United States Patent 10,233,495 (METHODS AND COMPOSITIONS FOR SCREENING AND TREATING DEVELOPMENTAL DISORDERS) - sequence listing, part 200

SEQ ID NO: 1436 - DNA, 57811 bp, Homo sapiens
tgaccacagtattcaatttattgtgtatttcaaaatagctagaagagaagatttggaatgttcccaatgcaaagaaatgataaatgtttgagctgatggatatcccaattaccttgatttaatcattacacattgtacacatgtatcaaaatatcacatataccccataaacatatacaattattatacatcaataaaactaatgaactgtaaaaataaaacctgcaaacaaccagaatgttcctcaaagttatcatgaataaatcatggtatatttatacaatggtaaactgtacaacaataaaaatggatcaactacagctatctgcaatatcaatgagtctcacaagcaatgtggagtgaaacaagatagtcacaattccaagtctaaaaagcatttaatgtttgaacatctgtaaaacaaaactgttgtttagagatgcttataaggaagaaaacttataaacaaaagcaaagaaattattattacaaaagtcagcatgggggctacacctaagatggagggagcggtgtcatcagtggtggggggagaagagtaggttattaaagggctctatttcttgctctggctggttattacatgggtgatggctttgtaaatgttctttaaactggcagttctcttctgaatgtatctgttttcttaatgaaatagaaagtagggtcactagttggaaatgatgagggagggagtattaaaagatttgaggaaaggaagatgatatgaaagaaccagagacactggagagtgaacagactagagaaatacaatatttttatcttttctgaaagctttttatattgtttctgatttattatgctttttctctcatatgcaacgtcattttattaactttaatatactacactatatatagttatcccagtaaaattataatgctatttagtgtttaaaaataaattgtaaatgcaaaattaagtcagaatataccatataatgatttgtcataaaacgttattatttcaacttgagctttataaaagctgatgtagtttatatttagagaaaaatatatatcacgcatatattgtgttgtatgatggctttttattcttttttttgactttttataccaagtaattttagtgttaaattgtatattttatgtgtttaaacagatatagatatttattacctccttattttattggtctcaactcctaaaactcatttttaatatcagaaaacatagctccattaacatcactaaactaaatattaacattgacatttaaaattacttgaaaacgactatgcccttaaattttgctcacaacttttaagtggaaaaagttgacaggtctgtataattttacaatattgcctaggatttcatatgaaccgatttgaaaaactcaattatttaaattataacatgctttagttgtaaatccatgtttatattataattgcatagcttcaagcttcaacatacataaagtttttataaaggcaaatatagtaaatttaagcaattattagcaatttagctttaaaatatactccgaggggaaaatacccaaactttttgcattgctcttacaccacggcaatcagcacagaatatttccatgtccagatgtgtggagttttcccacacactaagtgagcaatcagttctgcagcgaacaccagctgggtgtactccaattccattctgacacaatctacctggagatagcgtcatatcccacaagctgaggactaggtttcacaagactgttcccaggcccttcagacaccagtcgcaaatccaagcctccagaacttctgacagatgggcttcaagtttgagttcacatgaccccttctttgggtttaatttgccagaaagggtcacagaacttggggaaatacttaacgtttaccactttattataaaggatatatcaaaggatagagatgaagagatgcatagggtgaggtactgcggaaggggctcagagcttctgtgccctccctgggtcaccaccctccaggaacctccacatgttcagctatctggaagctctccaaacccagtgctttggggtttttatggaagcttcattgcgtaggcatgattgattaaatcattggccactggtgatcaacttaaccttccatccctctcccctccctggaggtcgggaatgaggctgttaagtcccaaccctctaatggtgccttggtcttcctggtgactagttcccatcctgaagcaaccagaggctgccagccatcagtcaattattagcatacaaaaagatatcactttggaaattctaaggattttaggagttgtatgccaagaaacaggatcaaagaccaagtatatatttcacaatatcacatatattgtgtgagttttcattttattatattctgtaataactgtcccattgtcagagataaaacacggtctcttaaaaaataatttggatctacaaacattgaatctaggaatattgaaaactgatgtatgcaactctcagatagttcagggaaaaaatatcctgtgtgtgtatagacagagtgcacacttaaataataaagcaaatggggagaaacattaataataggggaattagggtaaaggggacatgggtgttctttaagctttatttatgcttgcaacatttttaaatgtttgaaattatttttaaataagaagttaaaatgaagaaagggacatggatggacagaatgacataagtggaaatcaccagtgtacttgggagatgaatgcatctttttcctttccttatgcagactctgtgttcatacttccttgaatccacaagttgagtactgtcccaacacatcccgatctgcagatgtggaagctcatcttcagctctcctggaccagccattttctgccaaccttggtggcaaatgctctctgacatcatacctccaacaaccatgtctttaatttctgtggcattcagtgagaagttctcactgctaaatctacaaccaagtaagacaaatacaggacaaatttggttcagtaaggagatgcaagaggagggcattactaagatatctgtagggggaaactataacacatgtcatcttggaaatcctcaaaattccagagttgaaacaaatggtacagttgtacagtgtgattctgtttgtgaaatttcagttcctgaactggtgctaatagcaaacatgccatcagtaatataaactcatcaaatgtgccagttgaaagtaatttttattattgttattattattatcagtagcagcatcattatcattagcacaaaactaaatcaattattaaaagaaagcaaaaacacagcccaaaggcacgtgtcttgctgacagtgagtcaataactttatcgtcatgtacaagggacagcaccctgaggatataccatatcacagcttgataatcaactcagtaatttgaccaacgttattgagcacctaggcacaatggaagattttaaaatgcatacaaaaatccctgctttcaatgagttttacagtctagtaggaggtattgaagaatacaagaacaaagggtcacatgagattagtgacataatggaatcagtaccctgtatgaagtgctgttagaaaggggcatcacagaggctgggcgcggtggctcacgcctgtaatcccagcactttgggagaccgaggtgggtggatcacctgatgaggttgggagttcgagaccagcctgaccaacatggagagaccccatctctactaaaaatacaaaattagccaggcatggtggtgggcgcctgtaattccagctactcgggaggctgaggcaggagaatcacttgaatccgggaggtggaggttgcagtgagctgagatcacaccattggcactccagcctgggcaacaagagcgaaactccgtctcaaaaaaaaaaaaaagaaaggggcatcacagagactaatgtcacattcagttggggaaaatcaagaactccatagagaaggtgacctctgagctgggcttcaaggaactggaaggattttggtagactggcatgtgaagaaggagcactgcaggtggaaagaatagtgtgggccagagtatggccatgggaaagttcatggaatgtctggggagagaacaatagttcattatggctagtgtttggggtttatgtaagtggagtgacaatatgttgaaagttatatgatgaccatattttgaatggctctgaatgacaggctaagatttctgatctttatgtcatagtaactacatttaaccacatcaacaaaatatgcaattttctgtgaagagatatggtcacttcacttccaggtttcttagggaaactcaaacggtttctaggcaatgttatcaccttgctctcagaaatgtcctagcagataacaccaagcagactatagcaaatgtttctattttgcatgtaattaaatcttttctttcaaagtttttattctttccatccatgggccacgctcttctcactcccatctccagccccactagttcttgtggcacctgacgagttcatgcaagcctaatttaggatttccagccacagctgctaccctgaaagtaggacccacagccttgagaagtgagaggtggtggtagaggcagtgaacaatatcatgaaaatgtagccatctgagaagttttatggaattcccatcctaagagtcaagcatagttctttgaaattggagttccactcagtttggtctggaggacacctagaggggtcccagagctcagagtgcctaagtaaggtcatctttttaagtttctgtttattgccaaggaattccttaaaggaatgacacttaatctgggttacatgttatttaaaggcctcctggctctgaggctactgaaactgtggagagactggggtgaacgtttctttttgactaaggaatacttttgggctttgtccttgctcaacaggttggtagttgggaacttctcccatgcaatgagtttatagatgctaaaggatggctgtattaggcaacctagccaaagaagtaagctatatagaaccaaccagggaagatttagaataacaaagctgccatgccacactttctgcagctagtcagtcttcagctctttcctggagtgcgacttcctctgcaggaagtcatggattgccgtagtgaggccccatgtcacactggaccttaggatgactagggagcctccacggtagatcaggagcagctttcggccccgagtgttccatacatcctgggcagaggcccacaggcttggcatgttctgccatccaatatgggactgcatattagcaaccagcacaatcagaggatacagaactaggcaggtgattgttccattgacactaccagacaccaaggcaggaacccagtggggcaggccttgctctgccaggccatcctggatggggtccttgaaagaaaaatatagagcactccccaggctgttcctggccaggacaggccagaaaccacgatagtagcccagtgacagccgcccccaaagcccataagaattgaattccttgagaatgctgaaggtgctggggaagcgagcttgcttgcgaccatcctggagcacattttgcaccctttcaaaggggctgagtgccacggcctccaccacgccagacatgagcccggcagcccagcggtgtcccagggtgtgtggcccaacaggagagagaaagcacagcaggctatcataagtcccaaacagaagagtcccttgcaacgtcttggagagaagaggagggtagattccccggtagaagtattgaggaccttcatgccaaagctgtctcacagcctctgacactgccatggcatggatctgttgccggaacacaaccttatagataggaaaggtcagaaaagtagacataaagttggaaacggccccaagggcataggcctgggaatgccagcttttctttcctggagcctctgctcgcgtcctgtgctgaagctccttcccgggagagtggttctgctcccccatgctgaagacaactgggtgcagatggaagaaactggcaagggtggaaaaaaagagattagactgaccaattaattctgttggcaagcattttcattgcttaattagaaatgaaccctaagaaactcaggtcgacggaaacaagcaactctttgagccagtttctgatatataagcacacccttaagaaattaagaattaattaactttaaattaaaagaaaggcaatcagtttttctggacagagccaccactacagtattttgctgacacagcaaatattccaatattcaaaggattacgactgaaaaacatgaaatagaggaggggaagactccaaaacttaatgcatcaactttcacgacatgaaactgtgcattttataaactacttgaataatacattgctattctgtttaaaaaaatctggcactatcttgtagaggcagaaaggcatttaacagttgaagtgcaatgctttctctaaaagttggtattaaatttggggagggggaatctcccctcgcctttctctccatagattcctgcccaagttgtagctgtttcatggcaacgcccagcccccctccagcaagtgaggaaaggaaagagcagctgcttctggaagttcagtgcctaaaggctcagcacctggcaacttctaagcctaacctttaagacctgtagctatataatagagcagggtttcttaacctcagtgctattgacattttgggcaggataattttttattcttggcgcctgtcctctgcactcgagaatgttcagaggctccctggcttcggctcactgcgtgccagtagcaccagtagtgacttacacagtgtgatgaccaaaaatatcttgagaccttgccaaatgtcccctgggaggcaaaactgctcccggcttagaaccactgtactagatagaataggcagtgcaaggaccccaaactattgctccttaccccagaaaggccaggaagcagatggctagtatgagaagcaacttggaagccaggacatatgaaggaattttgggatctaaagaaaaaaaatgaatgctcagtgcagatctgagggagtttgccagagaggaaagagggggtccctggctgacgagacagggtgtgcagaagccagagctgccacctcagggaaaggaacagagatgtgtgggtgtggggcaggaggacaggggagaggcggaggggcatgatggccaggacggagggcttccatctacagtgacagggacacaaagcttggcaggaactgcagacccacaagtttcacacagaaccctgggctatgtgatgggggcatgaaggttgggactctaattaagctagcaggccaatggggaaccagagagtccaagctgaggtccccagggaggagtagaagccacacactgcaagaagcccaatgcagccttcccgaggctgccaggccaagaatccgccttggtgtactactccttccaaaatcactcccatcagctctgctcttccctagccccttctccctgctccatccatctccccacaatcccattcctatccccactgctgcatccatatccccacaatctcattcctatccccactgctccatccatatccccacaatctcattgctccatcaatctccccgcaatcccattcctatccccattgctccatccatatccccacaatctcattctataccccctgctccatccatatccccacaatctcattcctatctccctgccccatccatatccccacgatctcattctatcccccctgctccatccatatcccacagtctcattcataccaccctgctccatccacatccccacaatctcattcataaccccaccctgttccatctatatccccacattctcatttctatcccctttgctccatccattttctcacaatctcactttaccaccacgcccctcccctggagccacactcaccttttggtggaggcagatggaggctcagcctcctgtactctgcccataaccacctccccctacccccacattccatgatggccttgagcctcagcctcctttaccctcatagccagtacactgggaggacccctctgcctctgaccctttagctgagaactgagcaggagtaaaaactcaagaggcccactctttgcatccctttgggccacctctggcccctggaagccccacttccatttctccagagccaaaggggactcctcccagatacccaggctgctaaatctacagaagcccccaacagtcctcagctctcctatcaaagatcttctttccaaagtcttaccttcacctaaataaggacaggtggtgaagtaaatatttgtcctttcttctacctcagagtgcaataatgttccatttcctccctaccatttataaacatgttcactgacaccatgaggcaggatgatttagcagaaagaaaactgggctaggatttggcagtgcaaggactcccaactatcgcacctaccccagaaaggccaggaagcaggtggggtagtatgagataccagcattctaagtgagttttattatcaacttgatgtgtgacctttagaaattcagtgacatcttggagccttacccatctgagctgtaaatggagcagaaagggcaaaataatttttagtcatctccatactgtatctgtcagaggggggtgatattgggcattcaggtcaatagttgatagaggaattgtacttttcaatccccaactccttctgccatttttgtaaatcattttgggggaataaaggtgaacaataattgagaaacatctaaccttaatatgtaatccattttataaatccaatcctttccattttatgggaggggagttcgtgtttctcccatgtattttctgttaagatgccaggctttggaaagggcagacagacccgagactgaattctgcctctgccacttagttgtgtgaccttggaaaagacatttcattcagtctcaggttcttcagctacaaaacaggggtattaagatccacctcaaaacgttgtggcagagattaataacataaaatgagacaaagtggttgagaatccataacatggtggccttgataagaaggatcaaaaaagatgcttctggacttcactatctgtctccacagaacgcatgctccttctggatgctctcgggacagccataaccagatacaggggcatttgggaacaaatcttctgttcccaagggaggcagggaagcccttacttccacaaataggaaggtgcaacataagcaatctaggagagcctggccccttcacatgaattcaaagtatagaccacagaatggacctagagttggccttaagcagatatcacctgtaccctatgacctgcctcctatgtttacagcctagtaaaatgagcccagaggattccagactctcccagccagtctagtccacatgggtagactgtgtgactgccccaggatccagccacaaatgaatgcatttgtctgttcattcagggcatctctcagccagtcctttggtctgctcacaaacatgtattgatcatccactaaatcattgtgggtaaaccaccatagagctagagtgaatagaacttggtgcctgccctcaagtgcttagaaatctagtcaactagcttgggagacaggtcaacagtgtgctaaactctacagaaagacaaaataaagggtacagtaatgaaggtggaagcaaaaagacaacagcaatttattccacctgagaaggggcatatgactcaatccttaattgagtagagtagaataggctgttgttaggtaggggagtgagggcaagcattctaggctgaggaagtggcctaaggcacataggcttaagagtgtgagttgtgcatggggctggcctaccccatgtggtgagaaggaaatagagctgtggttgacagagagaagcccatttaagatgaggaccacatttgtcttctccgctgcattgtgttgtagggcacagagatgggctctggatacaggcagccctgggtttgaatttcactctgtcacttcctagctttataaccttggccaagtttcatcatctcgctgatcctcagtatccttatatgtaaaatgattgtcatgaaggatgcatgagacaaagtatggaaagtgcttagcacagcacctggtatataagttgcttcataagttatattagcagtttcattttttaaaaatgagataataggaataaaggcaagataacaattaaattgttctaaaggctgcaattggtctaatgaactgggttatctacagaatgcattttggactgcttgtttggaaggcagcaaagaagagttttcatgggctttggagttcgacatccctggcctgcagtctcagtgcctccacttacaagttgtgaagcctgacacaagttacttaatgtccctgaaattcagtttccctttctgcaaaatgggatacaatagctgtctcaacagggttgataagaagcttaaaagagataacagacagaaagttcctggcacaaaggaggcaggcagccaaaggcagctattattgtttcaactgaaagctttatctccaaaccttcaagcttttaaggtttatttgttgaaattagaaaatgtggtctcattagaggcatcagttggaacacactcatacatgtgaggccagagataggatgtcctgtatccaattgaagccaggttgcaaatactacccccatccctgcatgaagagtccctcgctttgttctagtagcccaaccctggcacctttacacaatccatttcctgtcattatttttgtctgagctctgacacctattcttggtcctatgtgattccatccctaccaagtccagctgcaaatacctaatttggtgataaagccaatttaaacactgaacaagactcttctgggaggtaagggtcagatgtcacgggatgggggagcagaagcaaaagtctgaaggaaacctaagagcaactgccagcatcacccctaagtgtgtgaggtgagcaacttgccttctccatacatccacactttccagcctccaccaccactaccccactgttccatccacagaccatgatcctgagatggaaggtgcttatctccaaatttttattgtttactccaaggaactctagatcttggggttgtaaataagagggcggaaaggagcaagtgaagtaccttggcagactgaagatgaagccaacagcagcggaagggcatcagactgtttacttgcttctaaacatcaggagtcaagaacaagccccacagaagcctcctagccacactatacataaaggaagtaatacctgctctctaagtcagggaaaaatggagcaggttttccagccactgccttcatggccattcactttggacagccctgcatgccgtttccatggagttgctccttctctggggccagtgatgccaaatccagcaaaggagaagtaccctgaagagctcacagaagggcaacctagcaacctgtccttgagccaggaaatgaaagagccatatcagcaacagagagctgtggtttgggggttaggttaaatggggttttatttctcacacttcttcatcaagcatggcttgaagaaggaagacgttatgacagacccatttgaaaatctgcaaagctgtgggctcagaagaatgtacggagtccagattctttgcatacaattccaggaaggacctcgggtaggaacctgtgctctggagttacatttcatgacagatatgccatggacagatacactgatggcaggcccatttacttataaccttcagcatcacgtggtggtgtttagaaaagtggttcatgaatctctctacacctcagaatcaactacagggctggttaaaactacaaatcacactcttcacccctagtcctactacatcaaaatcccccaggggtaaggcccaataatctacatttataacaagctctccaaaatgattctgaggcagctcaccttgtactcacactttggttaatagcatgagttctggattcagagactcagttcaaattttggcttcaccttgtattttcagacaaatcattttacctctctgagcctggcctctttggggtcacaaagggctgtcgaaattatgttgcttttataaaacaggcagcttgttgtgtaaaaagaaaaaaaaagaagaaaagaaaaaaagattaataaaaaaaatgaaagaaagaaaagtaccaagaagagtttcctcttctgtacaatgggcaccataaaggttgccctcatcttccctcagccctctccccactacctcctcaccccctccctcagcactattatcacattgagactgctgttgagatggtttgagactacctgtgcaaaaatactctccaggcagcgctgcagggcaacgaattagcatctagagagcaacagacggtgctaggttggatgctgtaacttatttgctgcaggatacaggccaaaactagtaacctgtctctctctggctcagtttcttcatctgtgaaatggagataatggttcttgctcaccaattctatgcaatcccaagttggtcctcccatctggctttggtttttctccactatcccttaatctgacagaatagaggagtgctggcaaggggcagcctttgaagtcagacatggtgacttgggtgtgagctcttaactctgcacttcctaactgtactgcctgggtgcttcagtcctttcctgttaaatgggcacactactacctccttcacacggctgctgagaagaggaaaggagatgtccatgcaggcgcctctgcacacagaaagcactcagtaaacgctgtttccccgcttccccctatacaaaggtgaggaactctcattgttcacttggtttctgtcccacctcgtgtttaaggtatccggtctaaaagcccggaggagagccgaggtgtaaggggatagggagaagggaagagatgggttagcagcaaactcacggatgaaagggaaatgggcccagtccgtgcgtccgagctgctgacgccgtgccgcctcccgcgcctgtctgccgcagcccccgcccgccggcccgccggccagccggcccgctcccccttcttgctagcagtagcttcggggccggaggctgtgcggcgaggccgccccctcgccccgctgattggccgcgtcgcccggcccgtcacgctcttttgtctcagtcgccagagactgaaagcaaccgcggctgcccggagggccgaactggagggtgggcgcagccttggctgccttgggaaccgtgctgcctcgactcggctacccctcgctgggcggtcgtgcgcactcgctaggtcgggcagccccgggtcgcttagcggccgaggaggcggcagagatcccgttcccctgcagagctacggggaccggaaggcgaaacagagctgtggacgcgggagcacatgctgcccaccagtggagcacaagtaaagaaagaacgcgcgattgcccggcgcggagaggggtgggggaagccccgccaggactgggcggcgcccggcttggagaatcagtaactgcgaggcaggggatggagcactcccttggcctggttgcgctgaggaaggagttgtggttcatctggatgctgccgactggataggatttaggatttgcctggattaaggtgggtgggggtgttgtcgtaggtcgggggtgttgttgggtgtcgggggcggggtgtgttcggggaggtggcaaggggcgggaggagacgatcgcaagctgtcttgaaccccttttgcatctcctcatctcttcctgggaaggaatatgagggtgggaggttatccaacttctagtctctttctccctggcaggtcatcaaagccgaatccgaacttgaattctgtgcggcggattgcagagctggtagggcgagggtctcccggaggaaatgtaagggggatgcgcgggagggcaggaggcactttggcttgcgttcagaagatgggagagggaattttccgcctggcgacagtggaggcggtggaggggaggtatcaggttttcagatgaagctgtttccaacccttcctttccctccttcgcggcacagtcttgaggccctgaggactgggatctgcgacacccagtggacaaaagtcggccgtaccccagaggctaattttctcacggcaggcacctgttgcagaggctgcacgtaaaataaaggcgaacgctagtttccgagctcatgtaagaatctgagaaataacgggggaaacgttgacaagggggtgtgattgagacctgaggccatgaggttaatggtttcttattatcataaatctgtgacacacaaccattgagttccgttttgagggcccagtatcagctcccaacactatgtcatctagaattagaagcaacagttgtcgcccctcctggagtacaggcaggaggggatggatgtggctctgaaaaactacctactagcccagggacacctgctagctctggaatgttgtaattgccagtctcctgcagggtattgttaaggcactgggcagatataaaatgcactgcaaggctattcaggaagatagagaatgctactgcagactgcttccccacagcccactatcttattaaccttttttactttccttagaatccctactgaaatataaggcaggcacagcccaggaacgttgctttggagaatcctgcagataaggcttttccaaaaagcgcgagcatcttgttgtattcagataccctatcgtcgtcagtcatggctagcatcactgcgtgtgtgggtaacagcaggcagcagaatgcacctttgccgccttgggcccattccatgttgaggtctctggggaggagtctctgtcctttagtggtcaaaatggcagagagaaacatgaagttgttctcaggaagagtggtgccagcccaggggaaagaaacctttgaaaactggctgatccaagtcaatgaggtcctgccagattggagtatgtctgaggaggaaaaactcaagcgcttgatgaaaacacttaggggccctgcccgggaggtcatgcgtttgcttcaggcggccaaccccaacctaagtgtagcagatttcttgcgggcaatgaaattggtgtttggggagtctgaaagcagtgtgactgcccatggtaaattttttaacaccctgcaggcacaaggggagaaagcctccctttatgtgatccgtttagaggtgcagctccagaatgctattcaggcaggcatcctagctgagaaagatgcaaaccagactcgcttgcaacagcttcttttaggcgctgagctgaatagggacctgcgcttcaggcttaagcatcttctcaggatgtatgcaaataagcaggagcggcttcccaatttcctggagttaatcaagatgataagggaggaagaggattgggatgatgcttttattaaacggaagcggccgaaaaggtctgagccaataatggagagggcagccagccctgtggcatttcagggcgcccagccaatagcaatcagcagtgctgactgtaactgcaacgtgatagaaatagatgatacccttgatgactctgatgaggatgtgatcctggtggtgtctctgtacccttcactgacacctacaggtgcccctcccttcagaggaagagccagacctctggatcaagtgctggttattgattcccccaacaattctggggctcagtctctttctaccagtggtggttctgggtataagaatgatggtcctgggaatattcgtagagccaggaagcgaaaatacacaacccgctgttcatattgtggggaggagggccactcaaaagaaacctgtgacaatgagagcaacaaggcccaggtttttgagaatctgatcatcaccctgcaggagctgacacatacagaggagaggtcaaaagaggtccctggagaacacagtgatgcttctgagccacagtaaggatctagtccagccctaaatgagtccttgactgtattcagagtctggtaatgggaataacaggagaggggggtgggtttctaactgcatgaattaatccacaaagcagttttcctttgggaaggagaagaggtcttgcataccagcacagtggatggggaatggtgtgacctctgtccctgctctcttctctgctggcttaagggtctattctccatgtgtctatttctttgatgactttatactttttatgaaaggagcatcttttcattaaaccttcaaaaataaaggaagatacaaaaactaaagtacaaattacctgaaactcagcacccttttgtaaccattgtcagccctttggtgaatgtccttccagatatctccctgtacctgtgtacccagatagatatatgtatagataagagtgaccaaatataagtgctgttctatactgtgtatttttcaccaaataatgtatctcgtggacttctatgtcgatgaatatatataaatatctaacttcatgtctctgtgtgatgttacttttagaaagataaagaaaaatgaaactaaatatagaagctataagggggggtcataccatgaggaggggtttttatcgacctcatttataggaaaggagaaaggaagctgaaatggactgaatatctcccatacaaccccttaacacaactgacctgtctcctaggtcatagagccaacccctgcacccatgagttaataatgttccaatgttttcttcttgaacatatcatgagacatcagatggggaacgggggggggacaaaaattgaaaatgggtattccagaggctccattcctgtttgtattgggaagggacaactactcctgcccgatctcttgacctcagattagagggtgataaaagatgacatgtgacctctatccctgagggtcccaagtttctggtaggtacagtagtccctatcttcacgaagaggtcaaaactggcaaggagcaggggggaatgatttcatttaaggcaaggagtggagtgaaatgaatgcagacctgaggacctgagggagtttgcctgggaggaaagagggggtccctgggctgacaagacagggtgtgcagcagccagagctggcacctcagggaaaggagcacagagctatgtaggtggaggacaggaggacaggggagagggggaggggtatgatggccaagctggtgggctcccatctacagtgacagggacaggaggcctggcagaaactgcagacccacaggtttcacacagaaccctgggctatgttgtagggggagtggaggttaggactctaattaggctagcaggctgatggggacaaaagggtctaggctgaggcccccagggaggagtagaagccacacactgcaaggagcccaatgcagccttcccggggctgccaggcccagaatccaccttggagtgctctccttccagaatcacctccaactctgctcttccctgggccctttcccttgcttcatccacatccccataatcccattcctatccccactgctccatccatatccccacaatctcattcctatcacccctgctccatccatatacctacaattacattcctatcccctctgctcaatctatatcctcacagtctcattcatacccccctgctccatccatatccccacaatcccattcagttcccccctgctccatgcacatccccacaatctcattcagatccttcctgctccatctgtatcctcagtctcattcctatccgccctgctccatccatatccccacaatctcattcagatccccactgccccatccatatccccacaatctcattcatatcccccctgctccatccatatccccacaatctcattcagatcccccctgcttcatccatatccccgcaatctcattcctatcccccttgctccatccattttatcacagtctcactttaccaccactccccttccctggagccacactcacctcttggtggagggagatggaggctcagcttcatgtgctctgcccatcaccacctccccctcctccgcattccatgatggccttaagcctcagcctccttaatgctcatggccagtagactgggagggcccctctgcctctgaccttttagctgagaactgagcaggagtaaaggtccaagagacccactttttgcatccctctggggcacctctggctcctggcagccacctccatctcaccacaggcaaagaggaccccaccacccacgcaggaggcagcttcatcaagcccccaaagccacagggtcccccaacactacctggctcttacagccccctattcctccctacctctcccaaagtctatccttggaggggatttgcccactcatctctccaagattagaatatagttccccttgctgctcaccttttctcaaattcactctataaatgctattgaatgatttacctagatatgctgtcataatttctttctgaaaccaggtagagtgaaaagaggaataaatgctacacctacccccatcctccttttcactggagttagcttggaggttcaagatcattactttgaaaccctgctgtgtaattcatcccctttccttcccccccatcctgtcctctgttgtgtaaacctgaaactgtctaaatttttacttcaccaaaatgatgcaaaagtgagactttttatttcattttgtgtcacactggctttcctttattcaagaagtatgtattttccctaattggaagacaaagaagacttggagtgattacagggttaagtgaaagaaggcttttaaaaaattttgtgtttgatacccttcatttataattattgtttttcctttcctttctcccttcattctcattagtcgccaagagatgaaaattgctcttttgtcttgtcaggagaaaccagcctttgaatgacctccttttgcaatatctccctccttcttgatactattttcccttgtttccatgacatccatctcatggtttccctctcccagatctttttgatgcctacttctcagtgtcttttgccgaatattctttcccttcctgatccttccacaatagcaataaaaattaaaatcactgcaagtgcgatttattccaagcttattacatgccaggcacccagtgccaagcctttaaaatgcattattagcttttcatagcaactcccttaagataagcatgactttctatttctaacttgctattaatttaattactattaattgacacatatttcagatgatgaaacaggctgggaagttaggaaacgtacttagggtcatgtaattatttagtggtacagtcaaggataagacactggactgactgatcccaaagtctgtgttccttacttgagttagccatcatgtgcacagcaccccatgaggtaggtgttactattatataaagatgatacatgaggaaagcaaggtcaacagacataattagccaaatatcatagcagcaagtggcttgtgcgccatacacaaggatgcagcctttaaggaatacttgtgtgacacaggccacctttctttcacatcctcttgttgcagctatccttcctgctgcctggcaaccatcccctcccccttcagagttgcattatcacattcagttcaggtatcaagtttccagtctatgcttttggtgcaaatggttttgaatttgatgtatgcaagaggagacagctgcaacaatgagtggaggagagataaattgttcaattcatggtgctggggggaacttcattacctgattggaaaaaaggtcagtttcctttctcccatgacactaaatatgaatcccagatacatttgagcagtaaatgtagattttatgcaattatgtattaattcttctttaatcgtatattttgttataaaatgaataaaaagaatcaaatgttcaaaagcaaccccttttaaagctgcaacacaatacatgttaaacctctgggttggagagaactttctatggttaagagtaatgaaagaaagtataaaagaaaagactgataactcagaagacagcattaacagaaataaaataccaacagtaagctgagaaacattggcaacaaatatcatggaaagggggcagggctggcaacaaataagagaagcaataataacagcaaatctgtattgtgtttagatagttaacatttattaaggtcttacaaagtgccaggcatattctacaagctctacatggctttatacttcatttcattcttacaacaagccctgagatagatcttatcttaaaatttccacattctaaaacactctttaagcggggggcggggggagcagaggaaagtgcataaaatataaatttacagcttaacaaattattataaagcaaatcaccataaagatcaagaaacagaacagatcagaactccagaaattcccataagtccttgcccaatcacaacctctttcctctctccaaaacaaaacaaaacactctcatgacagttttagctgttgctttcttactttcctttatagctttaccactcaaatatagatgcccaaacactactgtttctggagctttatataaatagaactataatgcatatatccttctatatccagctcatggcccttacaattatgcttctgagattcaacctggttgcatgcggcatcagttcatcattctcagtattgtgttacagctttccattctacgactttacaagaaattatccttttactgtcggtggacatttggactgtttccagttggggacaattatgaaaaatgttgctaagaacatgtttttaatgtctcctggtacatatgtgcacacacaaggtatatatgtaggagaggaattgctggctcatagattgtgtatattttcaacttcactagataccaccaaactgtatatcaaagttgtaccaattcccacttccaccatcaatgtttgagagttcctgttgctccacatcctcacaaacacttgacattgtcaacaaagcttcataacttttgcttgaggttttgtacgtctattattacatttagttcaaggtaattgtgtatactactataaattaaatattggtttaaatttcattttctaagggcttgttgatggtatatagaaatataactggtcttttgatgttgatattgtacactgactttgctaatctcttaataattttaatctgtagcttccttagaattttctgcatacacaagcatgtcatctgtgaatgatggtagttttatttcttctttcccaatccatatacatttctttttcttaccttactgcatcgactgggacctagagtacaactagtgagaagagacattcttgtcctattcctgaactcaagggaccactttgagcaattcaacattaagtggatgcttgctgcaggtttttagtaaataccacttatcagtttaaaaatgtttccttccattcctaatttaccataagtttttaaaataatcaatggatgctgaattttatgaaatgctttttctgtatctattatatatgcttttttctcatttattagttaaaatgctaaattacattatttgggtttctaataataaaccaaccaggcattcctgaaataaacaagatttggtcctgatttattacaattgttatatattgctggattcaatttgctaatattttgtttaggatttttagatctatgtctgtaagagagattcacctgtaattttcctttctgtataatgtctttgtgagattttggtatcaaaggtttgctggcctcctaaaactagttgaggaatacaattcttctttggctttcttcatttaaaaaccaggcaactgaggtccaaggtgtttagattatttttcataactgcattaaatccaattatttacttgtatccatgatttattaaaccagcctctttagagccattcattaccttgtttccttgtttcactgttataaacccactgagaaaagcatccttattcacatacaggtttgcacatgtgaacgattatttcctgaggatacattcctagaggtgacgttactggaacaagcactatgtttcacaggaaccagagcagaaagagaggtggcctgtggcacatcctactttagtagctctggctcacattcagggcccttcctcatctcttaaacttgctgggaataccctttaactctgagctactagagactttaatacttaataatatttaaaggtcaactcagctctaagaaactccccaaattaagttttcaaatgatttggcaggaggagcgggttgtttttaacattttcaatggaactttccaaacccacatgaaattatagaaaatgaatgatgaatccccatgtactcatcattcagcttcaagaattatcaatatgttgcataatttgtctcatcccccacattttgatgaagtattttaaagcaattactagacatcacatcaaatggtatgattcatatatatatatatatatatatatatatatatatatatatatatatatatatgaacatatatatttggtagagatggcaatcgcactctgttgcccaggctggtctcaaattcctggcctcaagtgatcctcccgccttagtctcccaaagtgctgggattacaggtgtgaaccatcatccctggcctgattcttctgtattctacccatagttctatcccccctttttgttccaaaattttcattgtggtaaaagttacaaaaaattcaccattttgaccattttaaagtgtacaattcagtggcatttagtacgcattccaaatattttttatttgtatatgtctttattctgagtccatttttccagaggtttattagttttttgtacatatttagatgtctgatttcttttttttgttttttttttttgttttttttttgagacagagtctcgctctgttgcccaggctagagtgcagtggtgtgatttcttctcagcaggtgcagacacttctctgaagaccaacagcagaactgagtctcaggatgggtaaaggcttctgtaaacctccagatccacagccccaactactttcccttcaccctggctgaataccacatcttgaggcaatcaattactaaaaggctgctcacactctctttttccgtaatgagactacttcagcccccttttatttggctactctaaattctccttttatagggatacaacagccctcaatgacttcttgaggaaaaagaagataatcacaaattcagtttcaacaagcaggacattttgctatactgtaccaactaagccatgttcctcaatccagcttttgggagtctgagaagaaatacctctcagagcagggagtcaaggagatatatttttattccaatctgaatactgtactttgtataaaggtggctgatcaggttgcctgtggagaggttgggtggttggacaagaagagggatgtgatttgggcattcctgaacctttggctccttatcctcaaaggaggaaaggaacttgggcaaagtagttaacttctctgcttcagcttcctcaccagtaaaacggagacaataacaggaagtccctcacagggttgtggtaagaattaaatgaatgaacacttgagaagtctttaaaagagtgcctggtgcactgtaactactgtgccatagaatgccatcataacgacaccaatcgcttcgctccaaactctctgagcacccttgtagatggattacctaaaccgtccctcccagactcttcacagagaatttcattaaagtcagtagacttcagctactctctctcatgtgcaggggaaaacaatataatccctttatgagctaaccaaataaattctctcaggaactgcccttgcatgaagaacatacctccagggatgcttgcttagttggggaggtgagtgaggctctctggacctagctgagatggcctggacctaaaggaagagagtagctcaaattccccacagaataactcagaaactttgaaggatgggagctggtaagccaaagaggtgagggagctctagggtcaggcaggaagctcaatggaagagaaatttgagagaaattgttctaatattcttctgtgtagtttgctgatttgtttattttttttttttactttttttccctttttttaaaattatactttaagttctgggatacatgtgcagaacgtgcaggttacataggtatacacgtgccatggtggtttgctgcatccatcgacctgtcatctacattaggtatttctgctaatgctatccctcctctagccccctacccctcaacaggccccgttgtgtgatgttcccctccctgtgtccatgtgttctcattgttcaattcccacttataagtgagaatatgtggtgtttggttttctgttcctgtgttagtttgctgataacaatggtttccagcttcatccatgtccctgcaaaggacatgaactcatctttttttatatatttatagtattccatggtgtatatgtgccacattttctttatccagtctatcactgatgagcatttgggtcagttccaagtctttgctattgtgaatagtgctgcaataaacatacatgtgcatgtgtctttatagcagaatgatgtataatcctttgggtatatacacagtaatgggattgctaggtcaaatggtatttctgattctagatccttgaggaatcgccacactgtcttccacaatggctgcactaatttacactcccaccaacagtgtaaaagcgttcctatttctccacagcctcgccagcatgtgttgtttcctgactttttaatgattgccattctaactggcatgagatggtatctcattgtggttttgatttgcatttctctaatgaccagtgatgatgagatttttttcatatgttttttggccgcataaatgtcttcttttgagaagtgtctgttcgtatcttttgcccactttttgatggggctgtttttctcttgtaaattggttaatgttttactggttagcctttcaaaacaatttctggccaggcacagtggctcatgcctgtaatcccaacactttgggaggctctggaggaggattgcttgaggccaagagttcaagaccaacctgggcaacacagcaagaccccatctctacaaaaaataaaaatgaaaaaattagccaggcgtagtggcacatgcctgtagtcctagctgcttggggagctgaggcaggagggtcacttgagcccaggaagttgaggctgcagtgagctatgatcatgccactacactccagcctgggcgacaaagcaagaccttgtctcaaaaaaaaaatacattcaatttaaaaatgtattgtaacattgtttagtgtagcacacgctcaactaaaaagaaataacttttttcctttttttttttttttttttttttgagacaaagtctcactgtcgcccaggctggagtgcaatggcgtgatcttggctcactgcaacccccatctcctggtttcaagcgattctcttgcctcagccttcctagtagctgggattacaggcacacaccaccatgcccagataatttttgtatttttagtagaaacatggggtttcgccatgttggccaggctggtctcaaactcctgacctcaagtgatctgcccgcctcagcctcccaaagtgctgggattacaggtgtgagccaccacgccgggccaaaaaacaactttcaaacacagaaaggggaataagtagaagtgaaagttccccagcttcccacagtctggtctggggtgttcttcggcttttacacaaacacaaacatatctattcttgttctttttctataaaagttgggtcatagcaggtacgtggttctgatactctctttcatattgtctgctgtgctaaaataaaccctctccactgtcccaaaccttcagcaacatcctgctacttgccttgtgctgtttatgctctttggaccagctgcttgagagttttctgtcagtgaaaggaagaaattatagtttcacctcactacaatcatatcgtaataacagctactgcttatggtacccctactgtgtctggcagtctctttggtgctttacttgaattctcatacccattcctcacaacaaccccttggaagtcagtcccactattatcctatgtgggttcacagatgaaaactcaaggcccaaaaggtaatgagtgggaagttaaggagaaaagcacatatactggaggcaggacttgggcattcagcatctccttaaatctttacaatgaccttaagagggagctgtcaccacaaatgaggacactgaggctgcagagttcacagagcaagcagcattcctgttctctgccaggatgaagccactgagagttcgtaagtacatccatccctttccgtaaaacttgatgaaagaaagctagcaaagatctgaaaacatggagatacacgcagtgctcagtgactgcaaaactcaatataataaagatgtcaattttccccacagttatctatggatttaacataattactatcaaaatcccagagggatttttcatagatacacacaagctggcccagcatggtggctcatgcctgtaatcccagcactttgggaggttgaggcgagaggatcacttgaggccaggagtttgagaccagcctaggtaacattacaagacccagtctctatacaaaaaaattaaaaattagccaggtatggtggcacatgcctgcagtcttagctacttgggaggctgaggtgggaggatcgttttagcccaggagttcgaggctgcagtgagctacgatcacatcactgcactccagtctgggcaaaagcacttgttaggaggagatagaaaaggaaaagaaactctcaaaattcaacagtaaaaaagacataaatattccattagaaggcctggcacagtggctcacacctgtattcccagcactttgggaggctaaggtgagagcatcacttgaggccaggggtttgagataagcctgggcaacatagtgagaccccatctctaaaaaaaattaaaacattagtcaggtatggtggtgcacatctgtggtcctgggtactcaggaggctgaggcaggaggattacttgagtccacatcaaagcttcagtgagacatgattgtgccactgcactccaatctgggtgacagagtgagaccctgtctccaaaaaaaaagtaaaaaatagattccattagaaaatgagcatgaacatgaatagaatttcaccaaaaagaatacgcagatggcaaagaacatgaaaaacatgttcaacatcattagtcactaaggaaatgcaaattaaaaccacaataagctaagctatcattgtacacctataagaatggctaaaataaaaaacagtaataccaaatgttcacaaggatgtagaaaaaatggatctctcatacaatgatgttaggaatataaaatggtaaggctctggaaatcattctggcaatttcctatgagactaaacatgtacttatcatatgaccctgcaagtgcattcctgggcatttatcccagagaaatgaaaacttatagtcacacaaaaacctgcatgctgatgttcacagcaactttatctgtaattgcaaaacgaggaaacaacccaaatgtccttcaactagtaattggataaagaaattctggtctatccacccaagggaatactactcagttggaacaaattactgatacacacaacaacccagatatgactcaaaaggattacatttggtgaagaacgtcaatcccaaaagactacattgtataggactctatttatgtaacattctcgaaattagaaaattttagagatacagaacagattaatcattgccagggagcaaggatggggcagggtgggtatgattatgaaggggaagcacaagggaggtcctattgaacagttttatatcatgactgtggtggttgttaaacaaatctatacatgggataagaccacacagaaaaacacacacacataaaaatgcatgtaaaatggtggaaattaggtctatattctagttaacaatcttgtaataatttcctggatttgatattgtactataataacgtaaggtgccaccgttagaggaagcgtggtttcaggtacatgggactctgtacttttgcaacttccttgtgagtctataattaccttaaaataatttttaaaaataactagcgtggggctgggtgtggtggctcacgcctgtaatcccagcactttaggaggccaaggtgggcagataacttgaggtcaggagttcgagaccagcctggccaatatggtgaaaccgagtctttactaaaaatacaaaaattagcttggcatggtggcacatgcctgtaatcccagctactcaggaggctgaggctcaagaatggcttgaactggtgaggtggagattgcagtgagctgagatcacgccactgcactccagcctgggtgatagagctagactctgtctcaaaaaaaacaaaaaaacaaacaaaaaaaaaactagtgtgggattccagggtggcagaaagtagccttggcgaatttctttgctagacttgtttttcctgtgttagctgtcttccgtgcacagctggggtagtttaaaaattcctcctccttttgacaagttttacaaacagtgctaaaaagaagtgtatcagtgcttctttgtaaaaagcattattatgttttctaaagtgacagttattttaataatatatttacaaataaaaattatatacagatggtgaaaatattagtacttttagaccctaaagagcttttgctaatgtaggttacagatctatcaatatttattatattagaaatcaaaactgaaaaattttaaaatttgtattaatgtatttaaaataaatccactgattatcgtaaataaaattttattaaaataattgcattttcagaaacaaagaatttaggaatgttttacgtttctgaaaatctcttaaatgtctgcctcagtacaagacagctagattcccatatttgcttctgcatttaatgttgtaacatgctgttttggataaagtatatgaagacaaatccaacctcatggagatatgtagttggaaaaaggatttcccagtcacctgaaagggtctgtctcaggtgtctccaggactcctcacactacactttaagaaccaatatgttagagagacataatgaaacattttcagataaaatgttaagatgtcagcaatttgcactaaagtactccaaaacacacacacacataaacagacacagacacacacacgtacacacacacacacacacacccatgtatgtatagttgattcattatttgtggtagttatattctataaagtcacctcaagcaatgaattaccaaataccaagccactgctcctagtggaaatacaggtttagattcctgggagcctctggttgcattccttaaaatgatcaatacacaaccttgttttatgtatgcttctgtctaaagacaccttctttaatatatatttcttaaaataataaattatatgcagtattttatagtaaaacattagccaagaagggtttaacattttcctgatcctgggttaacataaccataaatttctttggttttcaaaagcctcacaaccatgctgtccactatgctttttctaatcagtagttatgaatccacaaattttgctgcttttccatttattccataccttcatcacacactaaagatgttattttagcaccatacagagcgtcttcacatatagactggcaagcctttcctattcctttttctggatgtactgtgttgctgatttattaacattgaactcacagcagacagcgttataactcatgcctgatggaagcctatctaacacatgtattttcctctacagggcacatcactgccttctggctcttagaaacactaggcagtacttcagcactatgattgggggacattttaaacagcaaaatcaccaaaaaagccacaaaaatatggcactagatcgactacgaaaagaacacttgcttacagtatgagagcagaaacaagaacattgccttttctaacctcagctgggaacactgagtgcctgacaactaaattgttttgccactctgtgcaggtctatgaatgactattgaaagcactgcaagtatcgatttggggttatagataagtctgaagtaagtgaacttgcaaatatgaaatctgtgaataataataataaactttttatatatgtatatatatataactacatttatatatataagaatcaactatatatataaatatatatgtagttttatttatatatataaaactacaaacacatatatatccacacaaatgtatgtgtgtgtgtgtgtgtgtgtgtgtgtgtgtgtgccattcaaatgatgagcagacactgtaattgttgaagctggatgataagtatatggggattcattttactagtctaactttgtgtatgtttgtgattttccataagacaaagttttgtaaagtagtttatcttggactgcattgcatttccactttctttaattccttatcagcacgcggaagtctgcagctgtcaaaggtgaagttcaagtgacgttttggtacaaactgccatccaccaccaatccaactgaccatacatccttctggggagtactaatccagtacgcactccctgctataacagggacagtgacaggcagaattgtaacatcaacagctctttctcttggagagaacctctgggtcagaggtaatggaaccctgtattattttgagagcccattgagcccagacaagctgactctgtggaagtgtggttttaatgtgtatgtatggctttagcagaaggtaacttggattctggtccgagggtgtggattccaatcacttaactccagcctgggttgagtcagcaatccagagaaagggcttcagtcaaacaattcttaggagatccagtactgtccaactaaccttcatatattctctcgactctagtacatggatatgcttgacatttttaaagaacaggaggtgggcagacacttcctgttttacaaggcgaagcatcccactatccttgtaagcaagatcagtctgtccagcagaattttgcatctcatcccttcccttaccttctcataaacctcatgcatcagccatctcctctctcccctatcttcaacattctctttctcctaactcttccccatcagcatatgcacactcccaagtctctgtcatcttcataaaaattctcccttgatcttatgtgatcctcccactccatcagatctttccctttccaagtttaacggaaatataacgtgcatgtatggtttccactacttcagtgcccaatgttccagttatatactgctgtgtaataaaccaccccaaaacttggggcttaaaacaataatcatttaattatactcatgactgtgtgggtaaggaatgtgggcaaagctcactagagaattctcctgtcccacgtggcatctactgaggtcactcagtggtatccagctggctggctaggttgttttggagggaccaaaatgacttccgtcatatgtgtggcgcattggtggggataactggaaagctgggctcagctgggctgtgcgttctctctccatgttgtctcttgacctctccatttgatttctccagcagggcagtcagacttcttacatggttcctgagggatccaaaagaccaaggcaaaagttacaggattcttacaacctatccttggaagtcaagcagcattaattccctgcattctttcagttaaacttttgtacagggcccaccagattgagcagtagggggactacacagaggtacagttacttggaggcttggttgataggagccacatgttacagactaccgcccccatgtactcctcaaaccactgcattcctcatcactccattgaaattgtaatctttgaggtaaagacagacctcttagttgttaaatccaatagatgcctgtcagtacttgttttgcttgttttttgtttttgtttttggaattggaccctattgaccactaaattccttcttgaaattctcctcccctagcttctgtatatcacctttccttgtcttttcttcagtctcctaaagtgacttatttcttaggctctccccttatctactgggttttgctatcagttctcttctcactctgtatatgctacctagttatatcaactacacctatagcctcatctatcacttatctactggtgattcctcaatatatatcgccatcccagacttctctccagtgatccagaatctcatgtactcacctagatgtccagcgggtacttcaaacagccaaagcttaattcgtcttccttacacgtgctctcttccttgtgttttctctcctgtatttaccacccgcctagatgcacaaggctgaaacttggacgtcatccttaactctaccatctctcctattatactgaatacaatctgtcactgatccccgaccattcaacttgctaaaaagcttgtcaatttatctattcctctccatcctaaatactaggtctctggcagaggactagatgggggtctcagttcatcattctgatctgtaaaccatatagaaattaacatttactataatacactcaaacacatttttttgtaaagcagaggtgatccagagatatcaggataggagatatttaatgagttaaactccacatggggagaggcactcaagttggtagcaatggcatgttgcctttcggtaacctctagggtgaggttacttcagttcctgggaagccccaactgggggcttactggctaatcaagctccttatgcccctgaacatgccgtcctgaaacatcaattgcatttagtgtgattataaaaactgcctttatcaagcctcatcatctggatctcacatccagattgtgtataatttcttaatacattgccagcacatcgtggctacacacaccacaggttacatcacagtgaccagacagattctggcttctagtaaatgaccaaatagctcctatcaaatccatcctccttcagatgtaacaactatacaccctggacaaaatttttttttaattacctgcaagtattgacaagcaacccaaggcaggcagaaactggaggagaatctacatttaaaagaagagatcagaactaaatgagattcccatttttaagactttgaaccacagggtaggccccaatcaattccctgatgggtgaaccttactgacttgaagacaagaggacagagttcagagtttccacagcagctgaaaactgtggggataaaatcttggaatggagagagccagataggcagagccctgaattctgtgtataaactctaccaaatcactggctgacctctgaattatgcattcatgggacagtctccaaacagtctgtataaggctaaaagaactgactagagacttcagttgctgcctgccatgagggagacagagcatggaatttgagtttagtcaagttaaatgctgctgaaacaaaaatgtcaatacttttcagagggatataatggaatccagattctctagaacatgtcctctgcaatagccaggagacaagtcaaaatgactgaacattgttttgagaaaagtcaaaatgattgaacacgtttcctatgggaaacagaaaaatgtaacctataccaaagaaaaaaggcaatcaatgaagactgaccctgagatgactgacatgttagaattagcagacaggaatttttaaccagctattataatgattcccaaggacacagaggaaaatatgctcataatgaatagttaccagctgtactgcaaccatgtaaagatgagcaccctatagaggtgggtggctggttcacagtctagaaggtagaagagactgggagtggcaagcctggccaggacctacagcacccaccgacactgtcttagttcagattcttattgtttttcatgtagaccattaaaacagtctcaaaaattgcctccctgcttctggttactatttactatgacccccagcacacacagaaaccctaaacacatctgcattgattccagaattacctatttgaacacagatttaattaggactttactgattccaagtaatagaaacaccatttgggccacagagtcaatttacccgaagtttcacataatcataagtagatgagcctcaaggacaagtacaatcagagactcgaacatgaacaggaatctttcaattgctcctcctgtaagttcacttcattctctgaaacaagtttcctccccgtggctgtaaaaagggccaccagcagcttctggccacacatctcctagctgtgccacaaaaccaagaggcaatattttccctcaattaaatttttaaaaattgaagaaaaacattctgattgtcctgacctagaccacatgccacacctcaaccaatcgaatcaactgtggccagggagacaggtactatgattggaagctctcatgagcactgaatggctagacaggagaggagcagcacaccagagtcacagaggggttcatttccaaggcaaaggaaggattctgggaaaagaaactgtcaaatgataaaggtctaacaggtttcctgtggttgccacttcaatgtgtggcaatatcatcctccacgcaaatgtcagtgtcctgggatttctcttacagcagagacttctgttgttccccaacatctgttctccccttccccctacccagtattttactgcttgaaacataaatgcaatgaccagaggacaagtgtcacacggtggagacgataggacagaaagtccataagttattttggatggctaataactcacagctgaacctgatgctaactgacaaccccctcactccccacatctaatcaaggcaaaacaacactgaagttaagagtgtgggttagagccaaaccacctgagtttgaatctaggctctgccacttactagttctgttcagcatattactttatctctctgttcctgtttccttaggcataaaatgatgttaatgtacctcataggtgggttgtgagaattaagatcattcacgtaagcacttagaacagtgctcaatgagtgttaactaccattttcaaggcgtctcaattttacctactaaagatcttggaagactgtgccttctttcacagcccaaaagccactttccatcacttcaatgagtcactgcctcctccacagcgtcctccacattgcctcagcctgacctttctgaaacaccttgatctgaccatgttactcctattggaaacccttcaatgattcttcctttcctacaaaataaagccttaactccttagcctggtgaccaaggttccttgcataagagcccgaatggactttctgggctcatctcctgccactcctccatgatgccccaaagcccagccacactgaattactctctaccttcaacttcctacctgcctctaaagtactaaccactcccgtgttccctccctcctgaactctttcctcccttggctgctgtggcaccacaccctcctggtttgcttccaatctccctggctattctttttccatctttctcatgggtttctcattcttcagcccatctgtgtcaaggttcccaggttccatccttagcccacttcctgtttcactgcatgtcctgcccctgagtgatggcatcccctggcaagcttctaagctccaccgacagcttcatgatccccagattttcactcctaacctctttcctgagttttggtttcacacatcctgatatatcacaccccctgaatagacacctcaacctcagcatgtccaaaaccgaactcgtgtttcccaccccaaacccacttcccctctttactctgaacctgttgctggcaccaccatcacccaagcctggaattcttcgatctccacatctaagaaacgaccaaatcctaattcatgtcctcaataactctccaacctgtcttctctccatactcactgccattgccctcgttctggcctaaatcccctctagcacagactctgccacagtcacctccctgcctgcctccactcactgctccaatccaatgggcaacctgttacccacctccagcgaaaaactcatcatgtcactgccctgcttgaaactcttcactagttcccactgctcaatcagacacaattattctgtgcctcacagtagttaaatatctactatgtactggagcctatgctaagtatgaggaatgcttgaaatggctgctgccttttaaggaatttaccatctatctgagaagacagacatataaataaccactaataacatgatgcaataagtcctgtgatagacacacccacagagtattacaggagcacaagacttaggggtaggaaccacatcttcctaatctttgtatctccaatatctgataccaactttgattaactagagaattttatttgaatactgaaaagatgcccttctctgagcctcagcttcccactatataaaatggctcacaactcacatatcaaaatatataattatgtatttatgttacatataacacacacattatatatgtatacaatatgcatacacattatatatgtatataatatgcatacatattatatatgtatatatgtctgacatagtgccggaagtctcaaaagatgtcagttttgcttctcccctcacccctttaactccatcatgggaggcatagcagaggaaacggcaggtcagtgatgtaagaattagaagcccaacaactgaagaactggaaacagcatcatttctgtcctctgtctggtaatgacagaatggctggagcactaggcagctccaaaacagccttgggcaggaacggcagtgctccaagaccatcagaacaaagggaaagaaatcacagcttgaactttcgtggacaggagaaaaaatctgacgtggacaggaacatggactcctggctggaagagggctgctcctttcctccgctacttgaatccttctgcaatatcgccacctggtggctatctagcatccctttacttaattccccagtgcagtttgctctgacagcccactgcactgtgaaaattctagaagggaacagcctcgctcagtgaactgtttcggaactgctcaaagttaatcatatccttctccatgtcctgcaaagtgtcttgtactcaagctctattatagcacctctcattgtattataaatgtttacctgtacgcattcattcatgcacccaacaaatttgtaagtgtcgtacctagaacagacaggcagaggagaaacaatgatgaacaaaaccagttgaccatgtaaagaattaaacatgtacacagagaattaaaatagccatatttccaaccactataaaataattattataatatttaatatttgttgagcactgaatactgtatctgtattatcccatttaatgctcacaactcagtgaggtagataatatgattatcctcgtgttacagatgaagcaaaagaggaacagaaaggttgggtaaattgtccatagtcacacagccaggaaatgctagagctcagattcaagcctgccctgggtccagaactcatgcaatagttaaaaacaagcaaacaaacaaacaaactactgtaacccccgcctcaatgcatgtttgatgattcaataaataaaaaccttgtacctcccaaattcaaggagataaaagttcaggtagtagaatctcctagtaggaggtttagctgatcaggaacttgactccatccctctgaatctcacctaacccctggagatacgctctgcttgatccctgcctctactgtagccctgcaccccccaagccccaaagtgagtgctcctcctttcatgtgtgaacaaacataaacctgaaaaagccaatccttcaagatggatcttgagcagctcactgggcctaaatgtaaaataaagccaacgagccatttgccgactaggggtcacacacatactctgagttccctgaaaacctgcactcttttatctttcagactttcagtgcttccctgaaccaaccaatcagagctcatcttcctcagccaatcagagctcagctgtgttgaccaatcagggctatgctatatggaccaaccagaactcagctgcattgaccaatcagaactaaccatgcttcaatccttcgttataaatgtacttttgttttacactggaggctgtgactcctgggtttgcaactgttcactggaagtctctttcttccagtctccttttcagagaccttttgttcacagatgttctgtctcaaatatagaccaaaaaaaacaaaacactccatatgattcttcctaacatgatggagacaagttggcattttcaagatgctaccaaattctaaaagtgaacagaacagaaataaatttcagaacgcattcaaaaagtttctattttgaccacactcacacggtttttaggctttgtgcatttgatatttggatttatggctagactcagagatttaacatgtggctgcccaccagccagcatagtggttcacgcctgtaatcccagcactttgggaggctgaggcaggaagattgcttgaggccaggagtttgagaccagcctgagtaacagggagacggcgtctctacaaaaaaaaaacaaaatttagccaggcatggtgacgtgcccgtacttccagttactggggaggctgagatgttaggatcacttaagcccaggaggcagaggttgtgaaaaaggaaaagttctctcgtaccccttgcagggtgtgcaatggggggtgtagctcacttcttcagtgccccactgctcaaacctctatgggagcatacagatgggctgggagccccacggcagtgtctaggggtgaatgtttacagctgaagccccagtgggcgtgtgttacagggtgttcttttagtttagctgcctgtaggcagcttgtgttagctcaattcgacccctgccttattgcaaggacagagagctttctgtatcctggagttcttgccttggtgtactggaggaatcagatcacacgtgggcttggagaatgagttcaagattttattaagtggaagtagctctcagtagacgggggaaccagaagggagatggttttcctctggagtcaggctgcttgcggcccaggttttttctgactgccctagccaaactccgtgtcgttctgccgctcaatggcctgccggcgtgctggtaactgtcgatgcgttcctctccacatccagccacctgtgtgttcctccactgatgtgctcctctcaatgcccagccacatgtgtgtctgcctgctagcgtctcggggtttttataggcacaggatggtggtatggcaggccagggtggtcttgggaaatgcaacatttgggcaggaaaacaaaaatgcctgtcctcacccaggtccatgggcataggcccgggggtagaggcctagccagggaccacactcttccctccttccatatcatttaaagggatcatgctcttcccttcccagtacttccctttccccttccctatcagttgcagtgagctgaaatggtaccactgcactccagcctggctgacagagtaagaccctgtctcaaaaataaaaattggctaggcgcagtggctcacgcctgtaatcccagcactctgggagactgagcccagtgaatcacttgaggccaggagttcaacaccagcctgtccaacatggtgaaaccctgtctctactaaaactacaaaattagctgggcgtggtggcacatgcctgtaatcccagctacttgcgaggctgaggtaggagaattgctagaacctgggaggtggaggttgcagtgagccaagattgcaccactgcactccagcctagacaacagagtgagaaactccatctcaaaaaaataaagataggctgggtgcagtggctcatgcctgtaatcccagcactttgagaggccaaggcgggcagatcacaaggtcaagagatcgagaccatcctggccaacatggcaaaaccccatctctactaaaaatacaaaaattagctgggtgtggtggtgtgtgcctgtactcccagctactagggagactgaggcaggagaactgcttgaacccaggaggcggaggttgcagtgagccgagattgtgccactgcactccagcctggcgacagagcaagactctgtctcaataaataaataaatacataaataaacagataaataaaataaaaataaataaaataaaatgtggcttttagtaaacactctatgcaagacattgtgctttgcactattgatgcattctctcatttaaacttctcaccaaacctgtgaagcaggtagatattcccattttacaaatataataggaccaaagagataaagtaagtttcccagggtcacacagccaataagcagaagatctggcatttgaacttaagttgtctgacatcaggtcttgaattttttatgactatgatatacagcctcccctccttatttatttatttattttgagacagagtctcactctgttccccaggctggagtgtagtagtgggatcaaggctcagtgccacctggacctcccaagctcaagaagcaatcttcccacctcagcctcccaagcagctgggactacaggcatgtgccaccacaccctgataatttttgtcttttttgtagagacaggattccgtgtgtgtgtgtgtgtgtgtgtgtgtgtatcacagcatagtttctggctttctcccagggataagcctggcttttattcttgcattggttcagtgaggggatttaattacatataatctccatggcttgtgttaaattgaactacttcttaccacctattttcttcaactaatcacctcttgctcactctgtagaactaggttaaaactcatagctcctgcaagaagccttccctggtctctccaattaccccctttaacattggtctctcccaaattcattctaaaggagaggtccaagtctaacaaattttctggggaataccataaacagtagaggaaattggaagtccatctctggggaaaaaaatgagctcaaacgtatctccagatgttttcatatgtctatgagcacagaaacagtctggcagggacaaaaatgacatggtctcactggctgcccatagttctcacccactggcctgcttgtgaacacagcccagcctccacccaggacagtcttttagagtcctgaagagacaggagaaggccaccttaagcattttttttggtcagtccaaatcctgcccaccgctaagaagttctgacccaaatatacacatatatcaaaattattatttcatacggagatctgattatgccccaggcaaaacagaaacttatgagtaggcattttcagaatggcagagtaagaacctccaaaaaatctgctcctcaaatcagcaaagagaatattggcaaaaattgttaaaatcaagtttttcaatattctggaaattacccaaaagcttgcagcgatctaaggagcatttattcaagaaaacaactgaatcttagcaagaacactgatctttgtggccttttaacttgccctattcacatccccctctcttttgctcagtgatagccttgaaaaccagaagcctcgcaatcgcagtaagctgtgaaatccagctgctgggacaactggatatgcgcctggaaaacaaagctgggctcctactttacaccacatgccaaacttacctgaaaacaaaacaaaggcataggaaagaaaaatgtaaaactcctagaaaacacaggtgtaaatcttcaaaaccttagacattcacatgaatttttacaataaaacaagtgactcagacattttgtaccttggcccataaccatgtggtcagttggtagccatactcaacatttataaccaatatctctgaatgctcactgattaaacaattccaacagtacaaggacttctactactctttttttccagatagagtctcactctgtcacccaggctggagtgatcatagctcactgcagtctccaccgcctcagctcaagcgatcctcccacctcagcctcccgagtagctgggaccacaggcatgcaccaccacgcctggctaatttttgaattttctgtagagacagggtttcaccatgttgcccaggctggtctccaactactgggctcaagcgacccacctgccttggcctcccaaattgctgggattacaggtgtgagccaccacacccagtcctaggacttccattcttacctacagatagaataggttacccagcaaaaactattgatgtatataaaatctaaaatgtggccacatatggagactttaaaagtgaaccagccttctcactactatgcttgactagtcttttaaaagaaaaaggttcaggatcagcctgggcaacatggttaaaccctgtctgtacaaaaaacacaaaaattagctgggcatggtggcagtctcctgtagtcccagctatttgggaggctgaggtgggaggattgtttgagcctgggagttgaggctgcagtgagccatgatctcactgttgcactccaactgtcaacacagtgagaccctgtttcaaaaaaaactgaaccagtttctgccagattaaaagaatgaaacttccatacatgtcattggaaataacactgtgttttcctctcacacaatgagacagagatgagcaaatgtcttttcaatctctgataactaagtactattaccaaggaagattgaacagctaaacgtcttcacagtttcaacactaacgctagccacgtgtcatatgttaaacacctcaaataagatatactgaggcaaacattcacataaccaaagcaaagtagaaatcgttttttataaacaactcgagataattggctgaaaatgattagtgagagttcctcaaaggctcgtcagcataggcaactacaatattaaatcttgttactctgatttccggcaagatagccaaacaggaaaagctctggtctgcagctcccaacaagaccgaggcagagggcgggtgatttctcgaggtcaggagatggagaccatcctggctaacatggtgaaaccctgtctctactaaaactacaaaaaaaaaaaattaactgggcatggtggcaggcgcctgtagtcccagctactcgggaggctgaagcaagagaatggcgtcaacctgggaggcggaacttacggtgagccgagattgcaccactgcactccagcctgggcgacagagcgagactccatctcaaaaaaaaaaaaaaaaaaaagaaggcgggtgatttctgcatttccaactgaggcaaacagggtctggagtggacctccagtaaactccaactgacttgttagaatgaaaactaacaaagaaaggaattccatcaacatcaacagaaaggactcccacaccaaaaccccatcggtaggtcacgaacgtcaaagaccaaaggtagataaaaccacaaagatggggagaaaccagcgcagaaaggctgaaaattccaaaaaccagaacgcctcttctccttcaaaggatcacaactcctcaccagcagggaagaaaactggacagagaatgagtttgacaaactgacagaagtaggcttcagaaggtgggtaataacgaactcctccaagctaaaggagcatgttctaacccaatgcaaggaagctaagaaccttgaaaaaaggttagacgaattgctaactagaatacccagtgtagagaagaatataaatgacctgatggagctgaaaaacacagtatgagaacttcgtgaagcatacacaagtttcaatagccaaataaatcaagaggaagaaaggatatcagtgattgaagatcaacttaatgaaataaagcaagaagacaagattagagaaaaaagagtgaaaagaaaagaacaaagcctccaagaaatatgggactatgtgaaaagaccaaatctacgtttgattggtgtacctgaaagtgacggggagaatggaacgaagttggaaaacactctgcaggatattatccaggagaacttccccaacctagcaaggcaggccaacattcaaattcaggaaatacagagaacaccacagagatattcctcaagaagaaccctaagacacataatcatcacattcaccaaggttgaaatgaaggaaaaaatgttaagggcagccagagagaaaggtcaggttacccacaaagggaagcccatcagactaacagcaaaactcttgccagaaaccctgcaagccagaagagagtgggggccaatattcaacattcttaaagacaaaaattttcaacccagaatttcatatccagccaaactaagcttcataagtgaaggagaaataaaagcctttacagacaagcaaatgctgagagattttgtcaccatcaggcctgccttacaagagctcctgaaggaaccactaaacatggaaaggaacaaccggtaccagccactgcaaaaacatgacaaattgtaagaccatcgacgctatgaagaaactgcatcaactaacgggcaaaataaccagttagcatcataatgacaggataaaattcacatataacaatattaaccttgaacgtaaatgggctacatgctcaaattaaaagacaagactggcaaattggataaagagccaagacccatcagtgtactgtattcacgagacccatctaatgtgcaaagacacacataggctcaaaataaagggatggaggaagatctaccaagcaaatggaaagcaaaaaaaagcaggggttgcaatcctagtctctgataaaacagatcttaagcagtagaggtccactccagacccggtttacctgagttggaaatgcagaatcactggccttctgcatcgatctcgctgggagctgcagaccagagctgttcctattcggccatcttgctggaaatcagagtaacaagatttaatattgtagttgcctatgctgacgagcctttggggaagtctcactaactattttcagccaattatcttgagttgtttataaaaagatcaaaagagacaaagaaggccattatataatggtaaagggatcaatgcaacaagaagagctaactatcctaaatatacatgcacccaatacaggagcacctagattcataaagcaagttcttagagacctacaaagagatttagactctgacacaataatagtgggagactttaacaccccctgtcaatattagatcaacgagacagaaaattaacaaggatatccaggacttgaactcagctctggaccaagcagggctaacagacatctacagaactctccaccccaaatcaacagaatatacattcttctcagcactacatcacacatattctaagattgaccacatagttggaagtaaaacactcctcagcaaatgtaaaagaacagaaatcacaacaaactgtctctcagactacagtgcaatcaaatcataagtcagaattaagaaactcactcaaaaccacacaaatacatggaaactaaacaacctgctcctgaatgactaccaggtaaataacaaaatgaaggcagaaataaagatgttctttgaaaccaatgagaacaaagacacaacgtatcagaatctctgggacacatttaaagcagtgtgtagagggaaatttatagcactaaatgcccacaagagaaagcaggaagattaaaatcaacaccctaatatcacaattaaaagaactagagaagcaagaacaaacaaattcaaaagctagcagaagacaagaaataactaagatcagagcagaactgaaggagatagagacatgaaaaccccttcaaaaaaatcaatgaacccaggagctggttttttgaaaagatcaacagaatacatagaccactagccagactaataaagaagaaaagagaagaatcaaatagacgaaataaaaaatgataaaggggatatcaccaccgatcccacagaactacaaactaccatcagagaatactataaacacttctatgcaaataaactagaaaatctagaagaaatggatgaattcctgcacacatacaccttcccaagaccaaaccaggaagaagtagaatctctgaatagaccaataacaggttctgaaattgaggcagtaattaatagcctaccaaccaaaataagttcaggaccagacggattcacagccaaattctaccagaggtacaaagaggaccgggtaccattccttctgaaactattccaaacaacagaaaaagagggaatcctgcctaactcattttatgaggccagcatcatcctgatacaaaaacctggcagagacacaacaaaaagagaatttcagaccaatatccctgatgaacatcaatgtgaaaatcctcaataaaatgctggcataccgaatccagcagcacatcaaaaagcttgtccactacaatcaagtcggcttcatccctgggatgcaaggctggttcaccatatgcaaatcaataaacataacccatcacatgaacagaaaaaacgacaaaaaccacgattatctcaatagatgcagaaaaggcctttaacaaaattcaacagcccttcatgctaaaacctctcaataaactaggtattgatggaacatatctcaaaataataagagctatttatgacaaacccacagccaatatcacactgactgggcaaaaactggaagcattccctttgaaaaccagcacaagacaaggatgccctctctcaccactcctattcaacatagtgttggaagttctggccagggcaattaggcaggagaaggaaataaagggtattcagttaggaaaagaggaagtcaaattgtccctgtttgcagatgacatgattgtatatctagaaaaccccatcgtctcagccccaaatctccttaagctgataagcagcttcagcaaagtctcaggatacaaaatcaatgtacaaaaatcacaagcattcttatacaccaataacagacagagagccaaatcatgagtgaactcccattcacaattgcttcaaagagaataaaatacctaggaatccaacttacaagggacgtgaaggacctcttcaaggagaactacaaaccactgctcaaggaaataaaagaggatacaaacaaatggaagaacattccatgctcatgggtaggaagaatcaatatcgtgaaaatggccatacagcccaaggtaatttatagattcaatgccatccccatcaagctaccaatgactttcttcacagaattggaaaaaactacttcaaagttcatatggaaccaaaaaagagcctgcattgccaagtcaatcctaagccaaaagaacaaagctggaggcatcacactacctcacttcaaactatactacaaggctaaagtaaccaaaacagcatggtactggtaccaaaacagagatatagatcaatggaacagaacagagccctcagaaataacgccgcatatctacaactatctgatctctggcaaacctgagaaaaacaagcaatggggaagggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaaaacctaggcattaccattcaggacataggcatgggcaagaacttcatgtctaaaacaccaaaaacaatggcaacaaaagccaaaattgacaaatgggatctaatttaactaaagagcttctgcacagcaaaagaaactaccatcagagtgaacaggcaacctacaaaacgggagaaaatttttgcaacctactcatctgacaaagggctaatatccagaatgtacaatgaactcaaacaaatttacaagaaaaaaacaaacaaccccatcaaaaagtgggcaaaggacatgaacagacacttctcaaaagaagacattgatgcagccaaaagacacatgaaaaactgctcaccatcactggccatcagagaaatgcaaatcaaaaccacaatgagatactatctcacaccagttagaatagcaatcattaaaaagtcaggaaacaacaggtgctggagaggatgtggagaaataggaacacttttacactgttggtgggactgtaaactagttcaaccattgtggaagtcagtgtggcaattcctcagggatctagaactagaaataccatttgacccagccatctcattactgggtatacacccaaaggactataaatcatgctgctataaagacacgtgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactattgcaaggacaaaaaatcaaacaccgcatgttctcactcataggtgggaattgaacaatgagaacacatggacacaggaaggggaacatcacactctggggactgttgtagggtgggaggaggggggagggatagcattaggagatatacctaatgctaaatgacgagttaatgggtgcagcacaccagcatggcacatgtatacatatgtaacaaacccgcacgttgtgcacatgtaccctgaaacttaaagtataataataataaaaagaaaatgtggcacatatacaccgtggaatactatgcagccataaaaaaggatgagttcatgtcctttgtagagacatggatgaagctggaaatcatcattctcagcaaactatcacaaggacaaaaaaccaaacactgcatgttctcactcataggtgggaactgaacattgagaacacttggacacaggaaggggaacatcacacacaggggcctgtcatggggtaggaggacgggggagggatagcattaggagaaatacctaatgtaaatgatgagctgataggtgcagcaaaccaacatgtcacatgtatacctatgtaacaaacctgcacgttgtgcacatgtaccccagtacttaaagtataataacaaaaaagaaaaaaaaatcttgttactcactgaatagttggccactgttaatattattactactttttacttacaaaaaactccacacacttctgttagttttaatcaagatgttcagttaaaaaataaatagttcaagatcttattttaaaaggaggcacaattatctatagatttttcatttatccacagcagtttcatttagcataatggataaattatcttcccattttcccctctactgtccacttctgtccactctgaagtctctgggatcaaaaagcccctcatcagcagcaaagcaaaatgctttgtgtaccagcctgtttcttctctaccaactatttgccttccttgctccttttacttcaatccttttatgttaaccaaactccccacctctgtttgaattactattgcttcgtaataaaccaatccaaatttagtggcattaaacaaccattttactttgttctaggattctgtggtttaagaattgagacatcatggagcagagatagcttgtttctacttcataatgtctggggcctcacctgggaaaaccagaaggctgggggccgtaatcctttaggagttttcatttacaggctactggtaaatgttggctattagctggaacctcggctagggctgttgatcagaggacctataggtggccttaccataggcctgggccttctaacagtatggcagcctcagggtaatcagactttgtacatggcagctcagggctctaaaggtgaatgtcactgcaggtgagccagaagctacactgcctctcataacctagcctcagaagtcacagtttcactgccccctattctattggttaatataatcaaagttggcccagattcaaaggagaggagacatttgaccctacttctcaatggaagggtggcaaggtcacattacagaagagagtgtgggatgacaggtactacggtggccatctctgaaaaatacaatctgccactttctcccatgtacttctcctgcttaagtatactttgatctgattttttagggaaaaaccacctcaggagactaatattttaactgaggctcctaagctctgttagatagtaaccagagggctgggcacagtggctcattcctgtaatctcaatactttgggagtccgaggcgggaggatcacttgaggtcaggagttcgagaccagcctggccaagatggcaaaactccatcttcattaaaaatacaaaaattagccaggtgtagtggcacacacctgtagtcccagctacttgggaggctgaggcaggaggatcacttgaacccaggaggcggaggctgcagtgagctgagatcgcaccactgcactccagtctgggtgacagagcaagactctgtctcaaaaaagaaaaaaaaaaaaaaaagaaggtaaccaaatgctttcatccacatccagccccaagctttcctgttcagcatatctgactatttatctgctataaatggccaggaaatctggcctccaataagctgctggacccagtgctgatcactctggaggaaaaaaagcaaccactgacatgtggcaactggcttggcactcacagctgggccttggtgttctcccgatgaacataacaatttcataaactgccactatcagacaaggccaatatgtgaccacagtgaccaataaaaaagcaagaccacctcataactgtatctgaagaaacaaaacatgaactttgactaagccataaaaatgaccaaacactctgctatccttgctaacagtgaccggtgctactttaccaattagcctccttctggataagagtcattaagatacacaatcacagaattattcccatttcctaacagagtccaatccagggcaaagcctcacttctttaaatcttccccaaattcacctaacacagattcaaatcccgtaataagtcctttctgacaccctccaacagagaagcaccacagcgcccatggtgtgcgctctccctccatgtaatgcactgagcaatcaacccaacctgttcaaccacaggtgtgttcctggtggtcttgggctagagggcagtgacgactcctctaaggacctcgcataagaaaactcgttcctagcagaggtcacttcccatcccctgaattctagctttcagtcagactttcgatttggctcttttacactgcagttttggcagacaattatataaatccttagactgccagaagctattaaaatgcccctaaagttatatatatatatcttaaatatatgtgtatatgagatctggtcccccaggtttcctccttatcaccttatcaagtgcagaaaggttattccaataacaatggcaacagctgccctgtccccagcacagtcacaggacctaaaggaaatctggcttcacacacagggtgcttaagcctctgctttgggaaaagcaataggtaggcataggacatctcagttgcagatcccagattcacaatcctatttctgccacctcctcctcctcctcctagtgtgttcttcatttttctcctaatcttattttgcaaagcaaaaacgtgacattatcattacccttttcctcctctcctttacagttctcactcacttgatgcaaggactcttaccctcagaaaaaccattccaaagaaaaaaccgacctccataacctagtagttcagtgccagaccagaatccccaccccacttcaggtcagagacacatattgatttaaagtttagtttaaggaatcagctgtagcacacagaaaatatggactgggaacaatcccatctgaacttgaattctggagtaatcgcgtttgctgctttgacacccatagcccaaaattctccttcacaaccatctgtccactctcagggtccctgagatactgaatgttcatgcaacaaaattaaatcattactactcaggcatcatttaggaaatggagctacagagttcaaacttacataagtttgttttatctcctcacatttcacggaaaataacactacctgtaagactaggtgtggatttagacagatgaggactactgtggaggtgcagggtaagtgcacaagcattaagtgagaggctcaccaatcacgtgcaaaagttgattaattttcaggagtcatatgtggttgtctcgctgactcctttggaatatggacatgatagagaacagatttcttttctgttttttttgtttcgtgttgttttttattatactttaagttttagggtacatgtgcacaacgtgcaggtttgttacatatgtatacatgtgccatgttggtgtgctgcacccattaactcgtcatttagcattaggtatatctcctaatgctatccctcccccctccccccaccccatgacaggctctggtgtgtgatgttccccttcctgtgtccatatgttctcaatgttcaattcccacctgtgagtgagaacatgcggtgtttggttttttgtccttgcaatagtttgctgagaatgatggtttccagcttcatccatgtccctacaaaggacatgaactcatcattttttatggctgcatagtattccatggtgtatatgtgccacattttcttggttcgctcttgccgcccaggctggagtacaatggcgcgatctcggctcactgcaacctctgcctcccaggttcaagcgattctcctgcctcagcctcctgagtacctgggattacaggcacctgccaccacgtccagctaatttttgtatttttagtagagacagggtttcaccatgttgaccaggctggtcttgaactcctgacctcaggtgatccacctgcctcggcctcctaaagtgctgggattacaggcgtgagccaccgcgcccagcctgagaacagatttctgaaacatccaaggcactggccattctagcaccttgctggcccctacaaagactcacaatagactcaggccagtttgtatggactttttggttgtctttttatgtgtgtctgagtgtttggtttggggtttcatttattttgttttgtaactggcctagcgagatttgggatgaagcattgacaagagtctagaatgattagtgaaatttctgaaaatgtgtcctagcctttttcagggtcatgggagggggtttgaacgggaggtataactgtggactgccaccctccaggagtctgtttagggccaccccctaaaggaaggcttcaaattaagctgtaacaaaatgagatttctgattctgtgttctagagtaaataaaatgatttcagtcacaccttgcatagcaacaggaatatattctgagaaatccatcgttaggcaatttcattgtgagaacatcatagactgtacttacacaaacctagagtgtgtgtatatatatatatatattttttttttctcatatggaaaacaaaatgttccagtaccaataatgaacatcaatcattaccgcaactgatctgcaatgccaatatcaagtgctgtatatcaggtttctatatatgctccattataatcttctgggactaccataatatatgtggtccatcgttgaccaaaatgccactatgcagtgaataactgtatttcttctaaagggagagttttattggtgggggtggaactacctaccaattctgacttcttatactaatctttgtctgtcaattagcttgtcacattgtctttttaatttttaacctcaaacataatttattaccagaaattaggaacacttcatttttcgttgttgatacagtggaggtgtgaactccactgtaaacaactacttgaatatataaaaatcagcaagggatttgaatagaaaactgctactttgtgtttttaaacaatttatggtataagtcactgtgacaagtacaatggagaaaaacaatttgctttgtttagttcaggaagatgacctttgctcgaccatccaaaacatacaaacaacaaaaacacatccattttattaaagacttaaatatatgacctgagaccataacactacaagaagaaaacctagggaagaaactacaggacactggtctgggcaatgaattttggggtttgaccccaaaagctcaaataacaaaagcaaaactagacaaatggaattacatcgaactaaaatgtttccgcacagcaaagaaaacaattaacagaggggagagacagcctacagattgggagaaaatatttgcaagccctacttctaataaggtgttaatgtccaaaatatataagggactcaaatgactaagtagcaaaaagacaacctgattaacaaatggacaaaggacccgaatagacatttctcaaatgaagacacacaaatggccaacaggcataagaaaaaatgctcaacatcactaatcgctagggacatgcaaattaaaatcacaatgatatattatctcacaccttccagaatggctattatcaaaaaggtgaaagataacaggccaggatatggagaaaaggcaaccctatacattgttggtgggaatataaattagtacagccattatggaaaactgtatggaggttcctcaaaaaactaaaaatagaattactatatgatccagcaatcccacttctgggtatatatccaaagaatttgaaatcagtatgtcgaagagatatctgtactcttatgttcattgcaggatttatcacaatagccaagttatgggatcaacctaagtgtccatcagtggatgaacagataaagcaaatgtgctatacatacacaatgaaatattattcagtcttcaaaaatcaggaaaatctgtccattgatgagcctggagaacattatgctaagtgaaataagccaggcacagaaagacaaatacttcatgttctcacttgtatgtggaatctaaaacaatggaacccacaaacacagagaatagaatggtggtgatatttcaaaatttcatattccaaaagagctaagagtacatttcaaatgttagcaccacaaaaaaactattaaattccatgttgagtcatttttgtgtaaaaaaagataaaattttaggtgatgaatatgttatttaccttgatttaatcattctacattgtatatatataaaataccactttgaactctataaatgtatacaatttgtaaatatacaataaaattatacaaatataaaaataaaaagattttctaagcagtgtcaaataagtccattttatttcatatctactgtgtctgaattcagacatgcctgacgtttaggagtgtgcctagccttccctaggggagatattctttttttttttttgagacagagtctcactctgttgcccaggctggagtgcagtggcgcaatcttggctcactgcaacctctgcctcccgggttctaagagattccaggagatattctttccaatttattgtcagctccgtttagacctatagttctccaagtatggccccatgtccaggagtatcagcatctcctgggaactagttagaaatgtaaattcgggggtccactcctgaccaactgtaggggcaactctgtggatgggacctagcaatcttggttttaagaaacgctccatctgattctgattcacaggaaagtttgagagccactgacttagactgctatactgttgtttctctggtaaacaaagaggcttcttttcttgttcagagaaatattgcttaggatttctggtgggtgcacaattccctgctgtgaaccgagtttgctggaaaaccaagtaactagcacctccatcgtagtcctacccagagcttgcaggctttgcactcacgtaagactgattcttccagaggcgcctggaagtcccattgtgatgggcaaatgctcttaccagaaataaactagttgtggggaccgggcgcggtggctcatgcctgtaataccagcactttgggaggccgaggcaggcggatcacttgaggtcaggagttcgaggccaacctggccaacatggtaaaaccccgtctctactaaaaatataaaaatataaaaattagccgggagtggtggtgggtgcctctaatcccagcaacccgggaggctgaggcaggagaatcacttgaacccggcagacggaggttgcagtgagcggagatcacgccactgcattccagcctgggcgacagaagtagagagactccttatcaaaaaaaaaaaaaagaaagaaagaaagaaaaaaaaaaagaaatacactaattttgggccttaaatgctactcagttctccagttcacctcaacagggagggaaggtgcttggaggaaaattgcacttcgtttttgccctgcttattttgtcttcaaaatatatgttaaatcaccgcatcaaagagccgtcccagatctcaactcccagatgagttcggtggcacccaatagattttcataacacaggatctatctctgtctccttgtattgtaatagcctgtctccaaatgcagatagcaaccggcaggctgtaaatgtcgaggaaaaagcctaattcctttcctcatccggagcctctagtgcagtacccagcacagagcaggtacttggtattttggtaagggaaatcaatcaacgcatcaatagcagaatctgaaaccagggacctagatctttccaataaaatcatcctgctgagatgtgactcagatgtactggtgcccagcagacaacacgttttcgccctgattttatcctccattcatccgtccgccccctcccccatagaccccgcctgtccccagctaaaaataatgaggggattcacacatctcagtgtcaacacacacaacacagttgacacgccccttaatcctacagctacgccatcaattctcgccgccgggtccgtccgcttgtcagtttcccctactcctcatcccctcgcaacttctgatcccctatcacttccgttcccgtttgcctgctaggctggaagcaggatgtgtctacgccctcagcccataagaagtgctacaaacctccgcctcgctcgctgtcatggcggcgaccgacggcccctttcctgtggcctcagaaagcagcgacagtcgcagtcaccggaccttcgcccatccgccgccctcacttaagcgacgcacaacggagctcccacaatcctctttgcttcc

SEQ ID NO: 1437 - DNA, 77 bp, Homo sapiens
taagacttactctactcagaaagggaatagttacatgtaatctaagcaactgatgcctttccaagtagggcacttcc

SEQ ID NO: 1438 - DNA, 38397 bp, Homo sapiens
cgccgagctgggccaatcctcttggtggaggaagctcggctgattctcggctcacgcgggaggggagtaaagggtggcggtccgggcctggagttcagtgggtgcagcctgcttgcgagctgaggccagacaggggggcgcctacggacgggtaagagtcgtggccttgccattggaggtcaccctgtgtcagcgactgggcagtgcgggagggtggggagctacggggtcgcccgggtcgggtgctttctgggttgacctaaggctgagtttagggaccgagtgcatcagagcagccagaaacgattaccttgcgtgttggagcagggactgtactcacggggcaactgagacccggagaggggaaggggtgtgctgagtgttgtcgcagaggtcggacggctgggacctaggaactgaatccagccgaggctcgctctttgagggtggcccttcgagagcacccctagactgacccagatgtataggccccagaccaggttccaagagaggatcactttagatcttacctggctaaaagcagcccaggacggtgaactggggcctttgggaacggactttgaaaggagtgagggggatgtgagcgagcatgaggggcggggagaggtcatcaaaatatactctttttgacacccacacaatgcagataaggaggagcattccaggccgagacgccctcatcagcagagtcacaggagttttggaagtgagaggtatgcttggagaattaaaagggagcgtgtgcaagggctgtggactgacatagacctgcagaagtggagctggaggtccagtttgccctctttagctatccccgtggcttttagccttcacctgtttttcctccaggcataggggcagtaatctagggagacagagggcagagagtaagtttctcagacagagaaaggcccgaggcttattagaaccttttaaatggagctgctgccctttgccctcttctctcttcagcagtgaacagattcctgacttttgggtcatcatcatccccccaagtagtacgagccagagttctcactgtgatctccaaagcttggcacgacgtgtccccttccatcgctccacaactcttctctcgtctggctcactccagccccagaacactggctttgtggttgaacctcatgtgccagccacactcctgcctctcatctttgtctcagttgtcctctccgcctgcctcctcttaggcaccctatttaagtattgcagcccccagtacaaacaagccactcaccttgctctacttttttttccaacagttcttatccccttctgacctactgtatattttgcttgtttgttttgctctttgttgtccctccactagaaggcaggctgtctgagggcaggcatctttgttgtattcactactggtactccaggacctagaacagagaggggcacatattagacaactgatgagtagctcccctgtttcccagctctcacctagctagtcctccctgctctaccaggttaatcttcgtagtgaacggccctggtcagggcatctccctgctcttaaaccttcagagcctgaaccgtaaagggctccttagcctggcctgtgatccctctgcccagttttgcccctggtaacccttctagcttaatgtccctccataccttgcttcccagtccgtcaacctgcagatcggaagcctgacagagtacaagggaaaaacacaagttctgcgcaggctgtgtgcaggctgtgtgaccttgggcaagtcgcttaacctctctgagcctgtttctcatttgttgagtgagaccagtactgtctacctgatgggatacttttgcatctcaatgggatgaactacttatatgtaaagtggcctgatgttgagcaggtcttcaggcagtattacagttgacccctgaacaacatgggtttgaaccttgtgagtccatttacaggcagatttttttctcatctctcccaccgctgagcagcaggatcagctcctcctcatcttccttctcagcatactcatcaggaagaccgtgaggatggagaccatgatgatccactttcactcagtgaatagtaaatatattttctcttccttatgatttcatagtaacattttcttttctctagcttaatttattgctgggacacagtatgtaatacatgtaatgtacaaaatatttgttcatcaactgtttacattattggtaaggcttccagccaacagtaagctatattagtgaagttttaggtgagtcaaaagttatatgtggatttttgacttcggggctccgtgcccctaacccccacattgttcaagagtcaaatgtagttcttgtctctgatttgctcttgtcattcccccccgcccaccatgcctggagccttagacttgtccaaaatctcttccctgcactgcagccaaggtgatctttccagtcgcaacactcactcctgcttccaacttctaggggctccaccatctttccccccttgtaactccctagcttggcacacagcccccacatgttctcaactttgctcccgatcttgcttcacacttgctgtgacacagcttgtcactgttataagaacatgctggctctgtgccatcactttgtccttcccaccctggccatggaatgtctttcaggacaccatgcgctctgttttactcactcttctggggccttttgaagtcagcttagggatctcctagttggggcaggcttccctgagccagcagcctgcattggtgctctgggcttgccctcatcagagtggaaacgcacttctgtgactctttgcttgctcctgtctcccaccctagatggcgggctccttgaaggttggcagtgtgtctttgtcagcttctgcctggtagtggctggcatttgataacttgtgaatgaggaaatcaatgcatgaggtgacacctgggggttcttttacaagttacagctcccgctttaaccctgggggtttgtttgagcctcacagtagctctgaggtagggaagaaggacgctgttttacagataaggcctcatggccagcggcagcacgataattcactcaaacccatcttccattccaggctgtctgctgggcctccaggggctcgtggtgtcctacagggtgctgagtgtgaggatgagagcagaaacaggtgctgtggaagcgactcaccttccctggggagggggaggaagtttcacagagggggcagttcagctaggccttgaaggaagaggaggcactcaccgtggagaggagagagaaggtattccatgcagaggaacagcgtaagctaagctcacaggcatgctgctgggtttctgagaggtctaccacaaaataaaagctggcgactttttttgtcctaaaagtaaatagagaaacaaacaactggtggaaacatggacaccgcaggtccgtggaaggacaaggtcaagctgggttgccccagcataatcaaggctaaagtgacacctctaaagagaaatgacctccaagctattggcctcactaatcctaatctgggtattttctttcccatatcacatctttgaattctgaaagggaggctttattgttgttcctacagggctcctgctttgctgtattttctctaagaaatatgtccataatgaaggtgtgtgccgcctcaggtgaatccttctctttgcatctgatcatctggcccagtcctgcagaggaggccaagcatgaggcatgaggtgatgggaaataggggaatcctcttttataatccaaggcttaggcccccatttcaggattccaaagaaagttctaagaaacattacttggcattccttggatagccaaactctactgaggtgtttggggaagggcagtttgcctggcattgtctgcccatggactgaagggatgagctctcagtggccacattctagcttcctgcactggaccttgtgcaagggtggggctccgacaacctttcccctttacaaagatgtcacacttctttctagaaggacgggacgctctcatctctctccctagtttgagacagaatgttctctccttttccctccaggaaatgttccccagcaggaaggaggaggttgggctaactcgcttctctcttctcgcttcacatgaggcggcacacaccttcattatggatgtgtttcttagaaaaaatacagcaaagcaggagtcctctaggagcaaacgtaaggcctccctttcaagatgtgatatgggaaagaaaatactcagattaggattagtgaggccagtggctacaaggtcacatctctctttttttttttttaattattattatactttaagttctagggtacatgtgcacaacatgcaggtttgttacataggtatacatgtgccatcttggtttgctgcacccatcaactcgtcatttacattaggtatatctcctaatgctatccctcccccaggcccccaccccccaggccccagtgtgtgatgttccccgccctgtgtccaagtgttcttattgttcagttcctacctatgagtgagaacatgtggtgtttggttatctgtccttgtgatagtttgctgagaatgatagtttccagcttcatccatgcccctacaaaggacatgaactcatcatttttcatggctgcatagtattccatggtgtatatgtgccacattttcttaatccagtctatcagtgttggacatttgggttggttccaagcctttgctattgtgaatagtgccacaataaacatatgtgtgcatgagtctttatagtagcatgatttataatcctttgggtatatatacccagtaatgggattgctgggtcaaatggtatttctagttctagatccttgaggaatggccacactgtcttccacaatggttgaactaatttacactcccaccaacagtgtaaaagtgttcctatttctccacatcctctccagtatctgttgtttcctgactttttaaagatcgccattctaactagtgtgagatggtatctcattgtggttttgatttgcatttctctgatggccagtgatgatcagcattttttcgtgtgtctgttggctgcataaatgtcttcttatgagaagtgtctgttcatatcctttgcccactttttgatggggttgtttgtgtttttcttgtaaatttgtttaagttctttgtagattctggatattagccctttgtcagatgggtagattgcaaacattttctcccatcctgtaggttgcctgttcactatgatggtagtttcttttgatgtgcagaaactctttagtttaattacatcccatttgtttattttggcttttgttgccattgcttctggtgttttagtcatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctccatatggctagccagttttcccagcaccatttattaaatagggaatcctttccccatttcttgtttttgtcaggtttgttaaagatcagatggttgtagatgtgtggtgttatttctgagcgctctgttttgttccattggtctatatctctgttttggtaccagtaccatgctgttttggttactgtagccttgtagtatagttcgaagtcaagtagtatgatgcctccagcttcgttctttttgcttaggattctcttggctatgtgggctcttttttggttccatatgaactttaaagtagttttttccaattctgtgaagaaagtcattggtagcttgatggtgatggcattgaatctataaattaccttggacagtatggccagtttcacaatattgatttttcctattcatgagcatggaatgttcttccatttgtttgtgtcctcttttatttcgttgagcaatggttcgtagttctccttgaagaggtccttcacgtcccttgtaagttggattcctaggtattttattatctttgaagcaattgtgaatgggagttcactcatgatttggctctctgtttgtctgctattggtgtttaggaatgcttgtgatttttgcacattgatttggtatcctgagactttgctgaagttgcttaaggagattttgggctgaaacgatagggttttctaaatatataatcatgtcatctgcaaacagggacaatttgacttcctcttttcctaattgaataccctttatttctttctcttgcctgattgccctggccagaacttccaacactatgttgaataggagtggtgagagaggggacccctctcttgtgccagttttcaaagggaatgcttccagtttttacccattcagtatgatattggctgtgggtttgtcataagtagctcttattattttgagatatgtcccatcaatacctaatttattgagagattttagcatgaaaggctgttgaattttgtcaaaggccttttctgcatctattgagataatcatgtggtttttgtctttggttctgtttatatgctggattacatttattgatttatgtatgttgaaccagccttgcatccctaggatgaagcccacttgatcgtggtggataagctttttgacatgctactggattcagtttgccagtattttattgaggatttttgcatcgatgttcatcagggatattggtctaaaattctctttttttgttgtgtctctgccaggctttggtatcaggatgatgctggcctcataaaatgagttagggaggattccctctttttctattgagtggaatagtttcagaaggaatagtaccagctcctctttgtacctctggtagaattcggctgtgaatccgtccggtcctggcctttttttggttggtaggctattaattattgcctcaatttcagagcctgttattggtctgttcagggattcaacttcttcctggtttagtcttgggaggatgtgtgtgtccaggaatttatccatttcttctagattttctagtttatttgcatagaagtgtttatagtattctctgatggtagtttgtatttctgtgggatcggtggtgatatctcctatatcattttttattgtgtctatttgattcttctctcttttcttctttattagtcttgctagcggtctatcaattttattgatcttttcaaaaaaccagctcctggattcactgattttttttgaagggttttttgtgtctctatctccttcagttctgctctgatcttagttatttcttaccttctgctagcttgtgaatgtgtttgctcttgtttctctagttcttttaattgtgatgttagggtgtcaattttagatctttcctgctttctcttgtgggcatttagtgctataaatttccctctacgcactgctttaaatgtgttccagagattctggtatgttgtgtctttgttctcattggtttcaaagaacatctttatttctgccttcatttcgatatttacccagtagtcattcaggagcaggtttttcagttttcatgtagttgtgcagtttttagtgagtttcttaatcctgagttctaatttgattgccctgtgtctgagagacggtttgttgtgctttctgttcttttacatttgctgaggagtgctttacttccaactatgtggtcaattttggaataagtgtgatgtggtgctgagaagaatgtatattctgttgatttggggtggagagttctgtagatgtctattaggtctgcttggtgcagagctgagttcaattcctggatatccttgttaaccttctgtcttgttgatctgtctaatgttgacagtggggtgtgaaagtctcccattattattgagtgggagtctaagtctctttgtaggtctctaaggacttgctttatgaatctgggtgctcctgtattaggtgcatatatatttaggatagttagctcttcttgttgaatggatccctttaccattatgtaatggccttctttgtctcttttgatctttgttggtttaaagtctgttttatcaaagactaggattgcaacttctgcttttttttgctttccatttgcttggtagatctctcttcatccctttattttgagcctatgtacgtcactgcacgtgagatgggtctcctgaatacagcacactgatgggtcttgactctttatccaatttgtcagtctgtgtcttttaattggggcatttagcccatttacatttaaggttaatattgttatgtgtgaatttgatcctgtcattatgatgttaggtggttattttgcccgttaattgatgcagtttcttcctagcattgacagtctttacaatttgtcatgtttttgcagtggctggtaccagttgttcctttccatgtttagtgcttccttcaggagctcttataaggcaggcctggtggtgacaaaatctcccagcatttgtttgtctgtaaaggattttatttctccttcacttatgaagcttagtttggctggatatgaaattctaggttgaaaattcttttctttaagaatgttgaatattggctcccactctcttctggcttgtagggtttctgccgagggatctgctgttagtctgatgggcttccctttgtcggtaacccgacctttctctctggctgccctttacattttttccttcatttcaactttggtgaatctgacaattatgtgtcttggagttgctcttctcgaggagtatctttgtggcattctctgtatttcctaaatttgaatgttggcctgccttgctaggttggggaagttctcctggataatatcctgcagagtgttttccaacttggttccattctccctgtcactttcaggtactccagtcaaatgtagatttggtcttttcacatagtcccatgttatttggaggctttgttcatttctttttactctttttttctctaaccttgtcttctcactttatttcattaatttgatcttcaatcactgatatcctttcttccaattgattgatttggctattgaagcttgtgcgtatgtcatgaagttctcgtgccatggtttttcagctccgtcagggcatttaaggtcttctctacactgtttattctagttagtcattcatctaaccttttttcaaggtttttagcttccttgcgatgggttagaacatgttcctttagctcagagaagttttttattaccaaccttctgaagcctacttctgtcaacttgtcaaagtcattctccatccagctttgttctgttgctggcgaggagctgtgatcctttggaggagaagaggcacgctggtttttagaattttcaggctttctgctctggtttctccccatctttgtggttttatctacctttggtctttgatgttggtaacctacagatggggttttggtgtgatgtcctttctgttgatgttgatgctattcctttctgtttgttagttttccttctaacagtcaggtcactcagctgcaggtctgttggaatttgctggagctccactccaaaccctgtttccctgggtatcaccaatggaggctgcagaacagcaaatattgctgcctgatccttcctctgggagcttcgtgccagagggtcacccgcctgtataaggtgtctgtcggcccctactgggaggtgtctccagttaggctacatgagggtcagggacccacttgaggagcagtctgtcctttctcagagctcaaacgccatgctgggagaactactgctctcttaagagctgtcagacaaggacgtttaagtctgccaaagtttctgctgccttttgttcagctatgccatgcccacagaggtggagtctatagaggcagtaggccttgctgagctgtggtgggctctgcccagttcgagcttctcagccactttgtttacctattcaagcctcagcaatggcggacgcccctccccctccaggctgcagcctcacaggtggatctcagactgctgcactagcagtgagcaaggctccatggccatgggaccctccgagccaggcacaggagagaatctcctggtctgccagttgctaagaccgtgggaaaagtgtagtatttgagcgggagtgtcccgtttttccaggtacagtctgtcacggcttcccttggctaggaaagggaaatcccccaaccccttgcacttcctgggtaaggcaacgccgtgccctgctttggctcaccctccatgggctgcacccactgtccaaccagtcccaacgaggtgaaccaggtacctccattggaaatgcagaaatcacccatcttctgtgtcgatcacgctgggagctgcagaccggagctgttcctattcggccctcttggaatgaactgagttcacatctctttagaggtttcagtttagccttattttgctgtggcagctcagctcaactttgtccttccatgggcctgtggtgtggggcaaggtggttggatttcaccagtacaacatatctctgttttcctatattatttttagcttaagattttgtcccagtgtacatcgtgggtgcacatattggtttttaatggattcaaataactaacattttaaaggaagagacttgaggcttctgatgtgtgaaccataacaatccaccagcccctaaaacattgctctttggagtcttgttttcagtagttcagagctattcttctgtatgtctgtgtggtaaagtagacataacagaaaatgtaccatcttcaccatatttaggtggacagttgagtggcattacatgcattcccattgttgagtgaccatcaccccatccgccttcagaactcttttcctcctgcagcactgagagtctgttcccatcagcagtcactccccactcacagagcatttgtccttttgtgtctagcttatttcactgaccataatgttctcgaggttcacgcatgttgttgcatgtctcagaacttcattcctttttatggctgaagaatatgcccgtgtgtggctagaccatattttgtttatctgttcatctgtcagtggacacattgctgctcctaccttttggctgtagtgattaatgctgctgtgaacatggatgtacaaatttttcttcaagtccctgcttttagtttttgggggtatatgcccagacatgaaattgctggatcctattgtaattctctgtttaatttttttgaggagctgccatactattttccacaacgtcgcaccattttacatgcccatgaacaatatatgagggttccaggttctccacatcctcactgacacttgctattttctcttttctggcttttgataatagccatcctaataatgggtgtaaggtgacacctcactgtggttttgatttgcattgccctgttgattagtgacgttgagcatcgttttttattttttgttttttgtttttttgagacagagtcttgttctgtcgcccaggctggagtgcaatggcggcaccatcttggctcactgcaacctctgcctcccgggttcaagtgattctcctgcctcagcctcccgagtagttgggattacacgcatgtgccaccacgcccagctaatttttgtatttttagtagagacggggtttcaccatgttggccagtctggtcttgaactcctgacttcaagtgtttcacctgcctcggcctcccaaagtactgagattacatgcgtgatccaccacgcccagcctgttgaacatcttttcatgtgctttttagccatctttaaagtagatcttctttggagaaatgtctattcagtcagagctattctcaatgtacattttaacccaagcgtatatcacatggtgaatttaggtgagtaggcaggggacgggggttgcctatgggatctgactcatttgcgcggctagctctgggtactccaacccatagagacagctaagctgtcaccaaaattcttatctgactcatagtatttacaaactttaaaataattggtatataatttgagacaaaggagattttgttttgacaagaggctggtttgcaaagaattgtgtgattattgtttcagcagtacagctccgttggggtgagacatgtttcttctttgacctcctacatcctcctctagcaaacgaggagaggaataggctctaaggcttcttgcttttgctagtcatacaaggggacttgtggaattggcagctctgctatttggatttcggcactacaaaggatactcgtatagtttgctgggtctgctgtaacagatgaccacaaactgggtgacttagaaaagcagaaatgtgtctctcacagttctggaggccacaagtccaaaatcaaggtgttgacaaggttgtgttccctctgaaggatccaggggagactcgttcttcattgtttccaccttctagtggctccaggtgttcctttgcttgtagccacatcactctaacctctgcctccatcttcacatggcctcctcctcttctccctgcctttcccctctgtatgtctcttataagaccacttgtcattggatttagggcctaccaggcctccaaggacctctattggcccattcttttcctacttttcatgcaaaacttaaggctacgggagcagttaaagttactttttggttcaagaagaactgaatgaagcatttggtgttagtcattatgctattcattgaatgaggccaaagaggaaatgattctttccacccaagtttgcttgcgagtcccagtctttctttacactcctgccccatgctgtcgctgtacacctactttacaaagcatgtccttggttgtttatttgttagccagcatctagttgttgcgacaaccccaggagttagcctttaggcaggacctgggagccgtttccaggacagataggacagcccctgcctgcccaagcttataccgcatggcagcagattagataggggagaactaaagtggtggagagagtccaaaggcagcccaagaggaggcataggcagggagactcctgcacaggaagctgtgttacaatgataataaaattagctgccttgaatggcgtgttgacaggtatttgacacaatcctcataatgaccttatgaggccatttactttacatatgaggaaaggcaagctcagttcttttaaataactcccccgagggctacctgctggtaaggaatagtagctgggatttgaacccaggcagccgactctgggttaatttattgccagctgcactgaggagtggcgtgatttgtgatttctcatgtgtagagggtgagcagaggcttacaagagcagaactccacaggggtgggcttgcttagcccggctggcctagttagcctgtcatgcggtcctgtcactgccccaggcacacgcccctcagatcccctgccagcagaggtcaataaggccttggtggggtcagaggccagatgtgagccatctccttgcccctgtagatgccatgtgccttttcatttgctcacatttccctgaatatctggggaatctggataagaagccagcagtgggcattcgtgattatatcatcactaaataacagtcacttgccccactgaagcccctgcaccttagatgggatatgcatgtatgcgatggagagcagtatgggagctctggtgggtgtgcccacacatggtagtctcatgacccccggccgatatgtgagtgcccactttgtgctgggcactatgcttcatgcccaagttgcaacagtgggcaaggctttggtgcaaggtgccaaaatccttgttctctagctgctttggtctagatacacattgagtcccagtgagttcaatatcagccacatgtctttcgaatgaacagttgacagggcccctaccaatgtgaaggggattctgggataaagggagggacagggcaggcacagagctacagattgacttcaatgcattctaaaaatggccatgacaagtcaagttttgacatacagtttcttaataacttccattatgagttcagaaaaatgttcccccaaatggctcctccagacattgagggtcctgcatccatttcaaggccattttggctttctacatgcccgtaaagtctgtccccactgggacacatgatcatgcccattcgttaaaagtggcaaggagtgtaaaattcgaggtgtggggttggattggagcaatcacagcaggtggaatcccagtgctgcctgccacctcctcactgaagtgttctgtgaatctagcctttcatgagcaaagttagactcttgtcttgtcgtgggttttgccatctccagatgttaggggagccatgactaagtaaattggcaactaccaagaaaacatggatgcaagaccaaatacatcatagtcaagtggcatctttgtgtttgcagttcagtatcatgggtgactgaggagaggagcaccctaagggctgtcactaaagccatactcctctgtttggcaacgttgtcggattttattgctaccgtctccctgctgtgaactgctgggtgcccactgtactctgatcacttctcaagggtttctgatggcccaagatgctaagttcctccacgcatcgtcagggcggctttaacttagccaagcaggagagctccgtctcctattgcactccactcatcccccgtcccagcatcccatgtcctgagctcctagacatgagcccttgtgcccatttcattgatgggaaaactgagctgcagcaaagggaagtgactggagcaattccgtacagttcgtgataggcccagagcaggactccctaggtgtgggcactgctacaccctaatgagcaccacaggggaaatccacgctgactgaagcgtgggagagccatggaaaaagctacaatgccaaagacgttttttatgttgtcactgataagtgagctgatttaactggcctcctgtgcgcctctaatctaacagtgtggtgagtcataggcccagtcgttggccccgttagccgggcatggtggcagacacctgtaatcccagctactcaggagcctagtgtcttgtcgaacagctgtcgctatggttcagctatttgtaaaaacatgaacggggggatggcatctgcccaaaacactaacaactaaagatgttttgacttaggcaacattaatgtctgtctctaactatgtctttaagaaaagaaaagttgattacaaacgggaccatattttgcttcgaaatggaaccagcagttagcgagccaatgagagaccaagtcgcacggactcatttgacagaggacactcccaaagtgaatgctgacatagaaaaggttaaccagaatcaggtaaggagaaagttgacacgtacataccaacaggctgatactatttacctgtgggtgaaaaattgtatttgtacatgtattaatcaatgttgggtattttttatgtaagatatatagctttgtttaagatgtgtcagttacttattgctgtgtaacaatatcagaacacagtggtttaaaagaacaaccatttctttgcttatgactgtggtttcggctgagcccagctggggtgttcttggatggtctcccctgggctcttgcatgtagttgcaatcacatggggaccccttgaagcatatgctcccaggtggccttgctcacacctctggtagtaactggtggctgtcaactgggcaccttggtttgccttcatgtggcctccagtagaccaggctgggcttcctagtgaaatggcagcagtatttattaggcctaagatttagtgtcgcaagtctcagtctgagagaggacttgaagaaattgttgagcctggtcgttgtcaggcttcctggagattcttcacatcagtctgcaaaggtttgctttgattgattcttaatcagtgctgcacttcaaaaatgtggctgggcacggtgtctcacacctgtgaaatcccagcactttgggaggccgagacaggtggatcaccagaagtcaggagtttgagaccagccaggccaacatggtgaaaccccatctctactgaaaatacaaaaaattagccaggcatggtggcagacacctgtaatcccagctactcaggaggctgaggcaggagaatcacttgaacccaggaggtggaggttgcagtgagctgagatcacaccattgcactccagcctgggcgacagagcgagactctgtctcaaaacaaacaaacaaaacaaaacaaaacaaacaacgtaattacatcaagacaaaatgtgtttatatcaaatgttaataggttcaagatccctaagaggttatcatgggccgtgaaatcaccctgtatttggtgtagaactcagagtcaagcctcctctgggcctctgtggttgaagccacgtgccatctgcagttcctcatttatgtaaatttgggttttatggctacttggcagccagcaaacaaaggtggattccaatggttatagcaaactgccattttcagctagtttcaaatttttgtgtccttcgaaataacatttttttctctcattagtggactgattttataagaagtaaaagttctaaatttagactactaaaacaaaaagaacacatttgtcttaacttactatacgttctgcataagacctctctgagaaaagggtcccactgctgacaacaaagcaaaacaagaagggttggaaaaacccagcgccctagactattctgttatctcaagattctattgcaattagattagtttgcctaaatggttttttttctttttttttttttgagatggagtctggctctgtcgcccaggctggagtgcagtggcgtgatttcaggtcactgcaacctctgcctcccggattcaagcaattctccctcctcagcctcctgagtagctgggactacaggcgcctaccaccacacctggctaattttttgtatttttagtagagacgggatttcaccatgttggccaggctggtctcgaacccctgacctcaggtgatctacccaccttggcctcccaaaatgctgggattacaggcatgagccaccgtgcctggcccctattcttaacactgtctccaagaggttgatcttataactcacctcagtaacccattatggagtcttgctgtttccagtcttgagttttatacttgattgttagtacatgttcattcttgtccactgtggctgtgagaagtaaaaagtggtcatgaaaagtttcatgtgatctcctgtaatcacacagcattataggtatgattatcacacatttgacttccctggggtaaaggccagtttgattcccatcactacaagggtctccagggaacagccattggcctactcatcccaaacattattgatagaacatttcaatatcataaaataatccacgtcacattgtccaagagtagcgtactgattagtcacaattaaaatcgtgaaatgaaatcacactggactaacagcaaggttgttttttgaagagattagcaaccttttgaaacacctgtaactagagatgccaaatgaaataaacaaggcagtctgaaatctttcaggatgctttagtaacatatctagttctgactgtctttgggcttagccagacttttagtaaactgcagaaatccaggttgggaaacaggcagctcagagttattctaaatagctacagtttgcctgtacagctgacttgggaggaggggagaagaaagggattgctagaaaagggattgatgtgagttttgtatttaatttggctatgacttgaggaaatatacatctcagtccaggtgcaaatcatgtaacctggtatgattacatgtgtttaggaataatcagaataaagcctagaaaagaacaggttgggaagttagttttgggtggtagaagaatggtgaggctgattttgttagtagattgcacatggacagatgaaggtaaagtacagtgccagctccagctgggcctggtggaatccagtatgagtgctgtttcagatgggacaccccaactgggagggaggtggatctagagaggatgtctggccctggcatcccttgagtctcttgcatagctcaattgtgttgatgtttaaggaataagtagggagatttgtttgttttttaaatctagaacataatttctttaagatctttcatttccacaaacccaagttggatttactgtatatgagctaaggaaattggaggttgtcatcttaaggaggcccagatacagttttagaaagaccctagggaggagggatatcacaggtcctcctcacagacacccatagccagcttgtctggtgtgcagcagccacagtttggcatcaacatcctgaaatgagggtatttaagtgcctgcatgtgctactgtgtcctttcattatgcccagtcaccagagttggaattacccaaggaatcgtgtgtgttgtggaggctgagacataaacaccatggctctccccatttcttcaacttccttgtagttcggaggagggaaagcagagccctgggctcatccatcctcactgcagccccaccaggagatcccatcaaggcggtcttagatttctaggctgaggcaagaaggggttgggcgatgagcccagagccacacagcccagccctgttgtggccagagagggaaagggactgactttgtcctgcaagtatggagactgctttcttctttctgttgttttcagtgcaagctatcagctaccaaatggctgccgttttgttttgttttgttttgtccttagagaagcgcccagggatcagctatcgggaacaagaaggtatcactgttttttggggtattttttagattgtccagttttggtcataggtggtttgatttcctttcactgaatacaaagcatggatcttgtcatcaaacccaaccaaagtcaatctcagtgtcattcgctatctctcttccctccttactgatcccaggagagaaggttagggttgcactagtgatggaacaccaggatgatataaagcttccaacttggctcaagaagagttccaaacaaacaagtatatctgccattgcagtggctcatgatatgtaagtctggactctgtagcttccagtcctcactaccctggtcttccccaccgttcctctctttccacaggccaagagatgcacagtgatcggtggctctggattcctggggcagcacatggtggagcagttgctggcaagaggatatgctgtcaatgtatttgatatccagcaagggtttgataatccccaggtgcggttctttctgggtgacctctgcagccgacaggtaatggaccatgcagccttgctgatttcccacgagcccacgaagggaaaccacgatacttcccttgctcagaagccagccaatttgtttgaaaaacaattgtttcattgtgaaaattttcaaagttataggaaagaacaccacattcttactgcttagaatgaataaccatcatctctgtcacagatactcagctgtgtcctggtagcacaaaagcagccatggtcagcacttaaatgaacaaatggctgtggctgtatgccagtgaaacttgacttcaaaagccgtccatgggctgtattgttccaactgcaaaacaagtgtgtgctgggccacagggtcttgattttttaattgagatataattcatgtaccacaaatttcacatttttaaagtgtgcaattcagtgattttcagtacatccacaaagctgtgcaactgtctcccatgatctaactccagaatatttgtattaccccaaaatgaaatcttgtagccatcccctctcttcccctcccagcccctggccgccactcatctacttcccatctatggattggcctcttctggacatttcatataaatggaatcatgtaatatttgtacctctgtgcctgacttttttcacttagcatgatgttttcaagcttcatccatgttgtacaggtatgaatatcttgaattttattagatggtgccaaatggctcagcaaagctgctatgtcaattttacctccatatccacaatgtggcacaagccccattgcttcacatctttgccaacactgggcataactagactttttggtgttgccattctgagaagtatgaagtggtgcttcactgatgttcagagtcacatgtcctccctgaccaagtaaccagccactctgccactgggtgatcggctttcaggcttcctcctgtgtgaaatgtttgtctgtgtcctttgcccctttgtctttggggttacctttgcttccttgttgatctagttgggatgccaatcctgtgcccgttgtacttattatggatggcttccctcagcctgtcactgggcccttattcttggctttggtgtcattcgctatatggtttgttgatgaaatattaaggccattgcttccgctgcaaagttacggttgttttctctcccgtgctgcccacacctccaggcctggagatggggtagacatctttcatgctcatcattgctgcctccgaaccgttctccctcatgctgctctaagcctctccagctttgaagaggataccctcagactgtacaaaccccgacaccgttccctccttgtggtggccacccacagccgcctgctccccttcccagtgactccacatcatttctcagtgatttcagctcctttctggcattattattggtgaattcagcgttcatgtagatgaccctaccaatgccctcgcctctctcatccttggcctcctctcacccaatgatgttgccctccactcccctgtcatcaccagtaagcacgtcctctccttcttctcagttgcaggcattctactctgagcactagctcctctctgtccagctcatgccctctagtgcctcagctgtcccgattccttaaccccacccagacatccagccatgcccaccatggctcagcctgttcgtgcctcactgcctttagttccctggtctgcttgttcgcttgcatagtcttcaccccttcccctttctcttctggttgtatgtatccataaagtttctccagagaaacaccagcagggggatgtgtggagaagggcaaggagagagatgggtgggtgagacggagaaagagaggttgagatttaattcacagaattggtttacatgattgtgggggctgactaggcaagtctgaaatttgtagggcagaccagaaactcaggcaggaattgatgctgtggtcccacgttagaatttcttcttacagaaacctcagtttcacttttaaggtctttgaactgagtatatactgcctgtccagagtagcaagggtaatctccttacttaaagtcagctggttgtagatgtcaaccacagctacaaaatacctctacagcaacacctacactgtttaatggagtcaccggggactagagcctggcccaggtggcaaataaatgtggccaccacagtgtacttcacattgtaacccccaccctggttaaatcttgccttgtgcatggccatggccctcaagcagacccttggtaccaccaagcaccatctccacaaacctgcccacatccacgtctctactcagcctcccctgctgttcccgaggacgcctcatccccaccaaagtgcccatcctggtgccagctggaagccacctcctcttccctacccagtcactgccaccagggaccttgaggcaaccatatctggtggttgaatctcagtcctcctctgacttggccctgtagcagcatctgatgctttctttgcttgccttctgagataccacctcactcatttctcctcctgcctcactgattgtctcctgatcactatcatttctaaactttgcagactccagaacttattctcttttcttctccaagtttagacagtgtcacagtgactccatcccatctcatggattaattactgtctagaagctgatgtgctccctgcttgttatctccaacccctagctctctcaggcacgtgtgtgtgtgtgtgtgtgtgtgtgagcgtatgtgtgtgtatgcctgctggacatccctgtttggatacctcatggacacttcaagcttgctacatccaaaattaagctcctggttccctgacgcaagcccctcccccaccacagcaaacctatttctgctaagtcttctctatctccataaatggcctactctgcttttccagttccatcaaccaaaaaccttagattcatccctgcccgattcctttctctctcatgcccttcatcccatccatcaggaaatcttgttggctccactcagaatagatccccaatccaacaacttctcaccccttccattgctgccaccctggtccaagccaccatcactgtctcacctagatgttagagggactcttaatggataaatcagatcacaccgccctctgtacagaagcctccagtggcgtccagtcccatgtcaagcaaacagaggcctctgtaatcacccatgaggccctgcacggcacgtccccactacctgtctggcccacttcctcccacacccgcctcatggctctgccccaggcacactggccaccaaccaagtttctgcctcaggacctttgcacttggtgtcctttctgtcaggaatgctcttcctgaaccacagaacttgctccctagcttcctgtaaatctccagccaccctgtgctaaggaacaggcccccgctggtctcccttactctgctctagtttctgcataacacctgccagtacggacgtcctctagatttacttgtttgtttgcttatttgtcctgattgaaacatgattgaccatgagcggatacagagcagaggaaatctctgaaatttgtcctctctaccatagaatgtaaactccacaaaagcaggaattttgtttttcgatcactgctttgtcccctcaaaggagacgagaatccttagcaagctttcacttctctccaaaaggctcccccgctgccatgctgttgttgctagtatgttatttcagctttccttgagtacagatttcaagggaaccctccagcatgccatgttgttctccagccacactcaactgctcagccgcaagcgtggagaaggggcgagttgcatttaaccagggttggagtttactagacaaatttaataaagggagaggggaacaaggcaaaggtggtgctggtggatcatgaaatctaagctaagtccaaggtcgatgtgatgtgggtgaaagacatggcaggagaggaccttttttattttattttattttattttatttttatttttatttttttagacatagtcttgctctgttgcccagactgtggcacaatctaagctcactgcagcctccgcctcccaggttcaagcgatgctcctgcctcagcctccctaatagctgggattataggtgcccaccgccacacccggctaatttttgtatttttagtagagatagggtttcaccatgttggccaggctggtcttgaactccttgtatcaggtgatccgcccgcctctgcctcccaaagtgctgggattacaggtgtgagccactgcgcccagccgagaaggacttttaaaatgtactttcacctgggtgtggtggtatgcacttgtagtcccccagctatttggaaggccaaggtgggaggatcacttgaggccaggagttcaagactaacctggactacataacaagaccccccccatttctttttttttaaaaatgtgtttttatagtcagtagagagagagagagagagaggagagagacagatatacatacatatagataaagtttatgtatatatagttatatagttttatacacacaatatgtattacataacacttttttttttttttttgagacggagtcttgcgctgtcgcccaggctgtagtgcagtggcgtgatcttgactcactgcaaactctacctcctgggttcaagcaattctcctgcctcagcctcccgagtagctgggattacaggcgcccaccaccacccatgactaatttttatattcttagtagagacagggtttcaccatgttggccaggctagtcttgaactcctgacctcaagtgatccacccgcctcggcctcccaaagtgctcggattacaggcatgagccaccgttgccaccgcgcccggcccatgacacttttaaagtcacctcggtcttgtgcatcttttgttgctgacaggaagtctactctcaagccggtcgttgttcgtttgtaggttgtctggctttccctcttatggtttttaggattttattttttatcatttatagtctatagagaatatatctgggcctgagttttagttttgattttaaatcttaacacctggtaggcctgtgcaatctgaagatgaatgtctttcctcatttctggaaaattcttcaaagattaactctaccccttttctctcttttctctctttctagaagccgtgctggacatatggtggtctttcattgtatcatctgtctcttatcctctctttcttgcattccttctctttctctttttgtactatttcataggagatttcctcctccctgcctctgctcatggccaatcgtgtttcacctatattcctcctcagattatgttgaagtcaatcctagacatcatatcattttatctgcaaatatttcagtatttgtctctaaaagataaggattatttttaaaaacattgacagtagttccttagtatctagccagcgttcagatatccctgaatgtcttataaatgtttttgtattattgtttttccaaataaggaaccaagcaagatcaagactatggatttggttgaaatatttagctctcttttaatttacgattcccttcatttttttaaacttcagtctatttattgaataactgatgtttagtagaaaccatgtttatggtgctgtagtatttcccacagtctgggttttgccgattacatccccattgcgtttaacatgcccttctgtcctccagtattttctgtatactggtagatctgggatggcgctgtccattaaggcagccattagccacgtgcaactattgggcacttaaaatgtggcaagtcagaattgagaagcactgtaagtgtgaagtccacaccagatttcaaaaactacctacagaaaaaaggaatgtaactgtctcattaaagttaatttcacctttttctttttactttttaatgtcattactataaactttaaagtcactgtgacttttattatgtttctactggactaaagacttgatcggactctggttcagtttttccctctggggtattattacttctgatactccaatagtaataagcatgcctagtgctcagatttgggtttctatataccatttcccataaaaagaactagggcttcttgggaaaattgctcattctaggaccctagggcaagggcagtacaaaatgagtctgggacattttcttagcacaaaatgaatggggacctgccaagaagatacaagagccaacttgaagggcttcccctggccaaatttgggacattttgagcattttgagcctctcaaaacataacagtagtggatgacaatgcattttgatttcaaaaagaatccgtgggctgggtgcagggctagcgcctgcaatgccagcactttgggaggccaagacaggtggatcacctgaggtcagaagttcgagaccagccttgccaacatggtgaaaccccatctctactaaaatacaaaaaaattagccgggcatggtggcatacgcctgtaatcccagctactcgggagaatcgcttgagcccgggaggcagaggttgcagtgagctgagatcatgccactgcactccagccttgccgacagagcgagacaatgtctcaaaaaaataaaataaaaaagaatccatgggtccatagaaatactgaaaataacaattggggtcagggagaaggggaagctctacagaggaatgccaactaataaatgtaaaggccatgaattaaaaggctagacttagaatgtcaccattttatacccagtacattgattattgttccaggcaaggactatcaataaatgctgaggttaattggtagaattaacatgctacagattacttatcaattgcaaaggaaaaggtacctttttgatggccggaatctggcagccatcatcatcaccacgtgctccaacttaatatcaccaaaagtgggacagacttgcacctcctgaggtaattccctgagaaggacacaccaccactgatgtggtattcttgccaaaaccattaagcctgaatctaatcttgaggaaacagactaatccaaactgaaggacagtctataaaataacccaaacccttgaaaaatggcagcattaaaataagacagaaaagacgggaatttgtctcagattaaaagagatggaagagacctgaggactaaatactacatgtcatgcgcaattggatcctggaccccaaaacaaaaggctataaaagacattactgggacaattgggggaatttgaatatagactaattattggataagaacatcatatctgttaagtttcttgagtgtgatcattgttttatggttatttaggagaatgcttttgttcttaggagatacctgtgaagcgtttagaggcagcatgatgtctgcaacttacttgactggtttcaaaaaaaaaatcatgtgattgtatgtagagagaggaaattgtggcaaaatattaattggcacataattgtcataattgtcttttggtgacaaacatgaatcatacttagatcatattacttaattaaggtttgacaaaatgatgacatgctattagtcttcatttagtagctccagtctttataccttaatgcagaataaatatttgattctttccctttatttacctgaatttttattcttgcttgtggtcaagctgtcccttctttgcccagtgggaacctcttcaggttggcccttgagtgcttttaacgtgaccccggtagtcttagctagctagcatcctcactctctggtacaaggtgtgcctggttcctcttgtgtgtttcctgtcccagatctgcaatcagccatttctctcaggagctcttgttccttttagcagtaaatcaaacagacctgttttaaaaatccctttcaggttgctgtattgtgtcaagtttcacaggaaggaatatgcctgtgtattggctatttactgtctttaatggtgtggaactttttcatgtgattcataatttctatctgagttcaccttcctggggagttttacctcctaggtgcctgctctgaaccacccaaaaggatgttgcctctgtgtggatcccacaggcttctcatgccccaaaccccttttgactggggactagttagtggggagaaggtgattaaagggacaacttggtttccatcccatgtacttcggtatcattgattcttttatgagaatgtatttccatattgattatagaattataagacaaggaacctacaagccacaggttggagggtgaaaacatgagaatgccattgacctgtcaaagcaggaatgattattttgtctttctttgcttttccaggatctgtacccagctctgaaaggtgtaaacacagttttccactgtgcgtcacccccaccatccagtaacaacaaggagctcttttatagagtgaattacattggcaccaagaatgtcattgaaacttgcaaagaggctggggttcaggtaaggggaaggctggagtgagtgctgtcaggagcacgtgatggccctttctaagggtgcaaggccgtagttcttgcagtctccctgggcctaggcggggttgcttcttaaagtgttgggaagatcttagaaatgaagcccttggagtcactggagatggtgaaggtctgcttgccaaggctgatttgagatgtaatattctaactgcacacaaatagaacatctgaggacctcaagcctattggccttcagttaaagagctgcagaacttagacattgcttatatttttattgtgataaaatatatatcacatacaatttaccatcctaaccatttttaagtgcggagttcagtggcattaagtacactcacaatgttgtatagccattaccaccatccatctctaaacctttttcttcttccctaataaaaactctatacccattaaacagcaactcctcaatcgcccttccctacccagcccctggcaactacccttctactttctgtctctatgggtttgacaactatagggacctcacagaagtggactcatgtagtatttctccttttgtgtctggcttttcaccgagcatgatgtcctcaggggtcatccatgttgtagcatgtgtcggaatgtccttcctttttcaggcagaacaatatttcattgtatggatgggccacattttgtttattcattcagccatggatggacatctgtgttgtcttcaccttttggcaattgtaaacaatagtgttatgaacacaagtgtacaaatatctgttcaagtccctgttttcaattctttcaggcatctacccagaagtagggttgctagatcatatactagttctacgtttaaccttttgaggagccaccacattgttttccagaccttgcttatattttaaaagaaaagcaaactgtgtttacccttagccaatagaaacgtgttataactcaggcctgaggggatacgaattttctgcccatcatagcttgctgcatcgttaccaatcctggttcttagaattgtctttagaggactccagccactggctaaaacggctccctgtcagctcagtatcctgaccctcacagggatgcatgccacaggtactgcataaattaagagaaaaacttgaagcaagccagggggttcctctcccaacaacctgtcctggcactgttggctggtccgcagcatcctcagccggcccagcagggttggagctcttctgggcttgggccctggaaaagatcacttataactgacccctagcagttgacaagatgctttgccctgctgaagttttcacctaattagctcctcgttgggtgaccaggggctaaacgatgtctctttgctagtaaatgggagaggtggggtcaaagcagattctccaagtcccagactctgcactcagccatgctgatgtaactggagccctgggaagggccctgctgctctttgttaaatggaaggttgggggcatacaacaaagatttgtgccccaggtgtggcggctcacacatgtaatcccagcgctttgggaggccaaggcaggaagatcccttgagccaaggagttcaagaccagcctgagcaacatagcaataccccacctctacacgaatttttaaaagccaggtgtggtggtatgcacctgtagcctcaactgtttcgggacgctgaggcaggaggatcgcttgagcccaggattttcaggctgcagtgagctgtgatcccaacactacaccccagcctaggcaacagagcaagaccttgtctcttaaaaaaaaaattaaaaaaacaacaagatttgagaataaaacagcacctctccactcaccacagcatttaagaaacaacattactggcatgtgtaatgtgtgcccatcctcgatgccattgctctcttcttgtagccatggatagcaattctgaatttgggtttatttccatttgctccatgtgtaagcaatataaagtattggattgcatgttataagattttatacaatgatatcttattgaacagatcctcctgcaacttgcttttttccccagtgttatgtttttctttattcatcttggcatatgtaactctggtttatttactgaaggggcagagtggcttagtgggtaagagtgcagaaagtgattgctgtgttgtattgaaggaacattttccaacactgagatcaaaagattatttaatgtactttttttcctcaaaggttttaagtgttgctttccacatttcagtctttaatccaccaggaatttatgtttgcttatggtgtgagatagagatctaactttcttccatgtgtataaccagttcagtgccatttattgcataatccatcctttctgcatcgctgcacaccatctgcagcatgtcttaggtgtttgtgtcttacatgggcctgttcccaggctctcccctctgccccattgacctccctgtctgcccatgcagagaagctctgcctttttaggataagtctcagtgtaccgtagataaatcacgcccccaaccaatttcttcaaacttcacttggctattctgagccctttgttcttctacatatgtttggcttaaccagttccttgctaaagccagctgagactgctgttgtaattgtgttgaacttgtaggtaattttggagagaattgacatctttcccatattgagtgttcctgtccataaatatgggatatgtttctgtttatctcgctctttaatgtcatcaatagagttttatactttacttcgtaaagattttgcatatctcgttaaatttatttgtatgtacttcgttttttgttatttaataactttctattacattttcagttattgctaatatataagacgagttaatttttgtatattgatttttaattcagcaactttgccaaacgctaatattttctacatatttgcctgtgttttctgtgtagatttttctctcatctgtaagcgatggaagttcagtttcttttcaaatcattataaattcgtgtttatcttaccctaccactctggctagagcttctcatacaatgttgaataagaatgggaacgatatgattcatgctaatggtgttcagtgttggatgagcttctcttaaccagcaggctggacgctggggaccctcataagagaatatcttcctttagaatagcatttcttaagaggtcgtgtggtgtgtgtattcctatgtgtgttcacatggccaggtcactatcagaatagccagtgatctttttcagacatcttcctagaagtttgcgggctgcccttcacttacaacagagaatcgctgtcatagtgagataccatgaatgcaagtctattctatctctcaggtgtgatgggatagaaaaaatgtgttatcccttgttttgaaaccaagatctcttgattcttggttagaatgtaatacatagtgtgtctggaatccacatagctgcaaaagatggtgatctttggattattttaagaaggcatgaaaagcaaaggcattgcagcaaataatttcttcagtgcctcgaatgcgagggcaacaaagggatgcccctgattctctttcatacaggatcatgcactgtttgaattgtgataatttgtgacttttattttttctgaccttcctctgtcagaaactcattttaaccagcagtgccagtgtcatctttgagggcgtcgatatcaagaatggaactgaagaccttccctatgccatgaaacccattgactactacacagagactaagatcttacaggagagggtatgtaccttggaactggttgagtgagcagactgaagggtttagaatcctaagaaaaatgtttatgaacttatgaagtttgtattctgaggcctacgtacctgatttgagatgtaaaatttgtgggtgaaattaaatttaaaaatactgtgagaggccgggcacggtggctcacgcttataatcccagcactttgggaggccgaggtgggtggatcacctgaggtcaggagttcgagaccagcctggccaacatggcgaaaccccatctctactaaaaatacaaaaattagcccagcatggtggcaggcgcctgtaatcctagccacttgggaggctgaggtatgagaattgcttgaacctgggaggcggaggttgcagtgagccgagattgtgccattgcactccagcctgggggatagagagagagagacgctgtctcccaaaaaaaaaaaagttactatgagaacagctttatgtggccagacactgttctgagtgttttccaggagtattttccttgtttaaaggtcacaattatcgcatcatcaccagattatagatgaagactgtggtgcacagatgcacagagaggctcagaacctttctaaaactgtgcagctaggaggtggctgaccccaggcagtctgtctacagagcttacagcccaccctcaatgccatgggagcttcctcgcctgctatgggaatttacagcagttgcaagcgtgcagacaggaatcaggctggaggcaccttcctagtggcactctcaccccctcccttacttagaaaaacaaacaacggaaggatcttgctttattttaaggaaaaagtacttttccacttggcaaaacagcttcatcaaagggcacctgattttagtatggttggattcagccacggtcgctaccaagccttcaggctgctggggctgtggggcccctgacaactgctagctgcagatggggattgtcaccctgaggccatcctaagctgcaggccaggagtgctcctgagcctgggatagctcgtcttagctgggtagctgtgagtatacccctcccaggtgtgtgcagtgtatcacacccactgaggttttctcgcaaagccggtacatgctgtactggagctgaacactgacctggctacctgagagccagctgcctcctggctgtttgccgtattttttttttttttcttttttgagatggattctcactctgttgcccaggctggagtgcagtggcacgatctcggctcactgcaacctccacctcccaggttcaagcgattctcctgcctcagcctcctgagtagctgggattacaggcgcgtgccaccatgcccggctaatttttgtatttttagtagagacggggtttcaccgtgttggtcggatggtctcgaactcctgacctcatgatctgcccgccttggcctctcaaagtgctgggattacaggcgtgagccaccatgcccagcctgtctgctgttgcttcagctcagaaagtcctggcagaactggtccacagggagacacaagggccacccagaccaggggtggaggcttgaactttggcaagccacagtcctggctccagactatgctgtcttgctccttggagcactcatgtgctcgaacttggcccaaggagtactaaagcctccctgcgccttgcaggcagttcagtcaccatggagaccctgtgtattctcaacccaatatgcctgatactgattgccaccagagctgagcccatctaggctcaggagcttcaaatgatggccttggcccagaccatcagtgtctcgcttatatcaacttttgggttctcaactggaaataagcaaagcctgcagatgactccagcagtaactcaccggaagcctcctttcagccgaggttgacatccactgttggctttataaccttcctactgatcataaaccaaatgtgatggggagctaggactccttcacctctcttccctttagtagtagagatgagccttggtggaagccatttgagggtttatttagtcatttcctccatcgctgtggggaccagagtcctggcgggaagaggagggccagctctgggaatctgttgagaggcagcttttccattgttgagttgcttaagatcactggggccaaaacatagaccagcactttgctaccatagagtagaagaaacccgaggtgacatgacagcaggaaccgtacttaccaagcatacagacacgcactgaagcaactcacatgggccatctcatgtaattcgcatgcagccccgtcagggtaggtacctttatgatcaccacttttacccacgataaaacaaatcctttggaaagttttgttacttttgaggcgaaacccatttcactgtgctttagactcttgagttctagtttgtccatgaagtcacacagaagtcaccctttccttgcggtggcaacaggagcactggctctggaccaggcactgctctgaggactttacatgtctcggcctcctttgccccccagctgctggcctgtttctccccaggcatggtcttcagacccttcaccttctctgaccctcttctgggcccacttgggtttctcagagccctcccctcggaggtgatactcagaattgcctggaacagacccggcctggtggaaacgtgggcggcacatgcagttcaagtcactggaggctcacggctaacttgtttgccagaacctttggacgttttccacaaactgctgccgaggcatgtcttctggcagtgttggtggattttagcctttgaacgcaaaccagggccttctgatttgatcttaccagtttttgcccagctgtctgtcctgcattttcagattttggtgtgagggtgggtggggtagagaggtagcccagaattataccagccactgatgtaggttgtcagctcaaggcagaccactgctcagtggccacatgccagcagagtgtgtcatctgtctgtcccccacgagtggtgcttctcacccagcgaggcactctcttggcttgggcctaggaatttgcaatggacgtgccccttctcccactctcctccaggcagttctgggcgccaacgatcctgagaagaatttcttaaccacagccatccgccctcatggcattttcggcccaagggacccgcagttggtacccatcctcatcgaggcagccaggaacggcaagatgaagttcgtgattgggtgagtcagcccacagcggctcttccctagtccttcctggtccatgctcgcattcagagagcacttggcaggagccacatggcattgtagctcttttcttatgtgactgtcttggtccatgcaggctgctgtaacaaaatacctaagactgggtaacaaacaacagagagcttggaggctgggaagtccagatcaaggcgttcccagactgggtgtccattgaggccctgttcctcatgagtggcaccttttcaccatgtcctcacatggtggaaggggcaaacaggctcccttgggcctcttttatgaggacactaatcccattcccgagggcagagcccccatgacctaatcaccccctaaaggtccctcttcacagtaccattgcactggaggttaagtttcaacatatgaatgttgcggggatgcaaagattcaggcgatagcagtgaccttgtccgctgtcctctgtattcatttcttgtagttgccataacaacctgccacaaagtaagtgcttaaaacaacaaatggattctgtcacattttgggaggccagaagtcctcagttaagatgttggcagggctagtgtcttctggaggttcgcagggagcgtctgttccaggcctctgccctagcttctgctggcttccagccatccttagcattctgtgcttggagaggcatcactcctgcctctgcgtccctttcacatggctgtgttccttgctttctgtgtccaaatttccctcttataaggacatcattccctggatttaaagcccaccctaccccagtatgagctcagcttaactaattgcatctgccgagcccctatttccaaataaggtcacattcacaaggcccaagtggacagaagctttgggaggatactgttcaatccagtgtaccctctcaggtaggctgggaaggtatttgtgaccctgtttggaaattgaagaaaccgtgactcagagggaaagcaatgggccccgggtcaaaggccagggcttgactgtccttgcatctgggaaggcaggcgggggcattacttttctcctcgggttaagtgcaggtggaggggcctccacaggggacaacagtgtgcctctctcccaaataggctttctcttccttcatttcctccttttctcctctctctcttccttcctttttccctctgccttgccttcctgtttctcactcagcctcactgctaccctgacttgtcaccttgaaggattacagggagactggtcaataaacggaggaccagagcaaggcgttggccccgtgtctcctgggaaggggctgaaaagctgctacccaaatcgggacaggagagacagcaccagtgttggccatgctggaatgggtgggcaggtcccccagctttcagattccactaaccctgaagacccaggagtcccggcccagtgtacatctttaaccagtacaggcatccatgagtgcctgggccggccttgccaagtgaggtggcagccattctgtaggtcacagtctctcaaatgccaagacttgggagtggccctggccttcgtgcaggggctcccagcacgtattccatcatcccttgtgcacctgcagaaatgggaagaacttggtggacttcacctttgtggagaacgtggtccatggacacatcctggcggcagagcagctctcccgagactcgacactgggtgggaaggtaaggcctgctgcaccggtccctgcacaggtgcctttctgcgggtttcttctccttgccattggatttgctggcaagttgctcctgtgatcctgtatcatggaggatctgccttaggaccccctgtgccaagatcaagcccctctgatagagcatgtggtgtcactgcagcgtcacatcacttgggcagccaaatttggagagctgacgagctgggattgaacagacattcaggtcacggtcatctatggtcccctgacctggctgcccacctgttggcatggctccttgtggcaggagcccacgtagattgggcagggtgcttgctcctcaccctttctcccactcattcctcaggtctctccctcccttgctgtttggtcctcttttattctcctgaacctctgccgtttccccactgataaccttcaaataagttgggaatagggtgggtgtggcattttttttttctttttttttttttgagacagtctcactctgtcaccctggctggagtgcagtggcgtgatctcggttcactgcaacctccgtctcactggttcaagcgattctcatgcctgagcctcccgagtagctgggactacaggcacatgccaccacgctcagctaattttttgtacttttagtagagacggggtttcaccatgttggccaggctggtctcctgacctcaggtgatctgcccgcctctgcgtcccaaagtgctggggtgacaggcgtgagccaccgcgcctggcccgggtgtggcttttgatttaaaacaagcagaacaccgtcaagaaatgtaatatgaggaattcattgcatccaaagatatgtagatgagttttatgatgattaacaattatcaaattaacaaatgtgcctttccaagtgcaatctatgcttcatttaaaatcctggcccatagatgaaactttcattgtctgccctttctatgccttagcagttgtgcaattgagggcaggccacgtggaaagctgcagcaattaggcagtgagaatgcgatctgcacgggcttaatagatgcttcaactttgggcaggtgggggtggtgtttctaacttcttgttcttgttctcccgccaggcatttcacatcaccaatgatgagcccatccctttctggacattcctgtctcgcatcctgacaggcctcaattatgaggcccccaagtaccacatcccctactgggtggcctactacctggccctcctgctatccctgctggtgatggtgatcagtcctgtcatccagctgcagcccaccttcacacccatgcgggtcgcactggctggcacattccactactacagctgcgagagagccaaaaaggccatgggctaccagccactagtgaccatggatgatgctatggagaggaccgtgcagagctttcgccacctgcggagggtcaagtgagggacactggaggctgggctctctcgacacgttgctcagccagtcactccttcccctgtggattgatgaaataacatcctttgaatgagtttgctctgagcctgtgactccttctgctaggcagagagcgcaccctactctttccgtgacgatgagggcggcaaaaacagacatttcttccttcatggaactggatttggatttcttgaagcaggcagcttcatattataccgatttgttctctgtc

SEQ ID NO: 1439 - DNA, 38397 bp, Homo sapiens; identical to SEQ ID NO: 1438

SEQ ID NO: 1440 - DNA, 5295 bp, Homo sapiens
tgagtaagccagaatggttgatagtgggggaggatgatgacgacgctgcctttgcccctgtcttgtgtgaaacaactgcctgtgggtttcctgcagcgcagtggggagtgagaggagaaacgtcctgccgtgccacagtgagtttgggtcaaaggcacacatggaggcagtcttggccaaagtcacaatgcggtgaatttcgctgtgcgccaaggaggttcctggccccaggagtgcgaagcgcctgcgcagtgggccccaggcgttgcgcgctgcgggagccaggagacccccgcccctggcccctcgccccggttcctcgcccctcagcccacgccctcccctgcgaacgcgcacgtgaacgggagcgcggacgcgcccgagaatgcgcttcacctcgcagaagcgggtgggctctgtggagagtcgcgggctcgcgggcagcagcgcctcctccactccggcgggcccgggttcggccggccgcccatcggactggcggactggctgactgacacgcctcgcttgcccccgcctccgcccgtgccccgcccagcttcatctctccctccgctccccgggctcgggggcagacggcagacggaggcgcctctctctccccgcccctctcctcggccctttctcttcccagcacctcggctgctgcccggcagcggcagcagctgcgtcggcggcccacacagcagcgagaggcgagaggaggctgcctcgaggatgaagtgcaaacccaaccagacacggacctacgaccccgaggggttcaagaagcgggcggcgtgcctgtgcttccggagcgagcgcgaggacgaggtcctgttagtgagtagcagccggtacccggaccgctggatcgtgccgggcgggggcatggagcccgaggaggagccgggcggtgcggcggtccgagaggtgtacgaagaggcgggagtcaaggggaagttaggccggctcctgggcgtcttcgaacagaaccaggaccccaagcacagaacgtacgtgtatgtactgactgtcacggagctgctggaggattgggaagattcggttagcattgggaggaagcgagagtggttcaaagtcgaagatgccatcaaggttctccagtgccacaagcccgtgcacgccgaatatctggagaaactaaagctgggcggttccccaaccaatggaaactccatggccccatcctcgccagatagcgatccctagtatgtaccgcttgcgcccgcacagacttctgtttgtctgccttgcttaaaatgcatcccgcctggagcacctctcgtaccatgtgcggtctcatgggcaggagggaggcttttgtttccttggcagaccctctgaatcacgcttgcaaactgttgccaggccctgttttcagttggcacgtttttcagttgctttcaaaatcgcttcttggttaccctgtaaaatgtttcggagaagcctatgccgcttggggttttaggtgctgtaactgttcaccctgcttttgggcggggggggggggggtggggggcgaggggtgggcggggagtgtgtgtgtctgcctgtgcgccctgtgatgtttttggttcttttatatttcacacatattcgtgggtgcgtgcacatttttgataccagccttgtggtttgtttggtagtggaggcctttaaagtctgaccagcttggttgtgtggcatcttttagtatttttttcccttgagttgttttctccttcacagcgttcgcccttgttgtcagggaggccttctgtggtgggagttggtttaaaaaatcagttttgaattcgtaaaaacattaggaaatcctacatcttgtgctctttctgcactcgacagtcgctctagcctctgaagtggtatctcatttgcccctttcagaaatttctttttctatttctatgtaggtcatttggttttcaaaaaattttcacaagtaatttttcactgctgactttaaatcgctatttcccatgtagattaaccttactgaatagatgctgctggggatctgctagccaaacgcatctgatcagaaaaactgtattcacagaatttgatttcccatactcaacttccaactcccattgccccttactggataccatagaagaaccatggttctctggatttaagtttgtttttgaaagaaagtggtttccattccatatttgaatgtagtgacattccgcttaacctccctgactcccagtaaccacaggaatggaatcttttgtggtgattacatcccaacagagttagctctagcgatgttcagctggtacagaattgtcaaactattaggattcctgaacaatctctcaatgatagagagtaattgttttgtctcacagtaccaccttttctgggtgccaaattaaaagctctcacgtttgcctcagtacttgcttgaagtcaggaatcccatctagaatagctaaatctctcttctggaccttccgctgttcccccagccatgtctgacattaggtagaaggaaaacctattttgtgaagagggtattcgaatgaaaagatcattcctaatttctagagcaacctagactatgtcatatctcttaaacattattgacaggtattggggtcccttaacttttttttttgagatggagtcttgttctatgggtcactgttacgcactttctattaagaaattttgggtttcgctatgtaaattctaggttcctcttctggatttcatctcccatgacagttgaggaaatgtctagtttttgaagagagtatgggtgggggctgggggaccgggcgcggtggctcacgcctgtaatcccagcactttggaaggccgaggcgggcagataacgaggttaggagatcaagatcagcctggccagcatggtgaaaccccgtctctactaaaaatacaaaaactagctgggcatcgtggtgtgcgcctgtaatcccagctactcgggaggctgaggtaggagaatcgcttgatcccgggaggcggaggttgcagcgagccgagatcgtgccactgcactccagcctgggcgaccgtctcaaaaaaaaaaaaaaaaaaaaaagactgattttccccctcgtccctgtcccccaatggacaagtgcctactttttcttattctaaaaaaaatttgaagacgacatgttggagtaaaggtaagtttggttgcttgatacagaatttgctctggatggttaacatattttctaagaaacctatgttctgttgatcaggtcacctttgaaagaagtaaccctgaaaggggtgaaaggtggccataaatatttttaagtcctgtagaaaattgataaaaattgaagtgtgtatgtgtaagagcttgtaaagaaacagcaacattagagggcccttgtgggatagatggtttaaagggctctgatgctggagctgctccttgtctcacttgcctttaagtggagttcaattgtaagaaaaagcatgtcctccctccatagttgttgactgggaaaagggagattagagcttacagcactaacagctggccagagttttatttttcagagttccttttgtggaagcatcagtcaaaacaaatattctcagcatcattcttgtattgcaatcatctttctgaatgactgttggcctattagaatatggactttttgaggactaggacccagactgaatcctcccccatatcctcagagcctagaacagtgcctgaaatttggagacatttgtctttgatccacagattagaaatgtctacaagtgtattcccgatttctgagcttcataatgtacctgggacaatctgttattccctcaggctctcatctggcctcacagtgaaactgcattcgataattcactgaaggcttttccaattcaaaatggttgatgagccatagtaggtgctcaataagtatttgttgattagaggaatggatgaaccaataaaaccctattaataagaatttttctttttaggtgaatggcatagatgttgttcagatttactttgaaagaatcaagtatgtgaatggatggatgaatggaattgtgaagcacagatgagctctttcacactccaaggacacagctcatcctatgcttttggacacttcttccctgtttattacaatgactattctccaggttgttgcactaccgctgtatctgtacataattctaacttggcacctgtggccttttttgtgctcttatgtgtctgtatttcccggcagagtatacgcccttgaatgccaggaacttgtttccttagtcttttttatatatctagcatataagatattgcttagaatatggtagacatcactgaagatttgtttcagtagttcatattttgtaatgatactgaatggttaaacaatccctttctaatctgtctagcatatatgtgacttttgtttatcaagtgtcacacaactgcttcaaggcagctgtgagatactagaaagcaaaaattcttactcctatgtctgtgtcatcccagatgtgtgcctccagatggcagtatactacactatctgtaaaatatatttgcaaagccaggcacagtgttacgcgtctgcctcaggaggctgaggcagaagaatagcttgagcccaggagctttagtctagcctgagcaatataatgagactccgtctcttaaaatatttgcccaaacattgaacctaaatttgaccatgcccctagaaataattcctaatctttagaaaatagggcagagaaacattattttacaccatggagatgagatcagcagaatccagactataagaaactacaggacacatgacctagtttcttctgtaaataacttgcaaggatgaaagatggaggatgaacctatagatttaaagagacttaagagacatattaaccaattgttaattggatcttatttgaattgtgatttgaccgaactgtaaaacgaatacatttatgagacaatcggggtaatttgaacattggtggggtatttggtattagaataatggttttatcattatgttagaaagaagggtcctcatctacattctcaaacatctgtggctgatatgatatgattcttggaatttgcttcaaaataataagtctggatgttaagtgcattggaaatattgatgaaacgaaattggccttgataattgttgaagctgggtgatggctaaaatgatggttcattatatatgttcatctctatttttgtatgtttggcattttccgtaataaagtttataaaaataa

SEQ ID NO: 1441 - DNA, 6597 bp, Homo sapiens
tacttttttcaatttttattatggaaaatttcaaacatatacaaaagtatagagaatagtataatgaactctcaaacatccatcacacagcttcagcaattaccaatttatggccaatcttgtttcatctatgtactcaattaccccacactcagatgattttgaagcgaataccagtaacatatcatttcacctgtacatttttcagtatacttctctaaaagataatcattttttaaaacaacataaccacagtaccatatcacatcttaaaaaacaataaatcaagaagttatatttttatttcaaattatgtaacaactggggacacaatcaatacatttcactggtatcatgaggaagagtgtcacactaaaatggagtccaagcttttatcgatgcaattgctttataatataaaagaaaaaatcaaacaaactagcatattagaaccacttttggtaatttgtaaggagctgaagactgctgatatcacacatcccatggcaaactccgtaagatttcttctaaacatctttgttattttcttaaaattgttctggaggcagctgatgcaagtcctcttttttaaaaaaaccttcactttgtgttcccctctaatagcagcctctttcctaaatgccttttctaaatgacaacaattttgccctctctcagccctctgcattctcatatgcagaaaccaggtaggatgaggagctagctgtgtgtactggaaaagggatgaaaactacagccaaatggatcagtgagagaggcaaaagaaatctagacaaactaaatggcataattaagtttggaaactgcctatgatatagcctgttggctctggcatcaaataatacagtatgttaaatctgtaaaatgaggaaacagtgtttcctcaaagagatgttaagatgacatgtaagaagtggttagggcaggcattgcaaaaaaatgtcttatatatcattttaaaatttatttttataaaaactcacaacattattttgcgtccactgtatttatttttacaattacctttatagcaagtgatagtttttgaataaaatttaagcaaatcatcaacagtacaaaaacactagagttgttacacgaaggactgattctacaaaacattaccctaggtgatggcataatcttaaaactgtgcagctactgtgtggtatgacatagaaataggagtaataattcttgtcctcaaacatcttacaactgtcttgaaatatttctgaaacacctgatacacaaaagccacacacatggtgcctagatagcatatactctactagcaccagattggaaggggaatgttttgccacacggtgattacaaaatattaattgaatcaaagaaccttcagtgatgccaaccatatttcaagtagtgtctcagatgcagaatatgcaaagagtaaggaaaaatagtctttgctctcaaagacatcatagtctaatgaaggcagacacatcaaaaaagcacaacaaaaggctataggtgctgaattaagagtctattcacgtataagagtacaacaaccagagcaagagtcagtggtatagacagggaaggagtgtcccaagatgcaggaagaaaccagatgagctgtcttcttgggaacacagaagtgctcacctgtacttgacaattccactgatcactgggttcacatcaatgtttctttcagcacaatactgaacatctttgctgttcatctggaaaaacaaaccaacacacaattagcaggcttatgttaataattcctccaactgacaaatgtaccaagagcttattatgtacatcaatcactttgcatcaagcacttcacttccacagaattatctaatgcagatgcaatcaatgagtctggatcagcaactgaggggttataagccaatgtataccatgatgtaaaaaagtcaggaaagcagcgatatcagaagttttgtaaaagaggagtgaccatttaagacataaaatatcctaaattccatgttacagactctagactcatggaaataattcaggctgattcccacccacgaaagagttttcagtccagtgaccacatggccaagaaaacagattaagtacaataaactctgcgaaccatgacacagaagagggtttcttaacccaggtggtcaggaaaggcttctcattggagatgtttgtaaagtgtctatttttactatctccaacaacagattttttttttaaactgagcgtcagatagttagataacttggcttaagtttcagtgaggaagaactggaactagatctgtctgacttcaaacccccaatgtagtttctatcacatcatgcgctcactctttttttttttttttgagacgtagtctcactctgtcgcccaggctggagtgatcttggctcactgcaacctctgcctcctggtttcacgagattgtcctgcttcaacctcccaaatagaaggtattacaggcacgtgccaccatgcctggctgatttttgtagttttacttcattaataattagaagtagagttggggtttcgccatattggccaggctggtctccaactcctgacctcaagtgatctgcccacctcgacctcccaaagtactgggattacaggtgtgagccaccatgcccagcccatgctctcttattcttataaaagtgttatgttttagcacagtcagcatagtaacttccacttcttatagtgctgtttgcccaaacatatttaaaatctgctaaataccattagtattaatagctatcttatcaagagaccactaccaggaaaatattgtttaaagtctttcagagagtacctggtggctcccccacaagggaattctagaggtgaaagctctgccaggcaaatacacattttctaactgtaaacaaattggcattcttatactaaccttctgaaatgaaatcacagaaagaatttaaaacctttacatcaattgttgcaaatgaatctatgcaaataaagcaacaaaattattttcgagtttcttccctttagtttgtttctttaaagtgtagtcaacagattttgtatctaaacacacacatacttcttgagaaaaactgtatatattatagacacagcaccaattgtttccagtatatgcatctatattaatgtttcctctttatatattcacaagaataaaacacttgaccagctgaaaatgtaagctatttataaaacatgcagaaaataaatctgattcatgtctgcaaacctcaattgtctgtgtactctttttcctttctttatcaagacagggctgtaaaatttaggtgtacatttttctgctatcacaaaagaaataatgtacaagtgaactctactactcttagaaggaaaaaaatctcaactatacatcaaattttggagcactgaagtggcagaaattttctatatactacctctgttctaaagaaatgtggtgccactgttccgaaaacaaatcttataacacatttaagtataggtaaacaaagtacaaatctcagtttttcaaaacattttctgtactaatgcttttaacttgaaactcttgacttagttttgaagagaaaaaaagaatctccttggcgctcttaactattctgatgagactaagttccagagaatattttacaaaaactacttaatttaacagtacgccttgaaaagtaacactacatattctaagtgtttctggaaaaaaaaaaagaaaaggaaaaaccacgacatatttataagctaacaattcttaagagagggttactatgaatgctgtacattaatttttactttgtcagatacataacttaagaaccaaataagatgatgcataattacttctaatgatagaaagtacgagttaagtctccaaagtaatcgtgacagtgtttcatgtggaacacatttcatctacaaaaatatccataaaatacaatctagtatacctcctaggtcaatattaatgtagaaacaagaaccttctgtaataattaggttattgaggaaaatcttaagatccattttagactgaataattaagtcaaattgtttggaatttaaaatatgtgcttcatgatgatgaaataatctgtacaacaaataaccatgacataagtttacctgcggaacaaatctgcacttgtacccctggaattaaaagttacaaaatattttttaaaatatgtggttcaaatatatatattcaacatgtatcactttgttaagagaaaaatagaaaaatactccgtatttgatcagaccatgtaattcagataataaaactgttgtaagttttaaaaagccacaatttctagtttactctttcctttgatagcattagtgcagaaaatattttgagaaacagatttgtactttgtttacctatacttaaatgtgttgttgtaatatttcttttcaaaacagtggcaccatatttctttagaaagtgcaacggcactcactgtttagcagcataaaaaatattatttgtgaaattacaatgtactccaaatagagaaaaatatttcagtgttttgaagggtaaaatacaaaaagcacacaagggggcagcaaaaaaaaaaaacagcagagacggtttcaaaaggaacttttctatggtattaaaagacaggagagcaaaataatgagtaggaggtttttggattacaggcaacgttaagttcttgatgtagatgctggtcacctgcacctagaatagggtgtcctgtgagacaaaacaattattctctatcgttaagagagattgttcaggaatcctaatagtttgacaattctgtaccagctgaacatcactagagctaactcagttgggatgtaatcaccataaaagattccattcctgtggttactgggagtcagggaggtttaagcggaatgtcactacattcaaatatgggagggagaccactttcaaaaacgaacttaaatccagagaaccatggttcttctatggtatccagtaaggggcaatgggagttggaagttgagtatgggaaatcaaattctgtgaatacggtttttctgataagatgtgtttggctagcagatcctccgcagcatctattcaataaggttaatctacatgggaaatagccatttgaagtcagcagtgaaaaattaccacttgtgaaaattttttgaaaaccaaatgatctacatatagaaacagaaaaagaaatttctgaaaggggcaaatgagatcccatttcagaagctaaagtgactgtagagtgcagaaagagcacaacatgtaggatttcccaatttttaaaaaaattcaaaactgatcttttaaaccaactcccaccacagaaggcctccctgacaacaagggcgaacgctgtgaaggagaaaactaaaggggaaaaagaatactaaaagatgccacacaaccaagctggtcagactttaaaggcctccactaccaaacaaaccacaaggctggtatcaaaaatgcgcacgcacgctcacccacgaatatgtgtgaaatataaaagaaccaaaaacatcacagggcgcacaggcagacacacactccacacacaatccccacccacccctcgccccccacacacacctcccaaaagcagggtgaacagttaaggcacctaaaaccccaagccgcataggcttccccgaaacattttacagtgtaaccaagaagcgattttgaaagcatctgaaaaacgtgcaaactgtcttgaaaacagggcctggcaactgagacagtttgcaagcgtgattcagagggtctgccaaggaaacaaaagaagcctccctcctccccgtgagaccgcacatggcacgagaggtgctccaggcgggacgcattttaagcgaggcagacaaatagaagtctgcgcgagcgcaagcggtacatactagggatcgctatctggcgaggatggggccatggagtttccattggttggggaaccgcccagctttagtttctccagatattcggcgtgcacgggcttgtggcactggagaaccttgatggcatcttcgactttgaaccactctcgcttcctcccaatgctaaccgaatcttcccaatcctccagcagctccgtgacagtcagtacatacacgtacgttctgtgcttgcgatcctggttctgttcgaagacgcccaggagccggcctaacttccccttgactcccgcttcttcgtacacctctcggaccgccgcaccgcccggctcctcctcgggctccatgcccccgcccggcacgatccagcggtccgggtaccggctgctactcactaacaggacctcgtcctcgcgttcgctccggaagcacaggcacgccgcccgcttcttgaacccctcggggtcgtaggtccgcgtctggttgggtttgcacttcatcctcgaggcagcctcctcgaggcagcctcctctcgcctctcgctgctgtgtgggccgccgctgccgctgccgccgccggggaacagccgaggtgctgggaagagaaagggccgaggcgaggggcggggaaagagaggcgcctccgtctgcccgcgagcccggg

SEQ ID NO: 1442 - DNA, 927 bp, Homo sapiens
atggccatggacaatgtcacagcagtgtttcagtttctccttattggcatttctaactatcctcaatggagagacacgtttttcacattagtgctgataatttacctcagcacattgttggggaatggatttatgatctttcttattcactttgaccccaacctccacactccaatctacttcttccttagtaacctgtctttcttagacctttgttatggaacagcttccatgccccaggctttggtgcattgtttctctacccatccctacctctcttatccccgatgtttggctcaaacgagtgtctccttggctttggccacagcagagtgcctcctactggctgccatggcctatgaccgtgtggttgctatcagcaatcccctgcgttattcagtggttatgaatggcccagtatgtgtctgcttggttgctacctcatgggggacatcacttgtgctcactgccatgctcatcctatccctgaggcttcacttctgtggggctaatgtcatcaaccattttgcctgtgagattctctccctcattaagctgacctgttctgataccagcctcaatgaatttatgatcctcatcaccagtatcttcaccctgctgctaccatttgggtttgttctcctctcctacatacgaattgctatggctatcataaggattcgctcactccagggcaggctcaaggcctttaccacatgtggctctcacctgaccgtggtgacaatcttctatgggtcagccatctccatgtatatgaaaactcagtccaagtcctaccctgaccaggacaagtttatctcagtgttttatggagctttgacacccatgttgaaccccctgatatatagcctgagaaaaaaagatgttaaacgggcaataaggaaagttatgttgaaaaggacatga

SEQ ID NO: 1443 - DNA, 108021 bp, Homo sapiens
tctttccacctcccttccagtccgctcccggttcctggctccagctaggctcggcagaaataggagcgcgcaggcgcgacgtgcggctcgcagaacggcgagtagcggagcgggacccgctgtgagtgtggcggccgcgctgggttcctagctggggaaacgtgatccaggcgaagcgccccaggaaggattggggtgtgtgggggtgacttcggttctgcgaggagaaacccgtcagatatgcggtagcgttggtagcgacgctgcctgtgggtgtccggccagggccgcgtggggagcggagtgcgtggtagcgggagtgggtgagggtgggtatgacgagaaaaaaaattgaaggaatggggtttacaggctggaagtccgcacacagactgggcaggaccgcgaggcttgccaacggtgctggagggtgtcccagcttcaagttcagtcccctgcttggtgcccatgagggacgtcccaagctcatcccttcctccagcgctgctttctctggtgcagagttgctagaaacattccccgtcggaggggaaaggatttggaggcggtgggctgtcggcccgggctagtcccaaggagggcgtggcgttcgtgtgactttcctttacccacccccgggaatgtgtccctcttctgatccattgtgcccgtggacattttaacaaaggctatgactgttttgtaggcagtggcgggtgacagtgggagggggtgcgtgcgaggtcggtcgcggtgcggccctgggggatgggagagcggggggagggggaggcggcgtggggggaagtgaaaggaagagaaacagtcttcctgcttcaggtttttccttcttcctggtccgctgaatttgatcactggtaggaacagccccaagagggatatgactggaaagtagtgtgtgcgcgtttggactctggctccagccactggtttttgtgattgtgctgtgcaagtattttctacgagtccctttaggagaaaagcgaaactaatgggatttgagaggaaataattgaatgaaaggatgaagaggttgagtgacaaaacttagagcttaattatttgtctgttgatggtcatactataaagccagactttgaaggatgcgaaggtgttcaagccagggtaagtgaaaagttggttaggctactgttgattgtttcaatcaagagtggattattgggcatgtgtgtggatgtgctgtcaagatcttgggccgactcactttagaacctttgaaaataatattaaggatacaaaacattagggcaaatattgtaatattggataaagctccatatgctttcattttcaaacttagggacttttatgaaagatagtatatgtgttcccaagcatagatgttgatatttttactcatttgttttaagttaatacaacaaaataaactgaacttcctcctctccacccctttccctcgattgtaaatcccgttttataaacgtttactttctgatctgaagtatacttaaaaacacaattaccccgcccaacccccacccctgcaccaaccccaggcatgaggtgaacaggatttcttctggttttattgttatgttattctttctttttctattttcccaaatttggggcaggtggagggcggggagtgttagggatgccttttctcttttctagtgcctgatgaactcctattcatctttctagacttagcctgattcacttcttgaaaaattttgccatcttctccagagtgaattaatcacacccttttctgttaaatttatataacttgccttatttctccattactactagaacctcagtcttttgtgttacccttgtacctagagctgcctggcatgtgataagcacctaataaactaacttacagatatatattaataaatgctgttagaaagatggtaattcataggccgggtgcagtggcttactcctgtaatcccagcactttgggagtctgaggcaggtggatcacaaggccaggagatccagaccatcctggctaacatggtgaaaccccgtctctactaaaaatacaaaaaaattagccgggcgtggtggtgggcgcctgtagtcccagctactagggagactgaggcaggagaatggcatgaacccgggaggcggagcttgccttgagctgagatcgcgccactgcactccagcctgggctacagagcgagactccgtctcaaaaaaaaaaaaaagaaagaaagaaagaaaaaaaagatagtaattcatattgcataaagttcatgggataatacaagaaattcagaattctgaaattgtatttaatatttgagcagcattatttggaatatggataagtactgtgtggaaatatgttctcatgtattagtcatagtttatccctctaaaaagaggtgcaaaaactctacagataaagggaaaatagggatcagaaaaaggtgaagtttttaaaaaggccagtttctgatactgaaactagtgaaattaactatttgtagaaagacacaaataggttgctgctggaatttaggaagtactacaaatgaatcaggttgccagatggtattctctgaagggtgatgtaactaaagaaagctgtaatctaaccagttgtattatacttcttttacatcttaaagtattttcggcctttggctaatgggtctcttcatgttacagttccctgataggcttggtctaaccatttctgccaaactgtctttgacatctctcttaactccaccaggatcactggccttccagttacctctggctcctaacaggaattatcttccccctgttcctcacctccagccttcttctcctgaatggatatatgtatttgagaaaataccatgaacaaatgatcacttactttataaaagaatggaattggttctttagtttaaaaataagtcagaattggctacctgcttagtctagccttctgtgcctgcaaagcagacagagaactatgagcattagtaacccttatttttcatttctcccttattcatctaaatgcaaaagcactttttttcatttcacttttaaaaatagcattagtcattgttcctaaaacacttcaagttagtctctttttttgactaaaactcaaaactcagggaggaagagtagtagcatccataaaacttttttaaagttctacatcatctgtggacctactgactgaaaaaatattccaaaccaaccattgtgattataccttccttcttaaaactttcctcttagacttccttctcatatttctgattttttttctctaattctttgaccggttaacctcagtcacctccacagtcttctcagggttctgttcaaaactctttttctcactgtatgcacaagagtcaagggcatggaaactggagaaatcgaaaattggaggcaagacaagaagttaaacttttctttccgagcattagtttcctcacttgtaaaaatgataattataatacttacctgataattaagatcaggtatatagtgatgtgacgcataatgacattttggtcaactatggacaacatgtgtgatggtggttcccataagattataatggagctgaaaaacctggtgactttgtagcctttgtaatgtcacagtgcaatgcattacagtatataacacttgataataaataactatgctaatggtttatttactatactatactttttaattattattttagagtatacttctacttatatattttttaaaattaactgtaaaacagcctcagacaggtccttcaggaaggcaagaagaaggcattgttatcataggggatgatatctccacccatgttattgcccctgaaaaccttccagtggaacaagatgtgaaagtggaagagtgatattgatgatcctgaccctgtgtaggtctaggctaatgtgtatgtttgtgtcttagtttttaataaaaatgtttaaaaagttaaacaaattaaatagataaaaacttatggaataaggatataaagaaagaaaatgtttttgtacaactgtccagtgtatgttttaagctcagtattattacaaaagagtcaaaaagtttaaaatattaaaaagtttatgtagtaaagaagttatagtaagctaaggttaatttattattgaagaaagaattacattttttatatatttggtgtagcctaagtggagactatttataaagactacagtagtgtacagtaaatgtcatagggcttcatatccacttaccactcactcactgacttacccagagcagctttcagtcctgcaggctctattcatggtaagtgccctatacagatgtaccattttttatcttttatacctatttttactgtacattttctgtgtttagatacacagacatcattgtgttacaattgcctgttcagtacagtaacatgctgtacaggattgtagcctaggaataatagggtataccatattgcttaggtgtgtagtaagctataccatccaggtatgtgtgagtacattctatgatgttgacacaacaacgaaatcgcctaaaggcatttctcagaccatatcccagttgttaagtgatgcatgactgttaacagcttataatgtctagcacatagtagtgcttttaaaatgttagctgttgttatttatgtctgctgtttcttgtgagctcccattatttcaatagcaattaacttcagaatgtggatgtattgatatttcccaccctgtttgagctccagttctgtatttgtagataactcccatgtatttccaacaggttgcttagcacagtggttctgaaacttcagcatgtacaataatcacaagatgcatagatttctggaccccatacccaaagtttgtgatgtctaggatagagtctaagaatttccatttctaataagttcataaatgatggtgattctgctgtccctgggaaaacattgagtggcatttaactgtatggcattcagacaggttggtggagaggaagggagaggagaacaaaagaccaaaaatttatgaaaattaagaacagagtgcactttaagctggtagtgctttttttatttttatttttatttttttattttttttttttattgggacagagtctcactctgtcgcccaggctggagtgcagtggcatgatctcggctcactgcaagctctgcctcctgggttcacgccattctcctgcctcagcctcccaagtagctgggactacaggcgactaccaccatgcctggctaatttttttgtatttttagtagagacgggttttcaccgtgttagccaggatggtctcgatctcctgaccttgtgatccgcctgcctcggcctcccaaagtgctgggattacaggcgtgagccaccacgcccggccggtagtgcttttaagactgtttagagtgtcctctaaaatgtagagaggataggactgacagaagatgcttggatttgatgaccacaaggttttcttttgtttgtttttggtgtgtttcaggtgcagattgttggtttaattatacttctcagttggtattatattatcattattgtgaccaggagaacatatcacaggtatttgaggtaatggcttttttgtttgtttgtttgttttttgagacagggcctttctgatgcccagactagagtgtagtggcgcaaacacggctcactgaagcctcaacctcctgggctcaagcaatcctcccacctcagcttcctgagtagctgggaccacaagtatgtgccactatgcccagctaatttttaaattaaaaatttttttttgagatgaggtctcactatattgcccaggctggtctcaaactcctgggctgaagtgatcctaccacctcagcctcccaaagtggtgagattacagacgtgagccaccatgctcagacatagaggtaatggttcttaatctggtgtgtgcatcagactgtcatagggagctgtttcaaacaatacacttaagtttagtgcccctccccacaatattgactcataaaatctggatttcagggtgtgggatctaggcatgaaaaaattccctggttaagaaccatctcttcagcaatgttgggcagaatatggaagaactgaaaatagttttattggtaaattgctggtgaaaggagaatagaagaaaaagactggagtttgaagatttttggagttcaagaaaatgggaatatgtaaaggtgaaaagcctgctggagtcaaggagcgattgaatgtgtaatgttatgaacatataattgatggaatacagtactggagcaggagagcaggagagaatggaattagtaggtaccataaaaagagaggagaaaggagtgaaaaaagtaagtttaaagatggaagtgggagaagctgaaagaactctctttaagggaggtttgtttgcacactactgttcttcagtggaacttaagtagtcttgaactcttaagtggaatggattttttcaagtttaataatgctagcaaataaatcaataatttcagctattccagctaccactaatggctacaagtgtatttttcttcaacttagtttgaataattattttttgaaattaagtctagacatgctgtgttgtaatgttattgccctagcccttgccgtaagactgctatatcataagtttcatatgattttcattcagttattcaacaaatatttgtatgactgtcaatggccaggcatccttctaaacactgaggatacaacagtatataaaacagttatattttattagaaatttccgcctttgaggcgcttgcatcgtatttgagggaggcagataataaagtaaatgagtaaaatataagaaatatatatataattttctatacatatacacataaatatacatatatgttaagtgacatggtgctgcattctttggagaaatacaaagcagggaaggtgaatggggggacctacaggtattcatctataggtgaatagggcatgttggagggaggtaatcagggaagacttcactgtcagcaaagacttgtagaagataagaaaaccatttatttggaggaagagcttcctaagcacagggaacagcagttgtaaaagtcttgaggtgggttctttttgagacctttcagctaaatatagcaaaatggtttttgcggctggagtagcatgaatgagaaggggtgaataataaggcatagagtcagataagcaagaaggattgtgggagtggtgggaagattgcaagaggagaaatttttgaatggggagatcaagaactacatactggccatgttgagttagagatgattatttgatactccaggtagaattcatgggataggtatgggtaaacaggaaactctaggaatggatcacaacattataagggaagagaaggggtcattgttttgctttgtttttaaattaaaaaactttagttttttagagcagtgttaggttcatggaaaaattacaaggaaagtacagagagttctcatataccccctcttcacatacacaacctcctgcactatcaggacatcctgtaccacagtggtacatttgttgctgttcatgaacctccattgacatatcattatcacctaaagctaattgtttatattaggactcactcttggtattgtacatcttatggatttggatgaatgtataataacatatctactattgtattaatattatgatatgatatagtttcactaccccaaaaattctctgtgttctgccttttcaactgcccttccttccagcccctggaacccactgatccttctactgtctccatagtttttcctttttcaaaatgtcatatagttggaattataaagtatgcggctttttcatattggtttctttcacctagtaacgttcatgtaagcttcctccatgttttttcatggtttaatagcttatttctttttagtgcttaatactccattggatgtaccacagtttattcattcacctactaaaaaatatcttggttgcttccaagttgtcgtaattataaataaagctattataaatatctgtgtgcagtattttatgtggacatagattttcaattcatttgaatacaaaggagctcaattgctggatgagaatatagtagtccccctccccatccatggtttcactttccacatttccagttacccaaggtcaactatggtctgaaaatattaaatggaaaattccagaaataaatgtcgtaagttttaaattttgtgccattttgacatgatgaaatctcgcaacatcctaccacattctgcccaagacatgaatcatccctttgtccagagtatccatgctgtatatgcctttcgcccattagtcacttagtagccatctaggttgtcagatcaaaaaaccatagcatgtataggagttggtactatccaagatttcaggcaccctttggggtcttggaatgtattctccatggatcaaggaggactactttatgtttagttttgcaagaaattgacaaagtgtcttccaaagtaacttaccgcttttattcccaccagcagtggatgagtttctgttgctccacatccttgccagcatttggtgttgtcagtgttctgtattctggccattttaatagatgtgtagtgccagctcactgttgttttaacttgcaattctctaatgacatatgatgttgggctttccatatgtttatttgtcatctgtatccatctgtatatcttctttggtgaggtgtccacatatttagtccattttcaaatcatgtttttttttttctcattgctgagttttaagagttgtttgtatattttggataatagtactttatatgttatgtcttctgcaaatattttctcacagtctgtggcttgacttctcatattcttgacagtgtattttgctgagtaggagtttataatattaaatccagcttatcagtcctttcatgaatcatacctttggtgttataactaaaactcattaccatattagaggtcatgtagattttttcctatgttctaggagttttatagttttgtattttacatttaggtatatgatccattttgagatttttatgaagggtgtaaggccatatctagattcatttttttttcatgtggatgtccagttgttccagcatcatttgttgaaaagtctatcttcattgttttgcctttgctcctttgtcaaagatcagttgacgatatggatatacctctctattctgttacatttacctgtttgtccattcttttgccactgtctttattactgtagtttaatagtaattcttgaaattaggtagtgtcagtccaccaactttggtgttctacaatattgtcttggctattctgtatctgctgcctctccatataaactttagaatcagttgttttttaaaaaaaaaaattcacaatatcacttgctgggattttgattggggttgcactgaattcgtagatcaagttggaaagaactgatatcttgagactatcgagtcttcctattcgtgaacatgggatatctttccatttatttagtcttgatttttttcaccagagttttgtggttttcccaatggagatcttgctcatcgctgatatataggaaaagaattgacttttatttattaaccttgtatcctgtaaccttactattatcacttattagttccaggagattttatttaaaacaatcaattctttggaatttttctacatagacaatcatgtcatgtgtgaacaaaaacagttttatttcttccttcccaattggtataccttttgtttcctttccttgtcttatcacataagatgggattttcagtatgattttgaaaaggagtggtgagaggggacatccttgccttttttctgagcttagagggaatgcttcaagtcttgcaccattaagtatgatgtcaactgtagtgtttttatagatgcctttttccatttgagtgagttcccatctattcctagtttgctgagagtttttttttttttaaatcatgaatcagtgttggattttgttaagtgctttttctgaatatatggatatcattgtgtaaattttcccttttggcctgttgatgttctggagtacattaattggttttcgaatattgaaccagccttgcatacttgtcatacatctcacttgatcatagcgtataatttttttatatatggttggtggatacaattgataatattttgttgaggatttttcaatctgtgtttatggtagatattggtctgtagttttcttttctagtaatgtctttgtctggttttggttttagggtaattctgacctcatagtattgccttggcttctaacttcaggagaaattgtagagaactggtatagtttattccttaagtgttcggtagaattcagcggtaaacccatctgggtgtggtgctttctgttttgcaggttattattgtttcaatttctttagtatagtcctattcacattgtctatttcttgtgtgaattttggcagattgtatctttcaaggaattggtccatttcaaggaattggtccatttcaaggaattggtccatttcatctagcttatcaaatttgtggggataaaattgttcataatattcctttattatccttttaatgtccatgggatctgtagtgatgtcctttctttcatttctgataataatttgtgtcccctctcttcttttcttaattaccctggcaagtttattgaattcattgatcttttcaaaaaaccagcctttggtttcatttatttttccctattgattttctgttttcagtttcactgatttctgcttcaattgtattatttcttttctcctatttacttcaggtttaatttgctcttctttttctaatttcctaggatggaaacttagatgattgatttcagatctttctttttttctaatgtatgcattcaagctataaatttccctctaagcactacttttgctgcatcccacaaattgtgacaagttgtattttaattttcacttagttcaaaatatgtttttaatttctcttgggatttttttcttcaataatccatgtgttatttaaaggtatgtagtttaatctctacatatatgggggaattccagctatccttctgtaattgttttctagtttaattccactgtagtctgagagctgacattgcataatttctattcttttacatttgttaagatatgttttatgtcccagaatatgatctgtcttggtgcatattccacatgagcttgagaaaaatgtgtaattttctgttgttggacgaagtagtttatatatgtcagtaatacccagttaattgatggtactatcaaagctgttgagttcagccatttccttactgattgtcttcaaataacactataccccttcatgggtacaacctctttgtattgcaacacctttcctacaatggcaaagtgatttggttatcctgaaaacctgagggaccatagaaataatgttgccattgcaagttgctttttgaatctcctaaggaaataactgtatgtcaaaccttagttcagcatttactgaacacctttggtatgtaaggggtgtgtgtgctagctttaccttttgtaaattagcgacataattacttctcaagatgtcattgggcataatgaaatgagaatcaaagtgccacagggctggggtaatcatagctcttaaaaatgctcaaggccgggtgcggtggctcacgcctgtaatcccagcactttgggaggccaaggccggcagatcacgaggtcaggagatcaagaccatcctggctaacatggtgaaactgcatctctactaaaaatacagaaaattagccgggcatggtggtggtagcctgtagtcccagctactcaggaggctgaggcaagagaatggcgtgaacccgggaggcagagcttgcagtgagccgagatggtgccactgcactccagcctgggcgacagagcgagactcagtcaaaaaaaaaaaaaaagctgaataattgctattctttctccattattgtggggtaataattggtatagttattttcaacctcattcaaataccgatgatgagtttttgatagcacttgttatcttcttgaaaggcttgcaaattaaatgcactagaattaaaataacaatttcacaatttgaacttttaggtacattttttcagtgcctcagaattcgtaacctattatttctttgggagaacatgttatattttaatctttgagttggagtaagttgtctgtggtctatttcttcccttctttcaaaactgtgtctgagatgtgtgttgttttctggagtcctagttaacaaaacacctcctttttcagtgacaaagccttgttactgaaagcactttatgttctgtgaatctcctccaatctgtccccagtgtgcttgttctttgtggtttggtttctaatattatgcattccaattttgtaaaaaaatctatatgagtaacttgccacagtaatcctctctgacatgtttgcttcagggaaaaagcaggaaaagtcagaaacgtaagcctaggtttaaaatttgctgtcgctgcaaaaaagtgaatagaatatattccaagtttctttttctgtattagtattacctatgggaccagaataattattttggcaaggatatagttaatttcctgtgtaattttatcctgcttcagtatcttagtcatttttcctttgatttctcaaaaaaattatagaagtaaaaaaagaaatttagttatttaggtttataaacagtctaaaaatacaaatatttttgttgcattaaatatgaactatagtataaaataaatacatgtgctctttgaattttaaacttcctttaacttataatgcaaatagtagatattaatatgtacttttttatatatttcattctctaaactatgaatgttaacacggtttatatacttgacctttgcaaagttttgaacagtccactcctactgctgttgttctagcattatttccttcctaatatggtagtcatttttttttttttaacttttctccccagtcatttctggcctgtccttaacccaagtctgcccatccacagatattgaaagcttccaaccttcaggaactacccttcacattactcctagaaagccccatctagccctacagatcaaactgttcactttcaaaggttgtttgtgcctaacctttcttctgttttttctgtttgcattcctcatttgcatttcagttcttcaccttttaactgaggctagttttctgccagaatctcagccccatttaaccaggggtcagaccatcatattgtctttgtctacttggtttctggttggttcccactaccaggaaccaggatgctgaatatccctagaatccttaccgttggagtgggtggactctagtctacttcaactggggctgtcaagaggaaaaaggtgtcagagtcctcagcagactgggagggggcctggagcaaatcctgtgttaaaatgggattttgttttttcctctgcgacccaaacccactcttgacagttctcttcttcacatgagagtatagtgattgttcgttattcagaagattgcccaaattattttttcctctcatctgttgagcaattcctggccatatggattatcttccttagtaataatacgaatgacaacaataataataaccattctatgttgcactagatattttatttttatcatttttattaccctgtaagatatatggcttttatctccattttctagtaagtacattgcagttcaaagagtttaagtgcccaagctcactttggaggtatacagtagaactgaaatatcaaatcaggtttctctgacattacagcatggagctttttttttaggagacccgttgcatgaagcatagttttgggctgtctcttctcattctcagtttcatacagtaagactttgtgtttacgaagataaaatatatattgaggatttactatgcatgcatttcatgcatctagcattatgatctaacatggattagtgcttgatgaatattaactaaaggaatgagaggagactctaaatttgttagaaagggtaatctccctgtgcttaacacagtggcaggcatatggttggtgctaaaaaatatttgttgaattgatgagatcacctactcaggtattgttgaattaatgatattatccactatatctttccattaaaagagatgactgtgaatttaaatagctgagccattgatccagttgtctagtaaaggaaaagatcagtttaaatggatgttttttcctttggatgcctgaaagtgtacttggtatcatataatgaattctgcttccaaaagaaggctgtcacttacttgtttcatcttacttgacctttcactcattcaccccccaaaacttcttccttgacttttgcctcttccctggataatgccattaattcccacaacttccacctcattcttcacactgaaaattctcacatctgtacccagtcaaaatttttccctgaagatccagaggcatatacatgactgcctaccttaaagtaaactgtctaaaacagaacttctccccctacctaacaccccacctatatgtctgctttttctccttttttttctcattttgttaaatagtgaaggaggccctgtatttgggataaagacttctggatcctgggtataaacaggaatgtgaccacatgggattccctttgccactcctttggagaaatcacagtcctggtgctagagttaggacccctatattaaggagctaatggtagtctatatcaccccctccaaaaaagtttctgcttttttttgcttttctgttaaccatctactcctccttgctgatacaagcagggatgataagaaagtgagccctctttctcattacctccttttctcaagcatatgtgagagaatgcaatctgattatcatttataggctctcatcccaaacttattttaaatgcaaatcttgagattaaaaccattttatcttttatctaacattggattgactgcaataatcatgtgatttcatagattactttgagagtttatactgcactctaggtttagatatcccagtgtctatctgtagcccataattagtgaagacaataatattctcttgaatttttattgtggtttcatgtccacagaacactctcaaggcttgtgtggattttttccccattctccatttctttcttagctggataataggccacaaattgttttatggattccttttcgtgttacttcccatcttcacaaaggtagagttaactctcacctccctccctggacctatccacggtttaatccttcttgtgctgtagttactggacttcaactgatggtattaatgttttttcatgttacattgctacaatggcatgtggttttgcttctctttttttccatcatcacacacttggcaggaccaatttgtctaaaaccatatatgaattgtctccaaacagccttatttaagtcagatgttgtctctgtaaaacgttggcaaagaaaagtattcccttcctacatatagtcatattaaatagaactttgtgaggcattgcattctttttattccaaaaatgtttaatatagctccatatgtagtattgacggaagctatgaattctattaagatggccaaaagttagtgaacttctgccacggaccctggtggactgaacaaaggaggacaaatgcgggaataaagacaaagacaaaagagtatgtttggaagaaggagtcgggggctccttgcttctggtgaacaagggccctgagcttctagagcccttcgtatttattgggtaaaagaaatagggagaaggggtggttgtcagtcagctgcttgatttagtgcaggcctgcatgactactttctccagatgttccagtagataacctcaaggagcatggcaccaggaagtgactgccctcagcataccttctggtggcaggtgcagatgtgagtttgcccacatcctgcattcatgataaacagtttgctgtttgatcatatagcctccagtggaatgctgagttggtcagcattcagcttacagctcccaacaaacttctagcctcctttttggtataggtaaatcttagttgctatataataatctgttatctgtctgtccatatctgcatttaaagaaatgtgattaaaactcattttgttggaggttctccagccagccagggttaaagcagagtatttcagagagcactgacttgatcttattttatagcttatgttctagcactttcttgggtagatatttctcattgtagtgcctctgttgttttagaaccattgcctttgatttgaccagaagcaacagcattattttcagggagtattaccagaccttaagggtatccttctgtgggaccaagagtgtgtggtgaggtagtacaagtgcttccttcactgtgcatagcaatatcctcccacaaataggtcccctgcttcaggggtgcctgtattttgagtgattaattgcattagcctttatggtaggtgacaggatattctgttcaaaactttatgcttaccctactccactaccactttcttttaactaattcaagtctcagccgagactgcaaaaattttgaaattaaatgttattctagtacttctggttcaccaaaaatcaggtaagttcagcatattacagaacagccttgctgtgcagcactctgacaactttgcacaacataatataggatatgggggcaatgcttgactgtagtctgacccaattcttggtgaaatgccctgcaattctggctagagcaaggaagataacaagcctggtaagctgctgtgagacagtttctcatccctgtcatgtaggaaactgccataataccatttctcacccattttctagtttcagttgaatgcagaacttttcaccttataccctgtgtgggataagcctatgaattttcttgggtttagtttagagatggctcttcaacagcaccatgatccattgcttggaccatttgttatctgtatcttctagtttggtgtcatgatgtgagactagggacttggggaactgataccatgctgatttagctttcgatgtctgtgtaagtaatcagttgtctgaattcatctgggccaaatctcctttaccagccaaatcaatggaagtgtggcaagccaacctaacagctgtatcagtaatacttgtggccctgttagccatcacattgctgctttggtaatgtttaactgtgtaacaaagtgggactcttactgaccaaacacccagctagtatatgtactatgggatattccttgagccttctacttgtctctgggcataatggagcccccagtttggcaggtggacagaggccagagctgtatatcagaattactctgaattgcttttctcacattgtcagcccaaggaagataccaagacccgctcattggaaagtcttatttacacaactagaagggccataccaattctgaagctgccctcacacacacatctacctgagtgtggtaagaaaggaagcacagtaacagtgtttgggcctactcagaatggtgcactttgaatatgtggttgcctcctgctcgtcaatcctgtggtctcctcagtctatggtgttttgtgtttcaaagaaaccaaatgtttgaccatataagcatctgtaaaacatttctagtttggcataatatctggaaaaaatagaaggcaacatggagaataatctctaaagtatacatttttgtaaaaaaatatgcaatacttgattttgcattatattcttttctaatataggcatttaaggcatttttgccttctaagcactattttaactgtgtttgtagattttgatatgtatttttattatatttagttcaaaattttgtctactttctcttgtaatttattctttaattcaatgattaatttacaattgtgtttttactgtccaaatatgtagggttttcctggttttcatgtaggtaaatttgagaggaaaatgttaacatagcagatctgtgttaacattcagcagatctccttcatatctccaagggaacttggatcatgattgactcttgaccagccactgggaatgtgaccctttggatgtcttttacataaatggtggatttttttttttgtacacctggagcaatggactatgtaggtacctgcttgtcaaaattgctttgtacaaacatcaagattgataaggtatacctagtttctaagtcttggttattgtggctggtcctatagctggatatgcctatatggccagccctctataaaagctatgaatgctgagacttaaatgctcttgcgctcttcttcaaatagagatattctgtatatgttcctgtattgtgctactagagagaaagcacgtatagaaagcctatgtctgacctctctgggttctacccaatgcatatctttttcctgctgcttttactctgctccttttgctgtaatacattttagccttgattataacctaatattgagtcgttttgatgaacctcgaacttgagggtggtcctgggttccccaaaactgtattctaatttaattctattgtggtcagagaatacactccatatgattcctttttttaatgttgagacttgtttcatggcctagaatatgatctttcctggtaagtacatcacatgccctgaaaagaatgtgtattttggcattactggatgtattgttctatgaataccagttatataaaagtagctaatagagttcagatcttctgtgttttgctgattttgtttttctagttcagttaattgctgaaacaagattgttaaaatctctagttatgattgtggaattatggatttctgcattcaattctgacagttcttgtttcatgtattttaaaatgctattatgggatccgtatgcatttggtatgatcttttctattgaattgacccttttatcattatgaattgttcctctttatctcttataatacatttgttttttatatttgtcttctgatggccattctagctttttgcttaactctttgcgaggtgtatcttttccatctgtgtactgttgacacatctgcatatttatatttagaatgaatgtcttataaacagtatatagttgcttggatttttaaaattttaccttctgataatctctgcctttttaattgaaatctagttcagtaatttttaatataactgccaatatagttaggtttagacctaagatctgtttttttttattttctacatgcctcttctgttttttcttcctcttttccagctttttttaaatccgtaaatgttttcagaattctattttatttttcctattgatactctagctattcttttttttgtactttttttgatagtggctgccctagggattataagatacagccatagctttcatagtccacttacttagttaataatgtgctacttcaagtaaaatatggaaatcttacaaatttccaggcccacacccctattcttttgattgtagttattacatgtaaaacaaactcccctctactcacacagcccacaaggcactattatcattttacttttaaacagttatttggtttatatagaggaaaaaaaggataaaatagtattttgcattttctccaccatttaccctttctgattttcttcattcatttctgagtatcccaattccatctggtatcatttctcttctatgtaaataacttctagcatttcttatagtgcaggttggctgatgacaaatgcttttagttttatgtgaaaatacctttatttcactttcacacttcagtgatatttttgctgaatataaaattctgggttaacatttcattttttcatgctttaaagatgttttaacagtttttcagtcctccattttttttaatttaaaaatttaattgatgaaaattacatagatttgtgtaagatgatgttttaaaattgagcttgttaacatatatgcattaccttacatgtcatttttgtggtaacatcacttaaaatctactttctcagcaattttcaagtatataatacattgttattaactacagtcaccatgttgtacagtagatctcttgaatttattcctcctgtctaactgaaattttgtatcatgtgaccaacatctctttgatcttcccccacccagttcatgataaccacctgatatggtttggctgtgtccccacctaaatctcatcttgaattgtagctcccataatccccacgtgtcataggagggacctggtgggaggcaattgaatcatgagggtgggtctttcccatactgttctcctgatagtgaataagtctcacgagatctgatggtttcatgaagggcagtttccctgcacatgctctcttgcctgccatcatgtaagacatccctttactgcccctttgctttctgccatgattatgaggcctcccaaccatgtggaactgtgagtccattaaacctctgtttttttttttaataaattacccagtctcaggtatgtttttattagcagcataagaacaaactaatacaccaccacttactctctgcttctattagttcaacttttttaggtttcatataaatgagattatatgatatttaactttctgtgcttggcttatttcacttaatgcccttcaggtttatccatgttgctgcaaatgacagggaatcctttcattttaaaggctgaaatagtattccattgtgagtatataccacattttctttatccatgtatctgttgaaggatacttaggttgattctgtatcttggctattgtgaacactgctgcaatgaacatgtgagttaagatatctctttgacatactgatttatatttttttggatatataccccatagtggaattgatggcgcagtggcccacctagagcagtcgctgccatgacactggctgcagtgggggaggtacgaccaaggctgctcactccatggagccagcaggggctgggactaggcaggagctgtgccctccagggcacagctgtagccacccaagtcatggctgtggacccaggacttcctgtgcccttgggggctgggagcaggctggagccctaccctcctgggtgcagctgcaactgcccaagttgtggctgcagacccaggcctccctgtgcaccttggggccaggagcagacaggagccccatcctcccaggcacagctgtagctgcccagccatggctgtggacccaggagtctctactctcagtggtctgggaaggccccccatgcgcctgccagctcagaagtatctgctcctgctgcctggcctttccccactcctggtacccactctgatctcagagcaaagttgaggctgagcccaggcactgttgcaactggccaggtgggtgccaacgagcatgggagggaggtcaagggggagctgagagcagtttggtgctggcgtgcaggcacccttcagcacaaacagcctggatgccatgaacagcggcaggaggcagacaggctcctgagtagaaagggataggtcaccagtgaagccccaccttcaagtcagggaaggcctgaagcttgggagccaggctgccagtcacacagactggagtgggaacttatggtgcttttcccagcccacccatagccactcatggactagttagtcagcatgcacttcctcccctctgaagcacataaaaatcccagatatcaaccagactcaaggaaaggatgagatgtccagctgtggagagtagctacccactccagggtgtcctctctgctgagagctgaacactcatcaagacaccctgcctgtggagaggagctacccaatgtgggtctcctctgagctgttctgtcgctcagtaaagctcctttttgccttgctcgccctccatttgtccatgtacctcattcttcctggataaaggacaagaacttggaacccaccaatggcagggcaaaaagagctgtaacacaaacagggctgaaacacactccttgctcattacgttgtaggcaacaagaaggagagaagagagaaggagagaagagctgcttcccttctgggagcccagacctaggagttccctgagccagggctgtgacaccctgtttgaggcgttgcggttcctggcatttccaagcttctgggtgctactgtgttccctggtgccagccgtggaagctgcttgcagtacgcctggcccagccacagccttgcagggagccagcgcccatgccagcatctggagtttcctgccccacttcagccagcatgcctggctatgcacagaggctggaccctatacttgctcacaacgctcctcaccgctctatgcctggcttgcccttggcaggcttgggagccaggctggtagtgtgagccgagtgtagcctgccaggctgagtgggtggaatgagctcagcaggcccaagtaaaactcaggcaaagatgccactggccacagaggtttctggctggtgaagcaacaccacaagaatcctgtgacagaactgctggatcatatggtagtactttttaaattttttgaggaacctccattctgttttccaaaatggctatactaatttacatttccaccagtagtgctgaagatttcccttttcttcatatctttatcaacacttgttgtcttttactgttttgataagtgctgttctaataagtgtggggtatgtctagttgtggtttcaacttgcatttcccttagtgatgctgagcatttttttatatacttgtagactgtttgtatgtctttgagaaatgtctgtcaggtactttgcccattttaaatttaagttatttatttttgagatggagtcttgttctgttgcccaggctggagtgcggtggcacaatctcagctcactgcaaccttcgcctcccaggttcaagtgattctcctacttcagcctcccaagtagttgggattacaggtgcccaccaccatgcccagctaatttttttgtattttcaatagagacagggtttcaccatgttgaccaggctggtcttgaactcttgacctcttgacctcaagtgatccacctgccttggcctcccaaagtgctgggattacaggcatgagccactgtgctgggctaacttcgcccatttttaaattggactatttgttttcttgctcttgagttctttgagttccttatatattctggctattaactccttatcagatgtatagtttgcaaatattttctcccatcccatgggttatctcttcattctgtttattgttcccttggctgtccagaaactttttagtttgatgaaatctaatttgtctatttttgtgcttttgttgcctgttcttttggtatcatattcaaaaaactattgcccagaccaatgtcgtggaccttttccgttatgttttctactagtaggtttatagtttcaggtcttacctttaggtctttaatccattatgagttgattattgtatatagtgtgagataatggtccagtttcactcttttgcatgtggatatccagttttcctatcactatttattgaagagactctccttttcccattatgtgttcttggcccctttttgaaaaatcaattgaccattaaatgtatgggtctgtgtctaggctctctatcctgttgtatttgtctatgtgtctgtttttatgccagcacaatggagttttgattactttagctttgtaggatattttgaagtcaagtactgtaatgtgtcaagcttttttccccctcaaggctgctttggctattgggggtcttttgtagttcaacatgaattttaggatcattttctctatttctgtgaaaaatgtcattgaaattttgatagggattccattgaatctatagattgctttgggtggcaaggacattttaacaatattaattcttccattccatgaaaatagtgtgtctttccatttattcatgacttttccaaattttttcaatgttttacagttttcagtgtacacaacttttacatccttggttacgtttattcctaagtgggatttcttttttggtagcaactataaatgagattggtttcctgatttattttgtaggtagttcattattagtgtatagcaacactactaactttttaatgctgattttgtatcctgtacctgttttaaccaaatttgtttattacttctaacagttttttggttgagtccttcaggttttctctatataagaccaatagtttaactttctattttctgattttcattcctttaattttttttctcttgcctaattgctcttgctaggacttccagttctattttgaatagaagttttgagaatgggcatctttgttcctgatcttagaggaaaagctttcaacttttcatcactgagtatgctattagctgtgggcttgtcatatatggcctttattgtgttaagatacattcttctgtacctaatttgttgagagtttatcaggaaacaatgttgaattttatcaaatgcttttctgtatatattgagatgatcatatagtttttgtctatcattctgttaatgtagtgtgtcatatttatagctttctatatgttgaattatccttgtgttccaggaatatattccatttgatctggtgaatgatcttttaaatatgctattgaattcagtttgctagtattttgttgagtatttttgcatttgtgttcgtcagggatatttgtctgtaattttattttctttagtgtccatgatccatagtttctgatgagaagttaagcattaactgaattgttgttttgactgtgatatgtcatttttctcttgctgctttcaaggctctttctctttgacttacagtggtttattatttacctcagaatggacttctctgtatttattctgctttgaaatcatttcgtatcttgtatatattcattgctatcattcatcaagtttgggaaattttcatttattattacttcaaatatattttatgtcccattctatctcctcttctactggtatactaaattcgcttatgtatgactgttcgatatcatctattaagtttttgagcttctgttcaatttgtgtcatttttttctctgttcttcaacttgtgtaatttctattgatctgtcttcgagttcacttattcctgttatgtccattttgctgttaaatccatctagtgatttttttcataaattatattttgtattttaaaatttccttttttattgcctttatttctctgctgaggcttcctatttctctactgaggttttcatgaattgataaatccaaggtctctgtcataattgaggttggttctgatgttctgcctcatcaaactgtgcctttttagtatgctttgtgatttttttgtcaaaagctggaaatgatgtattgggtaaaaggaactgaggtgaatagacctttagtgtaaggttttatgtttatttggttagggattaagctgtgtttagtattttctgtagctgtaagtgtcaggaaataaaatatcctctgctgtctttgttttttacttccctgttacatttgagttcctctagcaactttttcttaagatctgagatatgtaattctttctgttgtatccccctgttattatacaggatccctattgatgtagtaaggtgtagggagagaagtgttctatggtcctatgattgggtctcaatcttttagtgagcctgtgccctagactgtgaccttcgcaagtgcttctcagttttgctttgtttttcccaccttaggtgaaataggaaggctaaatggggacaggaattgggcatttccttcttccaggtcagttaaggtctgctaaatccccagttggttatgttctagtaatatagttgggtcctctgtatccatgagtttaacacgcatggattcaaccaaccatggatggaaaatgtttgggaaaaaaagcaataaagaataacaatacaataatacaaaataacacaaataaaaattgcagtatagcaactatttacctagcgtttatattgtatgaggtattataagcaatatagagatgatttaaagtatatgggaggatgtgcataggttatgtgcaaatatgacaccattgtatataagggagttgagtatctctggatttaggtatccgtggatactcaggaaccactatagtttcacctgagggcaggccttggtaagaaagagaatgttcttgagtgcttcataaaatggcttttttttaaactctccctgcctgaagcccaaaataatttttcttttatctttactgtaagaacctgatagggttcctggagctaaaactcacagaactgggtatgggtctaagattgggcctccctggagtttctaactctcaaactacagtttatgttttcttagcctgatactggttctggagttttctcctgggcttctgcttcagaaagttggattttctgtatctgcctgtctgtctctatagtttgggggcagtgatttgccctgtaattgcaacctctaatggatctaggaagagttgttgattttcactttgtttagcatttttcttgtgaggataagagtgataactttcaagctccttacattctgaaccagaaaatgaaagtcaggttttcatgaattagaaacatgtctatttgcatttcattgatgataaccagtttaaaatcttcatgttacttccaacatctggttcatcatggagttggactacatcgattttttttttcctgtttatagtgtgttctattttcttgattctttgtatgctgggttcttttgagttatatcttagatattatgaatgctaaattgaggaaattctggattatgttattttcacccaaaaagtattggttcctttgttttagtatctagttttgttgactgggcttgaacagctaactctatttcttttgcagcagctcttatcttcattcagatctttgtttttggatgggctgctgaaagtctggactgtataagcatggttcagtgtttagtcagaaatgtgagtgtatatatatatatatatatatgtgctgaggagggagaggatcctataggttctgagctcatcatacccagaaatggaaagttttcaggaatatttccttgcgggcaaaaaatctctgctttactgaataatctcttagcaaccaggaccatgtgttccttcagtaacttttggtgaggtagaatcttgtgatgtcccagcctcttgatttccatataacagggagtaggggagggagacattgtggagataatcagaaacctttggaggctatgagcaacctatataatcccacctccctcagttatactgaaatttgagtagcttttcacagaatctgtaaattttttattaacctagttaggacttttttgagccaaatgctcatttctactgttcttaatacaatgcctgtcacaaagttaggtattcagtaaatactagttgaatctattaattagggattcaccataaatttctcgccactaataaattacctaagtgtgaacgttttgtttatctcggaaataagatgattaaataaaaatatttgcatatttttcatcttgcattcatgttgatacacagccaatatatttcaagtcattttaaataaaagattaatctgtccatgatatactttgttagataaagctatttaaatgaattgtttttggataaatcctgtaatggtgttttctacttcttctttttaactcatttgttgaaagacggtagggaatagtggaccaggtaattaaataaagttcatgttgtagtttctgcctcatatgatagccaaagtaaatgagattattaacatgaacactttaaagatgtgtatcaaaattaggaggcttatagagagtctcaagtaattaagtgtgtagcgtagcaaataatgactttctctaatattggggttaagatgttcagcagagtatgaattataaaatcctcaaaatacaacttgaaagacttttgacttttagcccattatcctcttgttaatgcacatgtaagagattatgtggggtttttatgtcattatggcaaattataggctgtactataggtgctattcagtattggatacgaatgagttccaagtagctttgttgatctttcactaaaactagggatttggcattgacttatcagtgtgattattgtaaaagagatgtagtgtggaactgtttcctgagattaatccaagtattcagtatcataatttagaaactcccttcagttatctgccctacgtctccatttactcagtaatgtacgcagactgggaaaccttaagaagggttgagacttctgggttcattacagagctgtgggtagccatcttgctgttgttgactctagtgacctgtaactacagatcaagctgtatgcagcctttttctccttcaggtaagttgggttgaaatccagtgctccaagctgctctgaggctttaattgcatgagtgaacactgaaaatgtgaaaaacaattttagaccagaatagcaaggtgagtaaggccaaagaatgtattttatggatattcatgaatgtcacccacagaattcaatattttttccagacgattctgaaagattataatttaatggatgtttgttttattcttctgaggacccagttgaaatcctgttgattctgtagcagactacattactatcctttgtcttactcttatatctctgaggtagatgaatgcttcagaggtaaggtgttatattttcaaaggacttttctatgtttcgttgtatctgtgtgatcagaaggacagggagaaagtctgttttaaaattagcagcatgagatattagaatcctataatgcttatatgaagtttggtgaaatggttagccaaagagaattttctcctcagactagtaactaaattgatatgtaggagcagcctttcctgagtgactttccttgatagttaaaactgcagcaagacatttcagaagcagtttccaaggaagtgaatggatagtgaggtaattttcttaagtacttggattctgattgtctccagaggttttgaagctgttagttacacaatagacggatttgatctcctaggatctttgccaggttcgtaattgcactgagatttttaatgataacaaatgacaacatgatgtccttctctttattctgggagtgaggtgatttgtacataagaaacaaaattaggttttagtttgaaaggcttggagaatcagacttcttttaggccaaatacagtggtatatctgagagaagagttatacagccattgagttgtaattgcttgattcattaaggtatccttgaaaatcattagactgtcagcagcatgagggcaggttttatgtcattttggtaatcactgagtcctagcacaatagttgactgtggtaagtccttatgaatttttgttggaagaatgggaagtatattgaattgcgacatctttttgctttttttttttttttttttttttttttagcatgggattagaggcagcagttttggacaggaggcaagtcttttggccttctgctcctggcaggcaagtcttcattttttaagactctcaagtgtcaccatgtttgtgaagacttcttatcttttctaggtgcaattgacctgactagtcttcctataatgtgtcctttacttactgcttttatagcgtctgtgatgggtttattgcatttttatttgcttctttctaccatagtagaaagtgcaattattattcatctgtctattcctggtatatatattagtagaaaaatgttccactgcaagtaacagttagcaataattatcggccaaggaagttaatctcagaaaatagtaagaaatgtgtataaaacataggtagatatatgtttagtgctatttataatgaagaaatagaaccatcctagactaaaaccaatagaggactgattaaataaatgataaatatttatataaggaactatgaagtcacaattaaaatttatgcattttccaaattgcctgccttaagtatatatgagtttggtgaacagaaaatattcctgacccatatcatacaataatctgtattcaacccaatattggttttgtgttatagataaagtaaaaaaggagcagtaaagaggaaaatgggaaattaaaatattgttcaaatctacagtgaaataaaggtagtgaagtaggcaactggtttgtttagacagtccaggggatttggtatcttattcatcagttattgagtgtattctctgtgccaactaagtgttggatgctgtgacaaatgcagataggccaagtcatggcctcctccctcaaagaacttgcaatctggggagaataatatacacacagaaaatgggggagcaaacgaaaatgagtactacagatttgaatgccatagatattcagaggacagagtgattacatcctcctgggctgatgaagatacatttctaaggaggagaagaattatactgtaattaacagtggctttaggatttaaataaaaatggaaggaatatcatatttaaatgaaggagaatggtgtgaacaaaggcatggagatgggaaagtagacagcatttgcagagaactagcttgactcaaattttaagattcttcttgtagtagaaaagcaaataaaaagggccagaactccgagagcctgtcttagaacctctgattcatatttgcatgcctttatatttgttgcttttaatttgcaagttgcaaaaatgggcattttaatattagaaaatctactgtaggacagtaagctgagagctgataattttccattcttggttcaatactttagtgaggacaacattagattaagaatcagacctggaatgtggtactacaggttataataagtagtagctctgtaaccaaactaagccttggtttcctcatctgtaaaacaggtatgattattcacctctctggactcattgggtttttaatgagcagatcaagtaaaatggtatgaatgtgcttgatgtagagctgggggagcaagaaaaaaatcttcagacagaactccctccatacctctgttcctgtacctcaactctgatgaaaagatatgtaactaggggaaagaaggaatttacagatagatttgaatccacctgaaaatggagtactaaagtggtaatagtccagaaaatgttccctccacccagtaccatatcctttagtacattgtttcccgacagttagactccagtataaggttttggggatactttttagctataaccatataataacaaacatcctattttcttttggctgattgatcccagggctgcactgattctgtaaaccaacttggcaggatttccacaaactgcttctggggagtagtaattcttagggaaccaaggctacccccaaatgaactataatactttgcccttaattctttagaatggaacaataatcagaattatcttggcccatggagttgcttatcagcagttctctcaggactgctgttctttttggagaagggccagtagagtgagtcagatcttttatgttttgtttatagagtgaccatctgacattggtctgaaccacccaggtgcaatgagtttcctttggcatgatcattccactaggtatgctttcgattgtgtctaagttgttttaagaagccatttgagtgggccagtttctaaatatgttatacaaatacagagtacattgcttctatgctatcttgcccttggccgacttataagaaagaagttataagaaattatggcattaaatgtgttattgtatatactataaggatgttgaagacatcattcattacatttcttcttttgaggacactggataatttttctgtctaatctcgaaatcataagtaataaagtttctgggcaactggtttatttttatcttaggataccatagctcatgtaacaaattatttttttggcattggctactaggaggtttaccccttactttgtcaaaattacagaaccttctatatcctgtctctgtcttatctctcttattattgatctttccctttgtcatgtttttctcaaatgcttatttttaaacttttattttatcttcttttattacatgattttgtgtaaatcatgtttaattctttccagaacaggcctacctagtgtgaataaagtgaatttgatacagaaatattaaatttaatttgttgaattggtgtacatatttccttttttatcatgatttggtgataatctaggacaccaattaagtgatatccagaaatatataacaactgaaattttatataagataatttgtgaggtaaagcaacaattgatcatatgcatataataacccctgcaatgaacaaacaaagtgtgcacagattatatcttggccctttcttctcaagcttccctgagtcttcatacatttcacctggaagccttttataggagaggaaacatactcctaaaaatatctcacagttggtgaaggaacagaatggacttgtctgttgtgtattgcctggtcggaatcaattattccacactcaccctttgtgatctaactctttcactgccataccatctccacttcactataggaaagcttcaatttttgtagtttatttcagttaagtattaagaggcaggctggttaaattaattgacacatgtgaagagctgataacccccctgtttaattttaccagtagtatgcacgtgcttgccccaaagaataagatagctctgtctccagatgtcttgatctaggttttcacactcttcttccccaaggaaataatgtagcagtgtactaagatatacacagctatgtgtatatcttgcagctatagatatatatgatatacacagctatgtgtatattttgcagctacaaaaatataatcaaatcttaaaggctgcataattttccagtgtatggatataacaaggtttatttccaaatggtaaaacatttaggaatggttaaattatggtacatgagtataatgcaactattaagaatcatgtttataggaagattcttataatgtatgaataaaaacatagaatacaaactggaataacatatgagctcaactcattaaaatatctttttaattcaatagatttttgcatgtctagtatgtgtcaagtttagtgatgcatatgaggaaataacatcaaataagatacacatgatttctgaaagcattaactaaaataggacatcattacaaaatcaaatctccctttgaggattggtcatttttaatcaaatgtgattaagctcattttctagtttgtggactttccaggacccttgtttcatttctcttctgctttctctccgagaattcatagcactccagttcaattagattgagttgaagagtttaaaagcaaaagaaatcgataattcaagcctagaattccacattatttttagattttctttacctatgtagttagtgtaacctaagaacatcaccttctcccaggaatccatccttgtaattttgtctgggctacttctgcaggaaaagatactagtttgcaaagggaaaaagtgcttctgcacgtgccttttaattttatattacaaacaaacccacactcatgcttttatgagatgtaattcttattgttatgtagctttaacaatttaattttttgttgagacaaatttcctttgaataatttttaatgatatttatagaacatggatctttacttagaaagtctttattgaacatgtaaatcttatttaagaattcatcctgcaaaatatatattcttgagaattgaggctaatgttttattatctctgtcaagtcattacattttggttctcctggtagttgtaatgtgatattcttaaacattcactacagtgacatgatttagtatctagtgatgcaacagtgttacatctcacagaaataactgtgtccttctaaggcctcagaggcatatcacatttgtcccatatgctatttgcaatgatttctcaatgtcatttttttgtgacatgcttatacagtatgacaatgtgagagttaaaaatgtgagaacctatttctctctggttgaattgtctatattgacctcttgaagtaatttagtgtatctgaccttatttattttaaaattaaaatacctgaacttcttatatgatcacttttaaaacaccagattgttacatttggagctaaaattctgtgctgtggtatgcctaagatgatacaaccaaagccacattgtttattctactttttcacttatacatggtgtccattatgcattgatcttgtccagcaaaattaactttttaaactgattgttctgctatctgaagaatcttactaaaatttaatcggtaaactaaaaataagcacctaatgccatagtgcattctggtaactcataaaagaaaaaaaaaaaagaaactaaagcctaatgtaggcttgtgaggttaaaggaaggttagtatatacttactggccattcaagggtatatataaatgaccatttttcctcttttgagaagggtgatataatgcaaccacacttacaagtgatatactttcccgtttgcagaatatttactgttttgcctactatcactgaactgccctgagttatataccgctatataatagggttaaaactcatccgtgtcccttcatttccatggaaaagactttctggacagtggctaaggctaacataagattcttgagctatctcctatgtgtggcttacttcccacccaccaaaatgaagcaaatcctgtccagatgcattgtcttcataatggcttctctcttttttgtctcatttctaccttaaggattccttctgccttactgctgttcttatttctcttatatttctagaagaggcacgtaactatattcctactattagttctatcttccttttattttgatgactgttctgttgctccaagactcttattttcacaatattatacagaactcataagtttaggaaattatggcctttagctgatccaaaaattgatgtatgtttaaatggacaaaagacttgaaacaggcacttcacaaaagatattcaaagggccaatgtgcaaaaaggtattcattttcatcacttatcaggaaaatgcacaatgtgataccattaccccctcaagagtaacaaagatgaaaaagacaataccaagagtttgtaagaatatagagatatagaataattgaaactctgctgggagtgtaaattggtacaaccacattggaaaactgtttagtagtaatgagtagagctgaatataggcagcatgtgacccattaattctacttctacacccaacagaaatagaaatataggcatacacccaacagaaatagaaatataggcatacatccaacagaaacagatacatagtttcatcaaaagacatgcacaagaatgtttacagcactacttgtaataaacctaaacttgaaataacttaaatttctgtcaatagaatgaataaataaatggggatatatacctaacatggaatcagtagtgagaatgaatgagctacaactatatgcaacaatatggatgaatcttacaaacatgatgttgagcaaaagaagcttgatccaaatgagtacatactatgattccatttatatgaaattcaaaaacacacaaaacgtgtaataagtcagggtagtcgttacccttattaggaattagtaactggacaggaagcagaaggagggtttctggggtgctagtactattctgctaagtgtcttgatttgggtgctggttacctgggtggactcactttgtgaaaattcaacaaggtgtatactaatgattcgtatacttttctgtatgtatgagatatatatgtgtatatatatatataatataattttacaaaagagcagtactatatgctgtattatttatctaccactgcataacaaattaccccaaaacttagcagcttcatgtaataaacatttgttatctcacacagtttctgagagcaatctaggagcaactcagctgggtggttttggcatagggtctctcatgagattgctatcaagatgtaggctggggctgcagtcatccaaaggcttgactgggcctgaagcatctgcttccaagatggcttccttttttttttttgtttttcagacggagtctcgctctgtcgtccaggctggagtgcagtggcgtgatctaggctcactgcaacctctgcctaccaggctcaagcgatactcctgcttcagcctcccgagaagctgggattacagatgcctgccaccatgcctggctaatttttgtatttttagtagagatggggttttgctatgttcgccaagcttatcttaaactcctgacctcaggtgatccaccggccttggcctccccaaagtgctgggattacaggcgtgagctactggtgcccagcccaagatggcttcttcatgtacctgttgagggatgcctcagtgaaagctctttgtattgccagaggctacaaaataacctcacagataacattttatatatgtataatatgctcttacatatgtgtttatacatatctaacaaatgatatcatgaatactgttttataattttttctctactcaatacattgtggacatccttttttattttttgattggcttatctgtagatctattttatcctttttcacagagctctgttgaggtataattgtcatataattggcatacatacacatatttgaagtgtacaactggagattttttttatgtatgtgtacactcatgaatttatcatcacaatctagataatgggcaagcagtcacctgcaaaagtttcctactgtccctttgtaatcctcttctcatactttttaatggctgaaaagctttatttgcatatatgaagtgtctttaaaatccatacttacatttgctcacacatagctcaacctaatattttgtttaaattgtaggatgctcaccccatttagagaaagaaatccacctccccaaccccaatcaagaacctgctattgtatatcatcatagagccagattacctaggtaagaatcttagccttgccactttgcagacattatgatcctgggcaaattgtttaaccactctgtatcaaattccttacctgtaaagtggggataataatagttttatatttaactcataaaattgcaaagattaaaggaattaacacaatgatctgataacaaagcactatgttattatctgctgctgttattattcccatggtttgttatgctaaaagcctcttttcagtttctcctgatgatattaaagatacgagttgccaggaccttgtattcaaatagcctaccagaacttatctcctctttttaattcctacttctctgtcacctccctctgagcatcttgataaaggtgaggagaagtatgtagctaatcataggctgtttaagtattggagagtttggctttagggacatttcataaggtgagagatacccaaaatagaacacttaaaacaattccaagaccttatcaaccaagatgtcaaaatataaattacatttctacattaaaaaatgttattgatcactttgatggtaatgattacacatgtataataacctttccttgagcacatactaagtgtatattctaggaaagatcctaagaattaaggtatttattgtctttatgaagcatactatattagtctgttctcacattgctataaagaaatacccaagactgggtaatttataaacaaaagaggtttaattggctcacgtttctacaggctgtacaggaagcatgatactgacatctccttagcttttgggaaggcctcagggaacttaaatcgtggcagaaggcgaagagccagcacttcacatggctggaacaggaggaagagagagaggggggaggtgctacacagttttaaacaatcagatctcgggagaactcactatcacaagaaaagcaccaagggatggtgctaaaccgttcatgagaaactgaccccatgatccaatcacctcccaccaggacccacctccttgattgtgagatttgggtggggacacagatccaaaccatatcattctggcactagccccccacaaatcacatgtccctctcacattgcaaaatacaatcatgccttcccaatagtcccccaaaatcttaagtcatttcagcattaactcaaaagtccaaagttcaaagtcttatctgaaacaaggctagcccctcccaccaatgagcctgtaaaataaaaaacaacttatttccaaaataaaatgggggtataggcattgggtaataaatccccttccaaaagggagaaatcaatcaaaagaaaggggctataggctccatgcaagtctgaaatccaggaaggtagtcattaagtcttaaacctccaacctccaaaataatctcctttggctccatggcctaaatccatggcccagtgatacaaggcgtgggttcccaaggccttgggcagctccacccctctggctttgcagggttcagcacccttggctgctttcaagggctgatgttgagcaccttctgcttttccaggctgagggtacaagctgccagtggatctaccattctggggtctggaagatggtgaccctcttctcacaggtctactagacaatgccccagtggtgacgtgtgtgggggctccaaccccaaatttctcctccttactgccctagtagaggttccccatgtgggctctgcccctggagcaggcttctgtctggacatccaagcttttccatacatcctctgaaatctaggcagaggctctcaggcctcaactcttgctctctgtgcactcacaggcataacaccatgtggaagctgccaaggcttatggcttacatcttctgaagcagtggcctgaactgaacctgggcccctttgggccacgactgaagctggagcaactgcgatgtcgggagcagtgtcccccggctgcacagggcagcagggccctgggcctggcccatgaaacagttcttccctcctaggcctccaggcctgtgataggaggggctgccatgaagatctctgaaatgcctttgaggagtttttccccatcatcttggctaatagtatttggtttctttccacttctgcaaatttctgcagccttcttgaattcttctcctgaaaattgacttttctttcctaccacgtggccaggctgcaaattttccaagcttttatgctctgctttccttttaaatatgttccagttttatgttatttctttgcctacacatattagaataggtggttaaaagcagccaggccacatcttgaatgctttgctgctgagacatttcttctgccagatatcctaaatcatcattgtcaagttcaaagttccacagatccctagggtgggggtacaattcagtcaaattctttgcaaggacataacaatagtggcctttgctccattttccagttagttcctcatgtccatctgagacctcttcggcctggccttcactgtccatatcactataaccattcaaccagtctctaggaagttccaaactttcctgcattttcctatctccttctgatccctccacactcttccacctctgcccattacctagttccaaagtcacttccacatttttaggtatctttatagcagtgctgcactccttggtaccaattttctttattaattcattcttgcagtgctataaagaaatacatgagactgggtaatttataaagaaacaaggtttaattgggtcatggttccacaggctgtataggaagcataatgctggcatctgcttggcttctgggaaagcctcaggaaacttacaatcatggtggaaggtgaagggcagccagcacttcacatggctggaacaggaggaataggtagaggggagaggtgctacacacttttaaacaaccagatcttgcaataactcactcactcattctcacaagaacagtactaaggggatagtgctaaaccattcatgagaaactgctcccatgatccagtcacctcccaccagacctcaccttctacattgggaattacagttgaatatgagatttgggtagggacagagatccaaaccatatcacatattatcaatttaaagagatgtggctaggatttgtaggggtgagaatagactgggatctgctgttagagcaaaggaagtgagtaggtcttactgattggtaatgttagattgagccatggatattgccactgttttaaacctgtgtaatgggagtttgttttactactttccctaaactgaaaacaacctgtcttagttgattcaggctgctataacaaaatactttaggtaatttttgaaaaacaaaaatttattgctcacagttctggaagctggaagtcaaaaatcaagatgacagcagatttagtgtctggtgagagcttactctctgcttcaaagatggtaccaccttattgctgtgtcctcacatggcaaaaggggatgggaagctccctcaagcctcttttataaggatagtaatcccattcatgagaatggagcctcatgacttaatcccttcccaaaggctccactccttaacactgtcatattaggtattaatttccaacatatgaattttggagggacaccaacattcagaccatagcacaatccaaatgtctatcactggtagaatgaaaaaatgaacaggggtgtgtgtgtatgtacgtgcctgtgtgtgtgcgtataatatacagagccagtggtaagaatgaatctgctacaattacatgcaacagtatggatgaatctcacaaacaagatactaagcagaagccaaaaagatctaaaagcatacactaatgatttcatttatatgaagatcaaaaacataaaactcatttatggtataagaaatcaggctagtgattcctagtgcttgccactcctttcctcactctgctaattccaaatacagagcttgtcctcatcactgtagacaccaccactactcttactgtcacagagtgtccaggatcgtcttcttcagggcttataagttccagggaagttacaaggatggctatctacaaggaaacattgaatgggaactggctaaagcctcaggcatggataaaaattggatgggaactggctaaagcttcaggcatggataaaaactggatggcaactggctaaagcctcaggcatgggtaggcatccttaaggtagggaggtcatcagcaagggagtggctactgcccaagggaagccctcagcacatagccccaggaatgattctgaccatgtgcttgctcttatggtctgtagatgctgaacccacccccaagggcctcctgagcattcaagaaatggtcgtcactaaaaatgctccttcatttttaatctgtttgattcctttcagatctgactcttccaacctaggcctcactgatttctctctttccttcaatccagaggagactttctagcctgggaggtgggtttggatgggtaggattggaggaggaactttgctgtcattattttatttaatcatttcatctgctagaagacttcttgcttttcccgagtaccttaaaagacagaaaaacttattttttctctttttctgacccatacttgtctttcatttgaagcaataaacacaaaatggcttagctacttgcagggcagatggtaaatacacagtaaagaaagaagcagaaaaaaaaaatcaactattgggagaaacaactttagttaacatcttaaaatgtcattccataaaacttgggttgaattaggtaataaaagtattattaatattatggaatttcgaggagaaacgagtttatatgtgtggtggagaaaatatttgtttttagattcatagtatttcaggtggtggcaagatatccaggtgtagatttctctgaggcatttagaattgtagaactgaaggggtgggtcaaggctgaatgtatagatttattgggatggaagggaaaattcaaacatcattgtggatgaaataaactatttctgttagagaatacaattgactttatgaagtgatttatagggcatctagattgtttgatgtggtatgcaatgacgtttttattcactgaggtgtttctatagttaggataattttatttagatggttgtaccattatctttaatattttattgtgcactagaaatataagtcccactgtcatataaaattagtatctctcacttgaaagagaattctcttactgttgttattgatggtgctggatctctgtttcaatgatacttacactgggcttccttgttttttttttttgacttgttgatgtgtgaaaattcagtaagccatttcattgtatacaccagggattgtcaaataatggctggctgccagttttttgtgtccatgaactgagaatggttttacatttttaaatgctttaaaaaaattaaagaagagtattttatgatacatgaaaactatataaaattcacatttcagtggccataaataaagtttttattaaaatatagccacacacaaatttgtttctgtggctgctttcatgctataatagtagagttgggtagttacaacagagaccatatgaccctcacagcctaaaatatttattctctagctttttactgaaaaagccaactgacccctgatatacaccaactgatgtatcattagaaaactagtgccaggtgtggtggctcacacctgtaatctcagcactttgggaggctcaagcttgcctagctttgcccaggtgggtggatcacttgagcccaggagtttgagaccagcctgggcaacatggtaaaaccctgtctatacaaaaaaaaaaaataataaaattaccaggaggcttaggtgggaggatcacttgagcctgggaggcagaggctgcagtgagccgtgatcacgccactgcaccccagccagggtgacagagcaagactctgtctcaaaaaaaaaaaaaaaaaagaaagaaagaaaactagtaaagacaagtatcctcccaaaataaataaacccacagaagtacttctcttacacaggcaatagttatttaaataacatcttttcctgccttatttttctccttgataggtaccactatttatcactgttttacacactatacttttgcttgtttaaataaacagacacaggttaactatttcttccctctagattgtacctttagtgagggcaggggtttgtgtctgtattgcttactgttggattctctagcacctaagcatgtagtagacacacaatgtatattttatttgagtatttacatatctgttgaattgagaaaccaaccactgaatttgctacatattactgtatccaactctgaggatgattggacaacagaaacaaagtatcctttgttcatttgcatagcttgcctagctttgctctagagattgtaggaggtatctctgaatttcagcaacatctaacagcattttgatgctcttccctagtgtatatagcactgaagagcagcatgtataaatatacatatcagacacattcattttttaaagtatttaataatatacttttataatgtattttatataattatgttaatgtataatatattaattttatattatatttaatattaattatacataatattaatataaatttacatatatctatacctcaagcttttatatcaattattgtttttatacatttgaaacagtaggctttgtgaagtgaatggcacatagtaaatacctaaaggttaaaataattgaagaattaagcaagctcttaggtaataggttattttatgaagacagaggtattgcttagtggtttcccactgcatttacaaggaaatccaaatggttttccagccagtaaagccttgtatgatttgactgtttgtctttgtctcccaccttctcccttgctggttatgctgaaatcaaactgaacttctttaagttactctattaccttaaggtcctttatttatagttaaacaaaatattatgactcccccatagactctaagctctattagggcagggatcgcagatgccttattcaccattaacaacccaatgtttagcaaaatgactgaaatataataagcagtaagtaaatattttttgaacgactacatatgtgattaaaagaacactggggttgatgtcagaaaccctaggttaaaatcttgggaatgcattctgaatcttgatctaggtgccaattacacaactgtgtttgtgaaaagtcatcgagttttaatgttggcattttttatgtaaatgtgttgataagttttaaaaaacccagtcctaagatcctcctatttactatgcaaacatgagtaagtccatttctctgaaatttagttttatcatttatcaagaagtctttttgtacctatctcatagagttgttgcaagcactgatgacataagtgaaattgccttatcataatagatatacaacaaataccagttgaatttctattctttgaaggatgtagaagcagaaagatgcagaggtgaaactcccagaggccaaataggatgaaactttcacttacagaagagctcttagatagccaaagagagttgtgactttaagagacaccacgaggagggaatgaactccagggagcgcctgatctctagagtatgccacagggcccttagatccttttacccttaaaaattagaagggccttggggtctggggaagagcaagaggctgggattggcaaagccttaaggagagtaaccaggtattatagtcatgttgtgtccaagcactgtggtggacagtgaagtgattgacctgcctaattaaccatgagagagccatgtggctaaaaagtaaagtcaacatagaagtcctctacaaattaaaatgtagcctgcagtgtttcaaaactaataaagagctagatataattgaatcgcagaggattactggaagaagaataactaccaagaataggagtttccagtctattgtcacaggaagcctgggaaagaggggcaagtacatttaaggaacatcaaaaatggcaaaggaactcttagagaacctccagttctctaagagttccaaatttaaatcattccaaatttaaaacatcaaagcagctgaagccaaatcatatttaacttaaaacattcagcttacaaaatataccttatatcactctctgtctgaagtagtaatagttacacttaatgtattgaaccatattgaccaactagaagataaacctcaagaaccagattgtaccaaaacattttgaggggaaaaataccaaatctttgttagtatcctcataggtcctgcttactgttactaagaactattaaaactgttatttaatcctccctcaaagcctgtgaaattagagctactattaataaccccattatggttgaagaaactaagtcttaaagaggctaaataactttcccaagatcagatagatggtaattggcagacaaggcctcaagcccacatatgtatgatagcaaaacccatgctcttacctgttgttggaactctttgttgagatgtatataacgtgtcatcatttaaaagctcacgcttgtatgtgtctattaagataagtatatcaaggctgggcacagtggttcactcctgtaatcccagcactttgggcggccaaggcgggcgaatcacgaggtcaggaggtcgagaccagcatggccaacatggtgaaacccctgtttctactaaaaatgcaaaaaaatagctgggcatagagatgggtgcacataatcccagctactcgggaggctgaggcaggagaatcgcttgaacccgggaggcggaggttgcagtcagctgagattgcaccactgcactccagcccaggccacaaagtgagactccatctcaaaaaaaaaaaaaaagatatcaaaacatcaagttatacaccttaaatatatacaattaagaaagactatagtaaaaaaattcagactgaaaaatcaacaggaaacaaacctgatatggttctcagaaaagatatactttccaaaaggtagataaaatatgatacagattctattattgtcccaaattaaggaaattttagtgcatctaataagataagtaatatataaaagagcctaacattttccctagtatattataacatagtaattattcaatcaacattcaaacaactgtatattatacagtggtattttgtttggtattttctgaactgaaatgatagcagctcccaggaaattgatataaagtcagtctggatctccatctaaaacatagtgtccactttgcaaccttcagcctgtatttggggatgcatacttctgtatatagttgtttgacagttttagtgatgctgggctcctaataatgtggatattagtttgctctacctaagtactgtactgaacactgcatttctgcattgttaagttgtcatttctaaactgtatgaacaatataaagatcaataaagtcttaacttacaattttaaaagctgtggtactggacatctgttcagtgccaatatgacttccatatacaagaaatgcacacagagaagaaatcctgaaaactgtagattgttgactcttacttgaatatacttgatacggtttggctgtgtccccacccaaatctcatcttgaattcccacgtgttatgggagggacccagtgggaggtaattgaatcatggggggcaggtctttctcgtgctgttcttgtgatagtgaataagtctcatgagatctgatggttctgtaagggggagtttccctgcacaagctttctttttttgcctgctgccaatcatgtaagatgtgacttgctcctccttgccttctgccatgattgtgaggcttccccagccacatgcaaccataagtccattaaacctcttttgtaaatttcccagtctcaggtatgtctttatcagcaatgtgagaagagactaatacaatactgagagtatcatgtataacattgttactgaattgtaaactcaaaaaaaaaaagcagataatttgtctctcgtttgccaatttttttctctaaggcagggttttttaactttgacactattgacattttggactggttaattctttcttgtagggggctgttctatgcattgtaggatgtttagcagtacctggccccaacccactagatgtcagcagcacccctctccagttgtgacaaacaaaaatatctctagacattgccaaatgccccctcgggggaaaattgcctccagttgagaaccactactctgaagaataaaatagcgtgtggcaaataaaagacactcaccaaatatttttggattgactgaagacaggaaagaacagtctcccacaaaatgtaccacttgtgatatgctttgaatatctaggtatgacctggaaaaatttctataactttaatagttatgtattttatatacattagaaaatatataacatgacaaacccatgtttttgcctgctattttataggacagtgctaaagtcgatactgaagttaaaaagtaacttaattgaaagaaacattaactgtacacaacagatacattaaacacaactcatcaaattgattaaggtggtatgtgaattactggagtttgaagcactcatttatactaagggaaacttaagcacaaatgagcttcccctaagtctggtttgtgtaggccactagaatcctctttgggaatgatctactgccttgcacaggctagatacaggtgttgaagacaaattgcttactctttgagaattagtctgatagacactataagatatgaacatcaggatgaggtagcattatgagagttcaaaggaaaaagaaattactttctactcaggtaatgagggaaaatatcactattgatattgaaggatgaatggaatttttgtagtagataatacagaggaaaagagcagaggcaaagagttggaccagttcaaaacatatttaagggatgagtagaggctggtttggctggagtgtagtataactattaaggaaggtggaacctgcttgtagagggtatgtaatgccagggtgggttatccatagaacaaagattatttgattttctaatgtctggctaaaagctgctttgttgttattgtttttaagtgtattgtcattattttagaagtaatgtttagtttgggatggggacctgactgagaatcaagataaataaatactgctgcttacagaagtataaaaactaacacacacacacacacacacacacacacacacacacacatacacgctgaaagaagggaccagatgggggcagggcacagacaaacaaaaaaatagcagtaacctctgcagacttaaatgtccccgtctgacagctttgaagagagcagtggttctcccagcacgcagctggagatctgagaacgggcagactgcctcctcaagtgggtccctgatccccgacccccgagcagcctaactgggaggcacccccccagtaggggcggactgacgcctcacacggccgggtactcctctgagacaaaacttccagaggaacgatcagacagcagcattcgcggttcacgagaatccgctgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtatatcaccatcatcaaagaccaaaagtagataaaaccacaaagatggggaaaaaacagagcagaaaaactggaaactctaaaaagcagagcgcctttcctcctccaaaggaacgcagttcctcaccagcaatggaacaaagctggacagagaatgactttgacgagttgagagaagacggcttcagacgatcaaactcctccgagctacagaaggaaattcaaaccaaagacaaagaagttaaaaactttgaaaaaaatttagacgaatgtataactagaataaccaatacagagaagtgcttaaaggagctgatggagctgaaagccaaggctcgagaactacgtgaagaatgcagaagcctcaggagccgatgcgatcaactggaagaaagggtatcagtgatggaagatgaaatgaatgaaatgaagtgagaagggaagtttagagaaaaaagaataaaaagaaacgaacaaagcctccaagaaatatgggactatgtgaaaagaccaaatctacatctgattggtgtacctgaaagtgacgaggagaatggaaccaagttggaaaacactctgcagggtattatccaggagaacttcaccaatctagcaaggcaggccaacattcaaattcaggaaatacagagaatgccacaaagatactcctcgagaagagcaactccaagacacataattgtcagattcatcaaagttgaaatgaaggaaaaaatgttaagggcagccagagagaaaggttgggttacccacaaagggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactcaacatggaaaggaacaaccagtaccagccactgcaaaatcatgccaaattgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgttcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaaaggatcaattcaacaagaacagctaactatcctaaatatatatgcacccaatacaggagcacccagattcataaagcaagtcctgagtgacctacaaagagacttacactcccacacaataataatgggagactttaacaccccactatcaacattagacagatcaacgagacagaaagtttacaaggatacccaggaattcaactcagctctgcaccaagtgggcctaatagacatctacagaactcttcaccccaaatcaacagaatatacatttttttcagcaccacaccacacctattccaaaattgtacacatagttggaagtaaagcactcctcagcaaatgtaaaagaacagaaattataacaaactgtctctcagaccacagtgcaatcaaactagaactcaggattaagaaacacactcaaaaccgctcaactacatggaaactgagcaacctgctcctgaatgactactgggtacataacgaaatgaaggcagaaataaagatgttctttgaaaccaacgagaacaaagacacaccacaccagaatctctgggatgcattcaaagcagtgtgtagagggaaatttatagcactaaatgcccacaagagaaagcaggaaagatccaaaattgacacactaacatcacaattaaaagaactagaaaagcaagagcaaacacattcaaaagccagcagaaggcaaaaaaataactaaaatcagagcagacctgaaggaaatagagacacaaaaaacccttcaaaaaattaatgaatccaggagctggttttttgaaaggatcaacaaaattgatagactgctagcaagactaataaagaagaaaagagagaagaatcaaatagacacaataaaaaatgataaagggaatatcaccaccaatcccacagaaatacaaactaccatcagagaatactacaaacacctctacgcaaataaactagaaaatatagaagaaatggataaattcctcgacacatacaccctcccaagactaaaccaggaagaagttgaatctctgaatagaccaataacaggctctgaaattgtggcaataatcaatagcttaccaacgaaaaagagtccaggaccagatggattcacagccgaattctaccagaggtacaaggaggaactggtaccattccttctgaaactattccaatcaatagaaaaagagggaatcctccctaacttattttatgaggccagtatcatcctgataccaaagccgggcagagacacaaccaaaaaagagaattttagaccaatatccttgatgaacattgatgcaaaaatcctcaataaaatactggcaaaccaaatccagcagcacatcaaaaagcttttccaccatgatcaagtgggcttcatccctgggatgcaaggctggttcaatatacgcaaatcaataaatgtaatccagcatataaacagaaccaaagacaaaaaccacatgattatctcaatagatgcagaaaagacctttgacaaaattcaacaacccttcatgctaaaaactctcaataagttaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagtgcaattaggcaggagaaagaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggataaaaaatcaatgtacaaaaatgacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaatgaaattaaagaggatacaaacaaatggaagaacattccacgctcatgggtaggaagaatcaatatcatgaaaatggccatactgcccaaggtaatttatagattcaatgccatccccatcaagctgccaatgactttcttcacagaattggaaaaaactactttaaagttcatatggaatcaaaaaagagcccgcatcaccaagtcaatcctaagccaaaagaacaaagctggaggcatcacactacctgacttcaaactatactacaaggctacagtactcaaaacagcatggtactggtaccaaaacagacatatagaccaatggaacagaacagagccctcagaaataatactgcatatctacaaccatctgatctttgacaaacctgacaaaaacaagcaatggggaaaggattccctatttaataagggctgggaaaactggctagcgataagtagaaagctgaaactggatcccttccttacaccttatacaaaaattaattcaagatggattaaagacttaaacgttagacctaaaaccataaaaaccctagaagaaaacctaggcattaccattcaggacataggcataggcaaggacttcatgtctaaaacaccaaaagcaatggcaacaaaagccaaaattgacaaatgagatctaattaaactaaagagcttctgcacagcaacagaaactaccatcagagtgaacaggcaacctacaaaatgggagaaaattttcacaacctactcatctgacaaagggctaatatccagaatctacaatgaactcaaacaaatttataagaaaaaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccataatgagaaaccatctcacaccacttagaatggcaatcattaaaaagtcaggaaacaacgggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgtggcactattcacaatagcaaagacttggaaccaagccaaatatccaacaatgatagactggattaagaaaatgtggcacatatacaccatggaatactatgcagccataaaaaagatgagttcatgtcctttgtagggacatggatgaaattggaaatcatcattctcagtaaactatcgcaaggacagaaaaccaaacaccgcctgttctcactcataggtgggaattgaacagtgagaacacatggacacaggaaggggaacatcacactctggggactgttgtggggtggggggaggggggagggatagcattaggagatatacctaaggctaaatgacgagttaatgggtgcagcacaccagcatggcacatgtatacatatgtaactaagctggacattgtgcacatgtaccctaaaacttaaagtataataataataaaataaaataataaaataaaataaaataaaataaaataaaatgaatcttaacacacacacacagacaaaaaagaagggaccagagactagaacagcagaggatccgaatggaaagatcattccatcagaagaagcaaggaggtaacctgggcctgggggagtttggggcttgaggtgatatgggtattaggccttgagccttttatctctctaagaaaattgtcttatttaaaataagatgctgatctttggaagtttattactgaaacgctcggtgaggtggctgacatgtagtattgatttttgcctccttggttttatcttcccctggaagatggctgcctccagtgatgcttgttgtctccaccatgctgacctctggagcagcaattcctctttgaaaatcctggcccatgcctgacagctcgttcctttgtggtttttcctaacacaactgaaataggtttgattcttttctaaaagactttattaaatattaaagaataaacaaaaaataaaatatgagaagtcctgccagatttacctagcatctctgatatcactgtccctggtcaagccactctcacacctcaaatctcctttccctactgctgccagaggtgtcttctttaaatcccaatttagctatatcactaccctgtttaactctttcatgcttctcattcgtacatggattatattttagtatattaactttcttttggtatttcctggagtaaggatggttttatagttatgttgacataatgattatttcatttatctgatttgaatgggttacagttaaaattgagatgacacttgggaagggtgagcaccttcctgtaaaaaggtatgagttctaacactttcctaaaggtttcccagaatagctttatctgaagggtcaggagtcactgtatttcaaattgtgcttcctatagtgctaggtttctgatgaggtatgtccaggccacctccagaaaaaatctcaatgggtgagactacaaccctccaccccaattctgcctgaagagttccaccctaacccattttttatatattggtggtccgcataaaattttttgagggctgtctgctgctttcaaaaaagatgtgttgatgagaagtcattagatgatttctaaagttcctttcaactccaaaattatctgagaatccagcccccttgacttctttcttgattcactttatgctaattttgttccatatgattaaaataatagaatttcagagctgcaagaaactttagcagttatcttgtccagttttccaaaatgagctccaaagaacaagactcctgagaaacgcccatcgcttacagaaaggactgtatagctaaatattttgagactgtacttttgtcccattgctcattagcattttaaaggctctgaaaagtcttataataaagaaacctgattaaattaagtcggtatttcctacatgggaagcatgggctctgtatcaacttactatgaccttctttatctggtactagtttctgccctattaccagatcaaagagctctgtttttgaataacacactttttaacatgctgtggaggataatttgggaaaactcatatagttgagcctcctccttttgcaaagaatttatgataggaaatgattgatcaagtgtcacacagctgattatcaggtctcagtctaatatttattccttattggtctctgcttaacttcaagtaggttatagattccttaatggactgatagtttatgtcttatagctttacctttcaggcgcttagtttcatattgggaacatgacaagtgaataataaatacatgatagctctatgattgaaccctgtgagaaaatgaagcattatgatatgaattggtttctgtgtatgtatgagtgtttttttttttcatcttttggaaacagaatttctgctcccctgtgtacaccctttctctgtaattgcagtgtatgttttttgtttctccaaagtttctgttgtcagtagtttatgatcattggttcatactgtttattggaaataactctgtgggctgctttgcctcagggctaatttgattagggatgctgttgttttacaccgtttgggaaaatgttacactttaaagggtattggatttgtcacagaatgatattgaagggaagccggagacaggaaagctagtaacttgctggcctggttattagcattggaccttttgggatttttgtctgccatttttgttgatactgctgttttctgaagagataagtgtgtgaccaatttgaggattgttatttggcacacgcagaaactagtaccagataaagaaggtcatagtaagttgatatagagcccctgcttccagaatattgtgcttctgtcctctgaggttagattttctctttgtgagggagaaaacatttatgtaagggagaaagattggaatgtactgaaatgaaatgctcacattgaccacatcagctgtactggagcttatctgatgtagccactcagcctctatcaatctgactgtgtgtatgtgctctgttttgtacagggaatcatcatccagggacgtgccagaaaccacaagaaaacatggggaggggtaagtttctcttcctttttaagtaattcagactgtctccatagctattatagtcaggaaattaaatttctaactcatagtatatttgtggacacctaaattgtatttcttgttagtgttagaaagtttttgtctgaagcagggcttttcagagaaagaccatcaaccacatttattcactggatctttgattttcttcttttgtagagacctcccagtatagggagagatggatcaagcttgatactatatatatagtatatactattttatatatataactcacagatactatatatatacaccttccccaaacccagcttctttataagtcttttttctgttttctgttttcttgctagtaacacaaaataaagagagtctactatgcagccaataacagtagtaaaaaaaaatcatctgtgaggttgatttgtaatttttttaaaaattttaaagcccggcattaagaaccattagatgaattccttttgtttatttttgccttctcataaggctgtttatgggcagtggacaacagataaatttaagttcatttcattgttaatattaagcagccaccacagggacttcataaataattctaattaatgtatatcatgtcaacctaaaataatcaaaagggtcagaatctagtttaaagagtttatttgagtgcaaaggttgaggacggactccaaagaatggaaatcactgtttccagttgtagaagtttggggatcactcgaatagacaaagtttaggatattttaacagaattttaacatctttctatgtaaggcttactgcatagttacaatgacctgattgatccgggtggtccttttctttcaggaaaggtatatttaacattccacactgaagatgtgattgtcatggggtctctgtttggggcaccatctggtctgagttaggtacaggataatagagtagcaaagatcagtgactgaaagggggaggtctggcctctggtctttgctattcatttacaaaacaatagcaatgaggaagagtgttaaactataacctaagaaacagaactgcaaaatgttatgtgactgaaaccacagtcacatgtctcccaaggcttaaagtgttttggggggtcccaacagcttttacattttattaattttcacaattataaaattagaatgccttgaaggatctcagaggaagatttggtgtgtggtgtggtatagtacagtgagaagaatactggatacagaaggcctgaattcaagttccacctctactaccttgatcaaatcctagaacctccctaaactcgtttgttcatccctgaggtgggattaatacattctgcacttctagcctcagaaagttgtcgttggcataatgtgataatacatgtaaaagtgttttgagagttctaaagtgtaatggaatacagcagtggtatctgcccattactgtccttactaactatatcttcattgtttttttaatggataaaaatgaggttatttgaccagatgcttctgtaggcagcatgactgggacttgggtcatgcaagcaactgagaattcttttgttgcactttgcttgccccacccttgtgtgggccctggtaggaagccctaaggattatggatcaatcatggaaaatatcttcttgaatcttgctgaatcagcttttgttcctgttttctccagagctgcccttggaaattgattaggcctagctattctggttctttccagatcttcacaaaagatggcaatctctgatggtttcgaaattttaaaactaaatgaactttttaaaaactattcggaattctgggactaatctgtgccacgtcctgcccgcaaatcagctctcaatggaagcttctagagtagtgatacggctccaatgactgggggaactccagggtccttagtctcatgtcgagttagataaaacgacacagatacacgtggagtggttttaagtagtggagagtttaatagactagaaagaaggaagaagctccctcctacagctgagagaggaaacctcgaatgtggtggaaaacagccagttatatgaggaggctggaggaggcagtgtctgatttgcatagggctcaggggattggtttgaccaggtatgtcgttgacatagcctgcgagaaaactggccctcccaccctagcgttttaatgtgcaaatgtatccccatgatgttctacacatgtgggggatatgtgggggtggccatgttgccaggaacatgttggggcaaggggaagaagatggtgggaatcgccacgtttgtgtggacccagtttccagtggcaggtatttgcatatcaaagcttgccggcccaactttaagagcctgggctttcccgctagacaagaaacgtttctggagcagctttaaaagaaacaaaaacttcccaaggaccccctttcctatctattgcctaaaataatttcttagtaactcctataacattagaacatcatgtttgatcctcacccaatcccaaaagcttcaagtggatttggagaatgttctggttgttggatactgctatagccatatagaggagagagctgcactgagacgaaacccgttctttctcatttcctctattcatttttagactgctcatcaggtcactagcaaagggactgttaggtgcttagtttagaagatgtctcagcaactttttgttcaaatggtcaggcaattagtagttgacctttgaacaatgtgggggctagggatgactctgttgcataatcaaaaatccatgtataatttttgatgcccccaaaacttaactactaatagcctactgttgactgaaagccttaccaataatataaacaattgattaacacatactttatatgctatgtgtattacatacagtattcttgtaataaaatacactagagaatagaaaatattaagaaaatcataagaaaaagaaaatgtatttactagtaagtggaagtagatcatcataaaggtcttaatttttgtcatcttcacgttgaatcagtggaggaagaagaggaattggtcttgctgtcttaggagtggcagagactgcagaaaatttgcatagaaattaacccgtgcagttcaaatatgtgttgttcaagagtcaactgtagttcttgctaaagaacagggcatggtaatgtaatctgcaaagataggcatgtttccaggctggtgatgagataagggaagtgcttcaaagaatgctgcttttacaaatacagaagcttgtgatagcattttcactgtgttgaccactttgaaagtatttgtaatatcctgaatctcaaagagactctatcctttactctctaagctttgcttagtttgcctgattacatttgttaattgctgacactgttattggggagaaaaagatgctactgtatgctcatttttctcttttctggcactgtacaatgaaatttttcctgcacttggcaaagattctcacaaacgtagcccagtgtatcatacagagggacacagaggaaaaatattgcaaagatatgacactagcctcataacataaattaaggatgcatgaaaacaaaaaacacacttggataactgtacagtttaggtgagaaattaaaactgaggtgaatttcttttagcattctttgatattagatgaagaagttatttgtacatatgtgttagaagaatcattcgtttatgtgacatgaaggattataaacaaaatttaaatattaaggtggggaagatgagaacagccttgtatatttaattttttattagtctactactaccagtgtccattgtgtgtggcactgaaatcccattcactatgtatgaattcttaaacagggcttagtatttaggactcttaagaatctataattattctgagattaacacatttctgtagagcactttataactcataggtattccctctacattatcttgagttgtaagacaaccctatgttgtaaatagggattattatcctcattttatgtattataaaactgaggctcataagaaaaagtcttatctgtaatccacagactactaatggagagccaaaatgcaaatctaggtcttatgttacatccagttttttttcttccaataaaccatgttctgcatatcttaatcatcagtagtgtgtaagtcaattaaaaacttaggagctctctgttgctgtgagaggtatggaagaaattattttttgatatctgcaatgttcatattatcatgagggactggacagataggcgaagggaaatggctcattgttcatcaacctttagggtaacagctaaaatacatgtgtatcagatggtggagtgcctcaaatattaaaatcctctgagcagcagtggtctatgtctgtggtaattcaaaaggcagctacactgattggcagtgaccatagtagataacaaaacaactcagttcagaagctcgtgctacacagtccacaagggaaggtgcctaaagtaaagggcctgatgccgcttacctggcctatgtgaaactcacccgtttgactgatgagtttttatctttgttgcttttgttgacacaaggaatataatgcatcatggaacaccagaatagcatgagatgacaagatgagatactggttcaaaaatgaacagcaggtataaataaaattatatgtaaaattctagtagagaacatttttacaaagagaatgtgaggattttacaaatgtgtatgtatagactcacatagcattataatataatcagccttccatatctgtaggttccacatctgtagattcaaccaaccatggatcgaagttatttgagaaaaaaacaaaaaaataagaatacaacaataaagtgcaaataaaaatacagtatgtaaacatagcatttacattgtattaggttttataagtaatctagagatgatttacagtatacagaaggatatgcataggttatatgcaactactatgccattttatataagggacttgagcattttggtatctgtggaagtcctggaaccaatccccagtggataccagatgactgttctaggatatttatctttaatcatcttcaaatggtaattagaactatattttaccttttcatttctcatctgaccaactggcatattcatgataaaatggtaaaaggcccagtactcccagtaagtattatctttacctacaatgaatatttttcagttttcttgctttaaaaattttgtgattattgtttttattacagtgtttcggtagaatttgatttttaaaaatatagctactttccatctgaatttttttctatctcagaacacatttctattactgaatcttctaagtgctgtagtttgtggtatctgctagcctcatatgaagttattaatggctattttcactgtctaccttaaaagcagagcttctgggagaagttcatcatgttgtcttgataatagcaaatcatgagctagctgctcgtacacatcttccacaaaataggaataatacttagccatgaattttcaaaaggattaattttgctttgttatatacaaagcaatatctggaatagcttaatgattgcaatcaggcaggtctactttgtggaggataatctgaattaaaatatgaagataacttaggattttttttttctgtttctcctcttccagtatttagtctttggaaataggtcttacctacctagcttagaagaaaatcttaggtctataaaatcttaatatgaaaagtcagtttccattttcattttctgtacttaatagtaacatgaccttaatgtcttagcataaatgaatttttatggtcgtgctatagcaaaacagtggtagtgttgccagttagtctttgtttcttattaaaacatagcagcataattcctctgggtccttgcatgtgctgggctcctttatcccaaggaactcaaacatatccccctagttgtcaagacttagtggaaggcaagatggtttacagccaccacagtaaatacataagttctttaattcactgctgaactattgttaagttgaagccaattctaaactttaactgagtgtacagctctatattgtcaaatagggaatgaaccttcaaactgacaagccctgtaaagtaactgtcttataatgaagtgcctaattttatttggctttatggttcaagtgaagttatccatttaaagtcaattaattatttcatttttctggcctatattagatttgagagtctctttattgtgacatattcaggcctctttagtttagatgatgtcaataatttattataaattcttatcttcagaattttataacagtaatacgaatttgcttgtagctgacaactgccataattttttcttggcaagtttttctcaccagaaaaaaaaaaagaactaacggagaggttacttttaaaaaactcattatagtgcttgatgctttttgtctttgatgcaatcctctctgccatttacttattaaagaagaaaataacctttggcacataattttagaaaggtttctcaactttagcactattgattttttttaatggaggcaaaatttatataacatagacttgactgttttaaagtgtataattcagtggcatttagtacattttgtaaccagaaggttgctgtgctgtaaggaaaatagttacaaaatgtactaaaggttgctgtgcaaccttccagttataaaacattttcatcacttccaaaggagatcctattcccattaagcagtcacttaatcccttcccattatcaacatcccttaccagagaggtacatttgttacaatcaatgagattacattgacatgtcattatcacccaaagtccataatttacattagggttcactcttgttgttgtatattctatgagtttgggtaaatgcgtaaagaatgacatgtacccaccattatagtattatacagagtagtttcactgccctaaaaaaaaatcctctgtgtgccacctattcatgcctcctgcccactccctctccacccctggcaatcactgatctttttattatctctgtgattttgccttctcagattgaagagaaagaagccttctcagattggcttctttcacttagtattatgcatttaggattctttcatgtctttccatgatttgatgcttgtaaattctcaactgtttgggggtaaatatcaaggagtaccattgctgtatcatatggtaagagtatgtttagttttgtaagaaaccatgaaaccgtcttctaagtggctttactattttacattcccaccagcaatgaaagagagtttctattgctccatgtccttgccagcatttgatgttgtcagtgttctagattttggccagttaaataggtgtgtagtggtatcttcttgttttaacttgcaattccctgatgacatatagccatgagctgcataatgatgttttcttcaatgacagaccacatatatgaaggtggtcccataagattatataccgtatttttacggtaactatcctatgtttagatatgtttagatacacaaatacttacattatgttacttacagtattcactgtattcagtaagttgcttatagtattcagtacagtcacatgccatacagttttgtagcctaggagcaatgagactataccatatagcctaggtgtatagtaggttatgccatctaggcttgtgtaagtatactccatgatgtttgcgtaacaacaaaatcacctaacgatgcatttctcatgatgcatcctgccgttaagcgacacatgaccaaatgctgtggagcatattttcatatgtttatttgccatccatgtatcttttttggtgaggtgtttgttaagatctttggcccatttttatatgcttgttttcttactgttttaagagttctttatacattttggatagcaatcttttaccagatgtacctttttcaaatgttttctcccactcggtggtttgtcttttcattctctcgatataatggtgttttttatagaagtaagttgagtctaaaggagagcagagtatgattctggagaccaaggtacagtcctagtcctatcatcaagtagctgtggctttgggtaagtcacttaacctatagatttcagtgtagtgttctggtcagcaaaatgaaggggttaagatggatcagtggtttccaatgtgttcggtgaagccacagatcttctaaaggggcccctgaggggccaccatgagggaagagaggaaaaggaagtgcccctggtacataacacctctccttcagacagaacaactgtactacattgtattttatctgtttttatttcatgataggttgatttgcagaggatcctatgactaataaaatttagaaagctaccagattcaatgactctcaaagatctctttcagttctgaaaatctgcgactcatgaacattaattaccatccaccttttgaggctgtattaatgtgtgaacagataggaaagaaagtgatagaggaactagtggaatagctaatgttatgtgcttctctgatggtgacaaatcattcactctctatttcatggatttgaagtatataattcttgttccaatgtggcctatgtattaggttgaaccataggaacctacacttaacatattacgttgaaccatatgaaatggccttcaaaaactgtaatttcatgtacttcaaccaatataaatgcagtatgcatagggaacccttgagttcagaggcttcttaaagcatctagatcgtatatgtataaatgaattaattaaaaatgtgtcgcagccagacgcggtggctcacgcctgtaatcccagcactttggcaggctgaggcgagtggatcacttgaggccaggagttcgagaccagcctgaccaacatggcgaagccccgtctgtactaaaaatacaaaaattacccgcgcacggtggtgcaccctgtagtaccagctgctcaggaggcttaagcaggagaatggcttgaacctgggaggcagaggttgcagtgagccgagatcatacccctgcactccagcctaggtgatggagtgagactctgtctcaaaaaaataaaataaataaaaatgtgctgatttcatgggtggttaacagtccactttggaaacaaatgagattccagaattctacacatcagcccaccacctcctttgggattgatgtacatgtagaatcaataggaagagtttattgaatataatcaaaatcaatttggcttttacaattgctacattctttttggcaaatgtcagtagctgccaatagttaaaggcatgtgaggtctaggctccccacaatttgactaccaggttacaactaagtcttaggccgaattttgctatacacggacatttatcaacaagatggcacagttctgccatataacttattatataaactctatgaaatcctatttctttccttatttaggatctcccacaatatcttagataaaaagttcatctaaggcatatgtgacagcattctagcaatggtattcagctaacccatctagttagattaaagcaatcaagaatccttcatatcagcaggtaaacatgaggcctttcaggaatcaagtcttggccaccattcctaagggtacaaactgcagaggctttagatttttctactgtgttcaggcacacccttgactgctgctgtcatttctggagcaaattcacataaaaacatgtctttcaccagtgaaaagtcatttgtgaaattcatgttagtgcttactaacaatagcactaaactcctcaatgaaactccatttcttaaatccatcatgctctattgtgggctggagagaaagatagccaaatgcgtttgtagtagctaccttagaaatgtggctgtttcgttaaatgtaacatgtgtcctactaggacagttatccacttctagagtctagattacaactatcacatagaatacctatcctacagtctatgctgatgagttgtaaagcaatcattgcaatataaaattatgcattataagctatatttcatcttgtgagttttatctacctgtctttattttctattaaatggtgattattagtcacagctattaccatagtcttctatatgagatagaatgtaatcagtatagatagggtccataaactagaaaggaaatcatacggttgtaacaaccgcaaacatcaagactactgatattgctgctggtacaattgaggcaccagtaagagtagaactagctatctttggagttctcctgttttggtgattccatctgattgtgtgcttagtcatgacaaattacactaataattccatatttgtttgtttcttgggagcaaggcattgctcttggttcagaaatatgtattagaataccatacctttaaatcagtttacataattgctattaatttgattggtgtaatctgccatttcatgacgaattctttttgataagaagtagttataaagtttaaaacccctttaaagaaaactttgccttttgccttcctctgtgggagaatatattgcgccatttctctctatgtcctttttccttacaaagcataaaatcattagatgagagacatctgaatgtattctctgaaatttggcttttaagtataccatattgagatagttagtgtcactctggtgggaaccatgtttgttttatttttaaagaatactgactttatagacacactttacctcttttgtcatctctcatagaaatccatttctggcatattatccacactttttccaggaaacctacctgttatctggtatttcattgtatgcctctggtactacagatttgtttaagttttaggtaatgatcataactactgtatggtccttagggggcagatttcaggtattaaatatattaataatcattatttttttctcagtctcttagacttcccactcccactagctcaatcctgcaacttccaattattttttaaatatatgagctttttaatgggtttcagttccctcattcctgtgtaaacatatactatatgctatactaaactctaagtttgcaaaaactggttgggcacatgagtaccaccatacaataaattctgaattattataaacatatcagctatgaaaagttaacttttaattttcagaaatagtttaacaatggtgaaataaattgggacattgtacatatttccaccttcctaagtaaaaataggaggatgatttaaatagtgtctttttagtttgcttaattttgttttttagtaagtgaaatgtcacttcagagtataagactttgatttcctaggaaaagttgtttccatcagtctgtgataagaagtacctatttaacacctatttcagcagaaaaaaaaagtttgaaggcattatatgcagacacaactgaataatagtatcaaaatgacttacaagcgagaaaacaaagaattatgagtttgacacttcataagatgtttaaaaaataaagctaagcacaggattgggtggaatgggtgcttttttgattttctctgtttgtttgtttattattggtttgggatatggtgattgcttggctggaaaattgtgtattaatatcccaaaaggattcggatccaatacactactcccacttcctgaaattctttccaattatagaactctttatggttacaactgaaagtacttaagaaatcatatccaacacctttgcttcatcaattaggaaacacgttcagataaattaagcaacaaatgtaggatcaggtagccagtttactgccagagctgcaacaggaatccatatatcccgactacaaattcagggcctttttaccataccacactttttccttatcctatagtttcacttgcctcaatgcagggttggtgaaaatggttaatagatattggctctcttagacttcaacaacatatctcaaaaggcagctttcatgtgacaaacagaaggctcgaataagcagagagctttgcatgttctatagtcttgtatgagaaatttacaattaagctggattactagagatttattcagaaaagaaatcggcttccttgttaatttgtggactctgtagattcagtctgtggtacagcaacatttatacaatactgggaaaaaattttcaatttgagcaaatatattttgcagattgaggatgcttacctttttaaacatgatttaaaagatttttaaaaaccatatttttatagaaatagctctaaattagattatataatttactgccttcttgaacatcatcctgaacatcatatagccctttattggtaactcacattcaccattgtaaacataatcattgatgtctatagccttgagagctgtcagtgtgatggagtttagatcctactctaaataacccccaaagagccttctgactctcttttcccttgccttcagattaattagctttcacttctgttggctttcagtatgttgatctagttcagcccaccctgccccttttgctttctagttttcatgtgcaatgaggctttgaagtctcaggagccaggctcctgcacatggatagaggaaactgacctttggttagtgtaagaagttgaggttcccctgtagataaagcatcaagtgagttgtaatgtatgaccttggtcatctcttgtgtctaagttcatgagaatgagaatgggtttatttgagcaacttttgcatttctgcataaacgaggtattactgtcattcatatctgtagtgattatgtaaaacattgaatagccacccaaactatcaacctaaagttcaataaagcatattttgttatagttacttgtgattatctaaacatacatatctgtcatgtatgtaacttttctttcataatctatcctttctaagagcttatttgtggtctgttgttaaaattccagtgatgataagctatcaacatatatttgaccaaagttgaagttaataaaagcaagcatatacattatggcaaagggtatttcctcacaagtttgttataagtatcaagtccttataataaggaccatttctggaccatttcttgagaagaagttctgaaattttaaaatctcatgatatccccaaaatatttatgaatcataaaagtatattgtagcaactatacagcattggttaattgaaaagacttataagattctacggggtatattctcataaggctttaataatggctcaaggtatggtacagcaggagagagatcactcacaaggccatttttagttgcacaggacacatttgtcttctaattgtgaaccaccaagattatgtgcaagataaccttggtatcgggagctaaggctcatgtgtacagaagatctttgatatcccactggtcatgtagctgaaactagactatgtaatcaattagtcaggtgcaatcagcctatatgttttccaaaaacagttcaggacaagctactacagtgtgcctccaagcgaatttgagacattaaatagcacttcataaagctactacatgtcatcccagacttgaccaaggagaccaaactcccaggcattcctgaagttaaggagacagactcacggcaagttaatcctatttattctatatttcctaagtgtatttttattatcagcttgataaatatcattttttttatttcacagaataactgccacaatggtaatgacagtgagtcacactactacttattgtaaatctgtttttttgtcaagccctgagcaaagcactcatttataacttataacttgagattggtgttattttttcagttttatagatgaataagtgacgcttaggtttttgttttcttcacatggctatttgttctgacaaccctttttctttctaactagtgcacactaacaagcttgggatatccataagattaaattgattactcaaaacaaccacaaggctccccccatcaatgccataatgtctttattccttttctgactaaccttgttcccacaagaaatccaataactccagggttgcacaataggtctagaggagaggccctgactcttgaattgaagaagagctatggaatgctaggttcatttgtagaaagtcctcattctctgttcttgatgttcttgctactgtttgctactgtttctggtgtatagtcttatatcaaaaatagggcacctatggccaggtgctatggttcatgcctgtaatcccagcactttgggaggccaaggtgggaagatggcttgagcccagagtttgagaccagcctgggcaacatggaaaaaccccgtctatgcaaaaaaaaaaaaaaaaaaagaaaagaaagaaaaaagaaaaaagagaagtcaagtgtggtggcacacacctgtagtcccagctactcaggagactaaggtggaagggtcgctttagcccaggaggcagaggttgcagtgagccaagatcacatcactgcactctagcctgggctacagagcgaaactctgtctcagaagtgaataaataagtaaataaataaataaataaataaactaaggcatccaaaccacaaactcacacacccaccagaaatatgcctgccttctgaccttgaagaacatccgtcatgttcagtcttacaatagagctctttgtgtatctcttttattatatctttgttacctcttgcactgaagaaccttgagggcagaggtcatctgctacccatctttgtgacttgttgcatccacttattttatttatttttattattttcttttgaagagaaagcatggatgagagcttatttattttgaaattatgaaaaagtggttacatttttttgaataatatacttattttgtgtctgtgtatgtgtaaatatgccttaggtttgaaatattcaatttaataagagtatttcctaaccgaatctgaagaaaaaaggtttaggtttttctttatttcctttaatgggaaaactgcatgttttaaataacacctcagtattgtgttctcaaggcacatttacattctgtatacttgtcacatcatataatccttgattaaggcatgcacatgattcctgatagctgtaatttaactcacacaatttaaggagaaagaggcaattaaggaagtgatcactcaatttaaggaagtgatggactttagtttcaaacatcatggctttagttaaacatcctaacgcaagcccttgcagcctggaaattgccccatgtttttagaggagataatctgatttcatcctatagatcaaagctgccaccttctcccttattttgttttcgcattttaaaaaattctaattttaggggcacatgttctcaggatctcctgagggctgtgtcatgggcaaaaaagaaaataatctagttctggtatcatcatttagggtccattaggtttccaaatactttgatgagcactggcaaattctctgccactacttcctgttccctaataaatggcagacataactaatctataatagtatctttcctacaggtcagattcttactttaagtgatatcttctaatggactggatttggcaagtgagataaaatctacttgccagctgaatccatgtagagttcttagtattatattaccttgccgcccagtacaagaaatacatagaatatgatcatggaatgcttggtaatttgattagacttggattagaagctttgtgtcctgctgtattaccttccatttgcttattcttctaaattagactgctttctggttactggagtcagtggcttgctttgactcacctttttgagttggatagcatataagaaagtaattatctcttagaagcatttagcttttttctcttaaaagttcaaaatacattaatgttgattgatttatcttcagaaaaactgattcgaaacccagggatatcttagaccacattaacatatatattgtctttaaaacaaggaagccaataatcctgaccagttttgcacttgtcagaccaaacacaaagtattgcgctcagcataggtcactgtattttgagaggaagatgatgcagactcaaatccattttctatggcaaacagatgaagaagcaagacatgtttattctggaaaggagaagtcccacgggaaaccatttactgtctttcttcatgtattagttggcctgttatatggaggagacttatgcgttaattcagagggtataaataagactaatggctaggaagttgttaaatcagtaaaatatctcttgaaaaagggtactatagtcaaatatcacaaatgcatgtatcatgttccttttcagatttacaaatacatgcatgcataatgatgtttcagtcaacaacagactgcatatacaatgatggtcccataagattaggagctgaaaagtttctattgcctagtgacatcatagcatcacagtgttaacacattactcacatgtttgtggcaatactggagtaaacaaacctactgcactgctagtcatataacagtatagtacatacaattatatatattgtatgtatatatatttattgtcattctggagtaaactccttctacttatgaaaaaaaattaactataaaatagcctcaagcgagttcttctggaggtaatacagaagaaagcattgttataatagcagatgacagctccatgcatgttattgtccctgaagaccttcaagtgggataagatgtggatgtggaagacagtgatattgatgatcctgaccctgtggaggcctaggctaatgtgtgtgcttgtatcttaatttttaacaaaaaagttaaattttaacaaaaaagtttaatttttaattaattaattttaatttttaacaaaaattaactttttttaacaaaaaagttaaattttaacaaaaaagtttcaaaagtaaaaaatacaataaaatttttaaataggaaaaaggcttatagaataaggatatatataaagaaaatatttttgtacagctgtacaatgtgtttgtattttaagctgtgttattactaaagagtcaaaaagttaaaaaattaaaaagtatgaagtaaaaacattatagtaagccaaggttaatttattactgaagaaggagaaacattttccttctttttattttcatttaattttattttttattttttaatttaatttaattttaatttttttgagatgaggtctcactgtgttgcccaggctggtctcgaactcctgggctcaagcaatcctcccacctcagcctcccaaagtgctgggattacaggcatgagttactgctcccagccaaaatattttttttaagaaatatatttttatacatttaatgtagcctaagtcgacagtgttgataaagtctacagtagtctacggtaatgtcctaggccttcacattcactcaccactcactcaggccaactttcaatcctgtaagctccatttatgataagtgccctgcaaactccttttatggtaggtgccctatacagtaccattttttatcttttatatcatattattcctgtatcttttcaatgtttagatatacaaatacttaccattgttataattgcctatagtattcagtatagtaacaaactgaacagatttatagcctaggaccaataggctatatcatatagcctaggtgactagtaggctatgccatctaggtttgtgaaaatacactccatcctgtttgcacaatgatgaaatagcctaacaatgtatttctcagaatggatccacattgttaagtgatgcatgactgtttatactaaatatatatgaagggccctaaaaagtcattcagtgaaagatctctttaaatttgttaaccctagcattccataaatacttcactcagaatgtttccaaggaactctcattagggtagtgattctcaaactgtggtaatgggagcagcagcagcagcatttcctggaaactggttagaaatgtaattttatagccctacctcagatctatggcatcagaaactctggggtggggcccagcagtctgtgtgataatcagtccttcagggattctgatgcggctaaaaggcaagaagtgttagaaaattttactgttattctccaacttaacagtaaccttttgctttccttcattacacttaaccacaatttgtattttttaaagttctaatgatattctatgaatctgtgaattcatattccataatcataatctattctctgaatttccttccttctgtacctcataaagggtcataaagggaaccctttatgaggtacagaaggaaatactcattgaaggcctatcatggttttcaccctggtataagtgtcatctagctggtgtcaatttggatactttaaagaatcctaaataatgagtccatatattctataaagtaaaatactcatttctataacaaagcaaaactttaatccattgctggctgtcattgtcatttttaaaagagcacataaaaagtttttcatttccttcaaaatgtttttcagaaaatgtagacttttttagcatcttgaaagatctgtaatgtgccttttcttatgtcagaattctataaattaggaaatgttctaatctcttgcattaacggagatgaaattctggtggcattatatttgtctctccaaacaggcaacattcttttagaaaaatgtaattgaaattgaacttaaaatgtatttgtatttaaaaataaaacatcttattttttattttttatattttattattattaaaataaaagcatcttttttacatggtttcataaatgtattttgaatgtttatatgaaatgcctctgtaaatcatgcagaagaattttctttttctaaaggacagtgaaatgaggttgaatgtgttaaagcatcacactatatttaactcaagtacatttagaacaaaattattattaggatttccatagaatgaatcatggccaaatttaacttctcacaatttttttttacctattcttttcatacaagttagagctctctgggtttatattactaggtcaactgaagtgttatttatttttaggtagagggacaaagactgataatctagagactggatttgatttggctgctgctgtctgtcagcagaatgccttggggtatctacttacagtaatgagtataagtagtgctatcattattagtatatttaaacacccatggtttgcaggaatgtgctgaagtctgaatataacatagttaattatgtcactgtccctgcccagggcaactgctattgaaaggacatactcacatcatgaggaagatagcagatacagtggtttggagctaagtgttacttcattgctgactcacggaaagaggtttaggatgttggctatgttttctaaagagcatctagcagttttcatctggtatatcaacttgccacataggttttttatacttatatttctttttagttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactgtaagtatgttggcaattaaaaagttgcacagatttgcctacctttttgatgtatatttgaaatctgcatccctgaattatgtacattgctagcaattaaaaattcctttgttaggaactcggaaaatggcatctaactagtaatattctgtgggttggagagctaggttcacttccccttgtgctggactgtctttgagagccccgttcctataggactctgctgagcgaggatttatcatcttggcgagtaggaaggatttgatttgcacaaagctttgttctagaaggttatagataatatcactttgcctaattacagagaaagtgtggaggaagctaatggatggtgatagtgttttaaaaggttttacttctcgtacaaaagaaaagacatccagacataccttcccactccgcgagaatactcctctttacttctctttactctagactacatgctattcaaagagagcaggaatgggacagcacaaggcaggggtgaaaagtctatagaactgctccacagctggaaattgttaccagaggtagccattgtataaagattcagtcctgggcagcaggaaaataaccctagatgctaaacaagtggtgtcacttatgctaaaaagatactaaatataccttaagagcagcagatgcaaaagttttaaagaaaggggtaagaggaagaagccacatcttagtcaaatcacagggttagaaatagggaaaagaatatatcatccataataccatcatgcaatcacaaagcacggttgaccttttattttctttccagctttttccctttgcatccgcttagtcattgttggttttattttattttattcattttactttttaaaaatagtatatgttcattgtagagaaatttaaaaatgtagtaacataaaatcacttgagtttttagcaccaccagttttataattttggtatatctcattctggcctatttttactacatagatacttcataaataagaaaaataggattgtagtagaaatagtgttttgcaccataaagtttttaataaaaactggctgaagttactataaaccataaacaaaacgtggtttttgatattgtgttttatcaaataatagaaattatagatattctactatggttttcacaaggctaatggctttttaccctactttatcattctcctttaaagaaatcgtaagaacttgtttgggatttattgttctaaaagtactttatacaagtgaataatattcttttacaaaaaaaatttattgagttatgtttgacatataaaaagctgtacttatttaatgtatacgtttctatgagtttggggataggtatacacctatgaaacaaccatcaccatcaaggccacaaacatatccatcacctcctaaagtttcctctcacccctttattattgttgtagttgtgttctgtgagtatggtaagaggacttaacatatgatctaccttcttagcaaaatttaagtatataatataacattgttagctgtaggtaccatgctgtatagcagatctccagaattcatttatcttgcataactgaaagtttatactgtttgctacttctcatttctttctccccaagcccctggcaaccaccattctcctctttgcttctattagttcaccttttttagattccatatataagtgagatcctgtggtatttgtctttctatgcctggcttatttcacttaatataacgtcctccaggtctattaatgttgtcacaaattacaggatttccttcttttataaggctgaataatatttcattgtgtgttgtattagtctgttttcatgctgctgataaaagacatacccaagactggaaaaaaaggattaattggacttacagttccgcatggctggggaggcctcagaatcatggcaggaggtgaaaggcacttcttacatggtggtggcaagagaaaatgaggaagaagcaaaagcggaaaccctcgataaacccatcacatctcatgatacttattcactatcatgagaacagcacgggaaagactggcccccataattcaattacctccccctgggtctctaccacaacatgtgggaattctgggagatacaattcaagttgagatttgggtggggacacagccaaaccatatcattctgccccggcccctccaaatctcatgtcctcatatttcaaaatgaatcatgccttcccaacagtcccccagagtcttaactcattttggcattaacccaaaagtccacagtccaaagtctaatctgagacaaggcgtgtcccttccgcctatgagtgtataaaatcaaaagcaagatagttatttcctagatacaatgggggtacaggtgttgggttaatacagaccttccaaatgggagaaattggccaaaacaaagggtatacaggccctttgcaaatccaaaatccatcaaggcagtcaaatcttaaaactccaaaattatgtcctttgactccatgcctcatgtccaggtcacactgatgcaaggggtgggttcccatggtcttgagcaactctgcccctgtggctttgcagggtacagcctcgctcctggttgctttcacaggctggcattgagtgcctatggcttctctaggcacacggtgcaagctttcagtggatctaccattctgggatctggaggatggtggccctcttctcacagctccactatatagtaccccagtagggactctgtgtgggggctctgaccccacatttctcttctgcactgcgatagcagaggttctccatgagagccctgtccctgcagcaaacttcttcctggacatctgggtgtttccacacatcctctgaaatctaggcagggattcccaaacctcagttcttgacttctgtgcacctgcaggctcaacaccacatggaagctgcttaagtttggggctggcaccctctgaaaccatgggccaagctgtaccttagccccttttagcaatggctggagtggctgggatgcagggcaccaagtccctaggctgcacacagcatggggaccctgggcctggcccaggaaaccattttttccttctggacttccaaatctgtgataggggtgggtaggggctgccttgaaaacccatgacgtgccctggagacattttcctcattgtcttggggattaacattcggctccttgttatgcaaatttctgaagccagcttgagttttttcctcagaaaatgggtttttcttttttactacatcatcaggctgcaaattttccaaacttttatgctctgttttccttttaaaatggaatacttttaacagaacccaagtcacctcttggatgctttgctgcctagaaatttctcccgccagataccctaaatcatctttctcaagttcaaagttccacaaatctctagggcggggcaaaatgccaccagtctctttgctaaaacatagcaagagtcacctttgctccagttcccaacaagttcctcctctccatctgagaccacctcagcctggaccttattgttcatatcactatgagcatttttgtcaaagccattcagcaagtctctaggaagttccaaactttcccacatttttctgtcttcttctgagccctccaaactgtcccaacctctgcctgttacccagttccaaagtcatttccacattttcaggtatcttttcagcagtgccccactctactggtaccaatttattgtattagtcgtttttacactgctgacatacctgagactgggaagaaaaagagatttaattggacttacagttccacatggctggcaaggccttagaatcaggcaggaggcgaaaggcacttcttacatggtggcagcaagacaaaatgaggaagaaacaaaagtggaaacccctgataaacccatcagatttcatgagatttattcactatcataagaatagcacaggaaagactggcccccatgattcaattacctcccccaggcccctcccacagcacgtgggaattctgggatatacaattcaagatttgggtggggaaacagccaaactatatcatgtgtatataccacattttctttatacagtgatctgtcagtggacatttggttacttttagttaggagtaatatttagaaactgagatctgggaactagaatatgctcattgctaccagaatgttgttacttctggatctttcagcaatagagctaggaaaaaaaaatcacacatatgtatacatgcatacaaattctatatatgtctatatgtagaaatgtaaacatataaacatatagacatgtatgcatgtagacatatatgtgaaataactaattcattatgctgatctccaattgcaatccaatccctcagggctcttccagccattctacttttgtagagatgtaaaaattccttatagatgttcttccaaaatgagaattccagcacccaaaaacatcaatatattaataactcatttgcttagttgtataatacacaatggtttcggaattgtaatatctatactgtaatgtggagagggaaaacttatattcattcatgcatgcatgcatgcatttttttaacatcttatttggaaataattatagattcacaaaaaattgcaaagataatacattgaggtcccatgcagcctttactcagtttcccccaatggttacatcttacataactgtaagatcaaaactaggaaactgacgttggtacaatctgtatgtatagttctgtgtcattttatcacttgtatagatttgtgtaaccatcactgcaatcaagtagcagatatatttcattaccacaaagttttccctcatactaccctttaatagtcacacctactatcttccacaaccatccctaacccttagcaatcactaatctgtttccatctctataattctgccattgcaagaatgttatataaatggaataatataatgtggaaccttttgatattggctttttagagtcagcataatgctcttgagattaatccaagttacatatatcaatagttcattcatttttgtttatgagtaatattccatggtattgatacaccatggtttgttgaaccatttgcttattgagagacgtgtgttgtttctagttcatggcttttacaaataaagctgttatgaacattgcataggtttttgtattgacataaattttcatttctgtgggataagtcactgggagtacaattcttgggttgcatggtatatgtgtagttttttaagacactgacaaactaatttgtcattgtataaattaccatcttatagtctcaccaacagtgtttgagagatccagtttctttacatactcatgagcacttggtattgttactgtgttttattttagccattctgctaggagtgtagtgataacttcttgtgattttaatttgcacttccttaatggctcatgatattgaacatctttttatgtgcctattttctatttatgtttcttctttggtgaaatctctcttcatgtcattagcttactttctgatgggatgttttattttattttactattgagctttgagagttctttattatcctaggtttggatctgttttcagatatatggtttctaggctatttgaattttatgtattaattgtatattctactactctcgtattgattaagttttatcattgattctcagtgtgaacaatgtttttttgttgttgttgtttgtttttggagacagattctcgctctgttgcccaggctggagtgaagtggtgcaatctcggctcatggcaacctttgcctcccaggttcaagtgattcttgtgcctcagcctcctaagtagctgggactacaggtgcatgccaccatgtccggctttatatacatatatatatatatttagtagagatgggatctcaccatgttgcccaggctggtctcgaaatcctgagctcaggcaatccacccacctcagcctcccaaagtgctaggattataggcatgagccaccacacctggccatcatggtgaacaatgtttttttttttttgagatggagtctcgctctgtcgcccaggctggagtgcagtggcgcaatctcagctcactgcaagctccgcctcccgggttcacgccattctcctgcctcagcctcccaagtagctgggactacagacgcctgccaccacgcccggctaattttttgtatttttagtagagacggctttcaccctgttagccaggatggtctcgatctcctgacctcatgatccgcccgccttggcctcccaaagtgctgggattacaggcgtgagccactgcacccggaccgtgaacaatgtttttaatgcctacatttctggccttttatccatctcagtgcttctatatatcatttcccacccacagagacaggatgctgcatgtcagcaatctttgaagcaagtagaagaaattccttcaactgtgagagaattgcttgagaaattttctgtacttccggcatcaccttttccttcctatagaatcattctcatcttattagcctacatgccccagaaagaaagagaaaaaagaaaactctcttaacacatcgccatccaacaaccacttcatttcttgaaactctgctctgcctacacttgctcccctggtgatctttcctcttctcatacttcaaatgctaataacttccaaatttatatttgtagttcctggagcgctaaactgaactacagacttgtatggctaactgcctactcaacatgttatcttagaatcaaatatggttctcaaagtaaacaaatttgcaccccttcccccaaatatctacacttactacatcctctctgatctcaataagtagtaactccatccatcatgtttgctgatctccaggctttttgccatctctgactcctctctttttcatatcccacaccccatctgcaatagttggttctaatatgaaaatatactcggaatctagccacctttctacttgttatcactttacatccaagccaccacaaccctctcatctgtatgattttttggcccctgccccatagttgattctcaaaacagcaggttagagtgatcctttaaattctcttacttgcaagggcttcccatctccctcagtaaaggccaaagtgctcagaatcacccaccaggtactacacaatcagtcctcatctatctccaccccacagcttcactcgatatatagttatttctttaccacatctcctatgacaccccaccccttattcactttgctgtggctttcttgtgcgtcctcacatacacagacagcacgtgacctgcctcatgactttggcacttgctctctcctcttctagatggatatgtctgagttccttcaccactctcaagtcttcactcaagttcattttcacagtgagaaagcactctaccttaaattgcaaccgcttgtcccttctgtgactttctttttttcaagcactgacatcatttgacatctatttgtttttttttttaattgttacctcccccgccccatcaggactgttagctccatgagagcaacatttctcatctgttttgttcatagctatggtccctagcatataaagcagtgctggcacataatagaagccaaataagtatttgatggatgaatgaaggaatggattggcaaatcacaaagtaaatttagtttatgggaggaaccgatttaaacccaagttggctgatagataatagactttaaaatggtttttattatgttgttgttatatttccttctttgtgctttaaagtttgtcatctgagtttgttcatgccattaaaacaatcccatttaggataaggtgtgccagcctttgatctagcaaatgtaagtgaagtggcattctcattttttatctgtttcagaacaatgtttgttatctgttaatcaggatctagcattgccagcaaagtttcatcttaatcttggcagtgaagaaaatgattggatttgagatttgctttctacttttagactatctttactatctttttgtttactaaaatttatcgctcagaatacttttactcatacgtggtttcatcatttccaaacatgaagtatgtgaatttagaagtctgctttcagtagaatgtttattgttggaattatttacctaatttggaacacaagtctaattatacaatgggagaaaacatattgtacttcacggtcctcattttcatcatgtagaaaatgggtcagatttattcagacattatctgctgaatgcctactatgtaacagtcacagtatatacaacaatgaataggctgctcctcatggcatttgagttctgatagaaacagcagacatatgcacaaaggcttatatgagcatgctgtaaaccttaaatatacccaatttttatttgtcagttatacctcaataaagctgagttgtcatgccaaaatcctctgctttgagaatcagatggaccttgatctggtgtctgagctctgccatctactgactatattgatttgcgcaaacatttcatcttttaggcctcaatttttgtatcttttaaaaggaggatattatacctacagtatgaggtttgaggctgtgcacttagcatagtttttggaacagagaaaactttcaataaatataatttattctagtttttaggtgctgaattcttgccactttatttaggaatcattatttcaccactatcactttttctctcttctctctatgagactatgagggttctctacattttggagctgttaatcttgcactgacattgagaaaatagtagtaattctttaaaacaatgattatagaacttttaatcgtatataatttctagtttattttgcttgactttccacagtggttgtcttcaaagttaagcgtgcataggaacagtctgggtgcttagcacacctgcatagtcccacctagtgcccagatctgggtttctaattccattctatagtgaaataaaacaggactttctggggacatggctcattattgggctggagtgtggagaatacaagatgagctggagaacattgtggtaccagaaagtaaggaagtgtgataatccaaagaatgggagcatgttaaagggacacaggaggtaacctaaagaagctctcagtggccaaagctgaacaattttagccacaaaataaatgatgtagtattggattatagcccaaaacacaaaataaatacacatgattatataatgatataaatgcatgactgaatgaaaaggtgaaaagagaaaaatccacactatagaattccaaattatgtatgtaaatactccaccccagatggtggagcttaattttcttcttcccttgagtgtggcttgaacttaaagactagctttcaaagaacagagtatgggaaggatcagcgggtggggggaggtggggtaactttgcaatggagaaacctgtcaaactactttgacctggtaatcaaagttactaagtcacacatatgatatactgagaacagacatcatttatttccatcaccgcaaactcataaccccagtctaaccatgagaaacttacagagaaatccaaaaaccaaaagacattctccaaaatgtctgactactatcaaaacagtcaaggtcatgaaaaaaaaattagaaaagactaggaaactgtcacagaccagaggaaactagagacatgattagacgaaatgtcaattagattctggaaaaaaaggacattaatggaaaaactaatataatctaaaaaaagtgttatatttagttaatagtaatggactaggattgattcattaattataacaaatttaccatcctaatgtaagaagctcacattaagggaaactgggtgaggagtacaggagaatgttatgtattatctttgcaatttttctgtaaatttaaaattatttcaaaataagaaagttcatttttaaaatgcacagtccaggggtcacaagtctccttggaccagggaacttgccttatttggtaacactttattagattctaaagaaagcagtttagctaaaaccacttagaatactcagagctctgcagtgggtggtatttctagggatatggatgactcttttgtctgggtgcatcatcccaagtctttatcccattcttgtgcactccatgtgccattctgccgccaagttgctgctatattttagaaactgagttattgatatccaaggatctgagatctgagttcagcaatccctttttagataatatctctcattccaaagtgtcaccatttaaatttgtttatgtagaaattattggggaagaaagagatatgcagtcccccttcacactaggatatgttacaaaaactacatttggagattgtggaattcagagcccatggcaggaggtggcatgtagacacttgtgagttgggattagtgattacaagaaatactgtgtctgaggtatctaaaaattgatcactaggtcctggagattactcatggcacttgcaggcagaaagtccgattctttggcactgttagggaaactcttatttcacttagcctctcatgatctgctgatggcactagagccagattcagaatattttccccacccctagtgactaaagagttgttagggatgagagaattcaggaaagaagggaggtggaagtccagtctgggcaagaaatataggaggcaaacatggggcattgctgtggccttcttctagccataccttattcatttccattgagaccttctcctgccttccctagacgcatcccagaccctccttggggaaccaaatatgaagtttccctttaggcacatgggtggtttcctggaactcccaaaggcttcctcgctacttcttttggaacctcttgaaaataagttaaatagggccaaaatatgtcattttgtgcaactggtattctgagctaccttctgtaaagatgagggaggtctgactgttgcaggtcaataacatgttgttccttatatgattcatttaaagtacgtttttattgattatatcattgatattgtttttaagttagtggtgaactttagtctctggcagttgggcccatttgtaggttataaattatttgtagtgtcaattattcatgtcaggttatggtagtaactgaattaggagagtttcagcctgtatgatattaataaagtagtagacttcttcagtcagggcggggggggaggtgctctcctgcccatgccagcagtatgttaaccttgacctataaagttacctcagcaagtttcctctcccagtaccagtgccaacctttttcagaactatcctcagagactgggtaccagtgaggctgacagatctatttgttgtcacttgtagaatcatttgcaccatggatttaatttaacttgtggacctgtcacctatcatgctgctgctttgggatccttcactgcttaataagcagtactgtcatggttaggaaatggctcatgtatccattacagagctgcaaccagtcaatggaattgatgacaataaaacactgacattcaaattgggatttgagtagaaccctagggcagcaactttgcttggtaaatgtctaaggcatctatttttccatctgaaagatgatgtcaacatgtctcccatagcatgctgggaagaagttagctatgaattcagagaataaggggctagctgttacctaaggaattatattctttagcctaatacagtaaacctctccctctaaaaaaggacaagaagcagcaaaaaccactcaaccaatgatgagagagaggtgttgtgaaatgatattgatagccagcagaaaataccattttttttttcttttttgttggtttctatgggaggctgaggtgggcagatcacgtgaggtcaggagttcgagaccagcctagccaacatggtaaaaccccatctctactaaaaatacaaaaacaaattagccaggcatggtggcatgtgcctgtagtcccagctactcgagagggggaagcaggagaatcacttgaacccaggaagcggaggctgcagtgagccgagatcgcaccactgcactcagcctgggtgacagagcaagactccatctcaaaaaaataaataaattactaaaaagtataaataattatgggtggtgaaaaaatatagctactttgataaatgtatccaggcaagtagatgaccaaaccaattaaacatcatatttcattgattctctaatcatttattcatattttaacttctctgaaattgaggtgcagtttacatactatgacatggcatggattcgttgaaagcagaattttttcctttttttttttttttttttttttgaaacacggtttcgctcttattgcccaggctggagtgcaatgccatgatctcagctcactgcaacctctgcctcccaggttcaagtaattctcctgcctcagcctcccgagtagctgggattgaaagtgcccaccactacgaccagctaatttttgtatttttagtagagacgaggtttcacaatgttggccaagctggtcttgaactcctgacctcaggtgacccacccactgcggcctcccaaagtgctgggattacaggcgtgagccaccatgcccggcccttttctcttttttaatacataaaaatggtgtactcttcaattcgtgctatgttatatttgataaagtacagcaaccaaccaccactgctactcacttctcagaggttctgatctggatggggtgactactgtaattcaattattgttatagtgggtatctgctgatttccttaataacggggtttcactagttccttcttccaatgttagggtacagtcccctctagggcaggacatttgatcatgactctcatggttggtatatcagtaactatagaaataagattcagtttagccatttccaaagtacaataaaaggaattgcaaaagaatttgtaactttgccatagccctatgttgttagcccaagtcttgggtactgtcaagctgaaacaggaaatctgtctcctagtgaactacaacaaccagtagatccaaagaaggctctggttttccttgaactgtatatttcagagggtcacactaatgctataacttaaaatggcattattatttaaatattaagatagtatccaattccaaaagctaatatttgataccaatcactgctcatcatgaataggctaaaggctgccttttcattccatcccattgttgaagaatgacttatggaattggttctaatcatcttttcatggagtccacaaaaaccaaataggtcaaactgttcatttcacaaatgaggaaatagccccagaactgttgatttgcccatgttctcattacagcatactgatgaagcccaaaataggagccaggtcccaggtcatctatttccatcttcctcattcccttcctcccctcctcctcattgaacacagtgccctcctagtttaattagtgatggttatgccaggggctttacaatgaaacaatttaccttcaggcttcttatgccagtccttattgggccagtagtaaagacacatgacatggtacttattcaagctcagatatgatagaaacagaaaaagtggtggctggtacctattcttagtcttagcctttgttttaatttctactgctttaaaattcttttttttttttttttttttgagagggagtctcactcactctgttgcccaggctggagtgcaatggtgcaatgtcagctcactgcagccttcgcctcctggatttaagtgattcttctgcctcagcctcctgagtagctgggactacatgtgcctgccaccatgcccggctaatttttgtattcttggtagagtcggggtttcaccatgttggccaggctggtcttgaactcctgacctcaagtgatccgcctgccttcacctcccaaagtgctcgggttacaggcaggagccaccgtgcctgacctctactaattaaaaattctttagaacaatgtcctttgggatagacaaagcaggtgatattctttccatctttagaccagtattttaagtgtccaaaagaccagtgatacttccaatttctgaatggaattggaacttggggcttttgattcttaagccagttttcattagcatcataccatgtagctaacacacttgcagcctaagacagaatgtcttgaagagaagaaaacctaatagaacctacaatataattaggccgatttgggaggagtataggaggaggctgatttcctgttatctgggaagtggcaatctgaacttttaaacagacaattttgaacttttttggtttgaggcggagatcaagttcaaggcagctaccttttcgttaaaagaaactgatgaggtttcattataagcctagagtaatgtttgaaagggtagaagagatgataaagaagtagttctatctaaagttattgaaaattttcaatgctacagagattcatttttattactttgaaagacagattataaagatccaggagggtattaagtaaaatgggataaattaataaaaattataattccctattaacctaggttttatattagtttttcgttaaaactgttgcattccactttgctgttttctattttattttattattgttttaaaattgagacagggtcttgttctgttgccaaggctggagtgcagctgtgaacatggctcattgcagcctcaacttcctgtgcccaagtgatcctcccatctcagcctcccaagtaggtgggaaccacaggtgcatgccaccatgcctggctaatttaaaaaacaaaattatgtgcagacaaggtcccaccatgttgcctaggctggtctcaaactcctggactcaagtgatcctcctaccttggcctcccaaagtgctgggatttataggtgtgagacaccatgcccggccatctattttaaaatatttaaactcaaggcaaactctagacaaaacagaactaaatctggaaggagctattataccagaaacaagaaaatgttaccaaaaatatcaaattgatattctcagaatttaagaaaacaataggtttgtaaaatgagaagaagctattacagaggggaccaattaggggataagagaaagtccttggacattagaaatgttactgcaaaactaaaaactggacacaggtcagacagtgcagagttcactgggttgcacatggaacatagtactcattctcctccctgcccacttccactgaaaaggaatgcatccctccccagataatggacccaaatacccacttccggccctttccgccattagccatccgccttcagccagctactactaccacagctcccgcctgcctgctcaccacatcccaaggtgcctgccatggccaccaccccagtgttgcaggtgcgtcagaactaccaccccaactgcgaggccgctgtcaacaaccacgtcaacctggagttgcatgcttcctacgtgtacctgtccatggccttctacttcgaccgggacaatgcggccctggagcactttagccgctacttcctgcgccagttgcacaagaagagggagcacgtccaggagctgatgaggctgcagaaccagcacagtggctgcatctgctttcacgacatcaggaagccagagcgtcaagactgggagagcaggctcgaggccatggagtgcgccttccacctggagaagagtgtcaaccagagcctcctggagctacaccagctggccatggagaaaggtgacccccagctatgcgacttcctggagagccacttcctgaaccagcaggtcaaggccatcaaaaagctgggtgactacctgagcaacctgtgcaagacgtgagccccagaagcaggcctggcagagtacctgtttgacaagctcaccctgggcggcagcgaggaagacacctgagccaagatgggccccacagccacggtgtgccttccctgggtcaggccaccaggcgggggcgtgcatgttgccctttcagaacgttctcttcaatttttttcctttcagtgttaccattattggcaataaagttatctgttctcaaagcaataaaggtgtccagttgatgcgtgcctacaacactctcaccttttaggaatcagggcacatccccatgcaggcttaaagtaggtatccagcagtctctccacccagtcctgtcccatctgcatgcagctcaggatctgtgggggtggaggggaaaggtattctatgggcccctggaaaacacattagtcttccccttataaactctgagggcatgtgggatagggtggggtgaggtggggtagggtggggtgagatgggtggggtggatggcgtcaggtggggtgtgcagtcttgggccatggtatatgtgggtgcatgtacatggtacagtgtaaaacaatggtatggaattcatcctagtggctgcctctggggaagaagtgaagggagtgggattgggcagggattaaaataaagggggtcttcaacttttcatgaacacttttttttaaaataagcaaatgataacttttcttgtttctagacagcaagatgggggctctggatgacagcaaggcagagtacctctttggcaagctcacccagagtgacagtgataatgggactgagccttaggttggcttccccacaaatatgggggtgatttcctgcatattgcccttacaaatcctctactcctgtttttattctttcaattgtgccatttcttccaataaactaatatggaaaaaatatacctcagtagaaggactgaaaaatataaggtcaaagttggaggtcaaatttgtgatatgaatagaaagtagattaaatacccccaactgttaagccagtgactggctgctttgaagaatgtagaggggttggggagagttgaaggtgcagaacaggtagagccattgtagctgatccagatgagagcctagtgtggcttgaactgtggtagtggctgaggaaatgaagatagattcactagttccagatggattttggacaaggtgacaagttttgctcatggacagaaggtgaggactgggagatggggacaataagttctggtgtttgatcttgagcacctgggttgatggtgctattcttaacctcaggacatttgcagtggggacacctagggtagagggctggggaatacatgtcatgtgaaatcttagatccttattaggtatccaaatggaaacgtgaatcaagtagatggaaaaatgaatgtcagctttggaaatatacgtaagggagacattatagatggtattgaagtcatgtgattggatgagctcaccagaaaaagtgtaagagagagtttgacaaatctatccccaagctcagggcagctaacatttagggtatagttgagatgtttgaacacccagagagtttctgttcccacctgaccattaccttattccagaccatggcccccagtgtccactcctagtgtattttcaaatcagcttgtcctgatgtaagtgtgacctctggtttctcctttctagatgtggagaagagttcttttgtcttgtcttatggctatggatagaatgaaattatttcctagtaagaaaaagattccttagagaaatggtagtgatgtaagcctacgtttttctcctctctcctttcacaactttgccatatcttttggcctattctctacctaaacagatgaaattagtatgtaaaccttagattatgcatgtttctgaaaaactactcaaaacattttgttccttcagtgctacatgtagattattatataaaagataaaaattacaggttttgtatacagtattcaaagttacatgtgtagctcgagtctttttaaagctaactggtttgaacagtagtaaaatatgaacaagtttagctatgcaatcattaccttatttcataactgtaacactttcttaaaaatgaggattatggtcatataagtttccagaaggtattcttgcccctttactcttctaacttggtcctctcactatttctttatctgcctgatttgaggatctctcccctctctgactttgtctcagatcatatatattttttctctcctagatatgaggaagaacaaagcgagcatctttttgtgagtgtttacatttttaaaaccatcaggtcactgcggattcttcttactttcatactttggagagagtttgctacagtggtttcttaacttcagattgcctgggttcaaatcccagcttagccattcgtgttgacttgcacaagtcattaaatttttttgtgcctcagtttcttcatatataaaatagagatcacaaaagcatcaacctcattgggttgctgagattaaataagttaatatatgtaaatcacttacagcagtgcctggcatggtgtaagtacattatgtggtagctatgagttatcaccataatcaccctcatcaccctccactcaattctaagatcctttgtattatttacgctttgggggaaagacttcacttgtatacattagcactgtatttctacccatcatgtcaccctgcatacagagatgggaaaacccttagaagctggtttggttgtcaggtgccaccagaactcaggagggtacatggctgtttttgctgtcccacacacaggctcaagactagagacaggttttgttgtgatagctttctgtgtaatcccccccaattctatctcaaccagctttcccttgaattcacccctagaacactgtgcttgttcttcccaaacccaggttgcctgagcctcctatttccacccttaacttcctcccactcctcagagatggacaagagcaacaggatgaaatcctaacccagatccccaccttcatctggatgtttggagctgaaaaggagaggaatggctaggcggcgcttgacaggagaatgagaaaaagggaacacattagagccactgataacataactaaaatcgatacatcatcatgagctttggcaaagaggctctcaagctttgctgcacattcaaatcacctgcagaggttttaaaaaatttcaatgcctagatcaaatacataagcttctgaggcaggacctaggcatcccagacattaaaaaccagtgttagcatcttactgctcaaagttggtctggaccaaagtatcagtctaaactgagagctcattagcaatgcaaaatctcaagctccaccccagagctacagtattagaatctgcattttaacaggctcccaggtgatgagtgtgcacactgaagtttgtgaagcactgctttagcatcctggttctctacctagctgtaccttgggataacctgggatactgaaaaataatactgatgcttgaacttaaacaacttactcgatcatgcccccatgcacatactgcaccaaacaccaaaaacttactgtaacttcaacaacgattattgaattgacaaatatccggaaagacttggaaactttttctcatttctgtttatgttccacacatatataacatgtgcacacttttaatcattgttttataaatcatttggcaacctatttgttttttcacaagcatgggttggaaacaatatggcctaaaagcatatggcctagaagccaaatatagcccaccatctgttcttgtaaataaagtttaattagaacagatgcatggccgttgatttacgtattgcctgttgctggattcatgctgcaaaggtagagttagtatgtaagactaagactgtatgtcctacaaagtctaaaatatttactatctagttcttaacaaaaaaatgtttaccaatcccattgtatagtaacttatcacaggccctgaatttacctaaagccaccaaatatttttaaatgtgcaattgtctttgtacctccaatatggtcattgcagtttggtgcgtaatttccctatcaaacacaatgtgtagcagaaatgaaagcaatatactgtattaatttaacctaagatgataatgatttaatatagcacctccatgtaagaggagtatagaagatacttttggttacttagccaacagccattttactccttcatccttattaaggcaatactgaattttttggggggttggtgagtaacaatgtgtcctattcctagtaataaattgaaattagtctacacaggttcctaaactttgtctggatctttaactggctgctatctcaacctgtaattcatagccaggattctagaatgggttacctgtacctgttgacttcccagaaataatgcatttctttaagtgttagaagaagtaatacatccgtaatgttcagaagtaaaatatataaaatgatatgtgatgaacttcctcatgtccctgactgcaggctctcaagtgtctttcataccagccccactgaaagattaccttccttaggagttttccatatatcctttctgtcttcccgttttgtgtgttactataacagaatccctgagactaatttatagagaggagatttatttagctgacagttctgcaggctgggaagttcaaggggcatggggctagtatctgctcagattctggtgggggcttttgtgctctgtcatgacacagcagagaaggtcaaagcggaagtaggcacatgtgaagagggaccagacctgaggaggaacctccctttataacaatccactctctcggaaactaatccatacctgtgagaactagtccagtctctccaaagcaagaattcactgactgcagcgagaaggacaccaagacattcatgtgccaccccagactcaaacacctcccactacagcccatctcccaacactgccacgctggtaatttaacttccaacatgagttttatttttttttcagtgaacataaaataattgtattaaatataacaaaacataacaaaagtatcacatacaatgttatagtaccatttaaatataacacagaaaaatactacaaagtaagaaatacaaaaacaaaaactaggtaagattttatttacaataatggtgtgcttgccttgttcataaattcattccagtctggaacacaggaagataatgctacccgcatagctggtgcaccattcagcccatttctttcctttgtttttaacagggttaagatagaaaaccctagttcacacaaactagatgtgaatggtagtaatagcaggacactctttctacttaacaatggaaagtcttcctttaccttaatcaaaatgctgataaacttaaggtctcataatcattcttcaatgtatatgaagaactaagctgcaataattcattctcttcttcaggcaccaagtttagctcaattattgattcagagtttcaaaaagcaaatggatcttttacccaactgttttcccttaatgtttcaaatttttcttctggaaagaaatggttaaaagtttgagatagagaagtgagatgcaacaatatctctaattttatttctttcaaaatgttttcattaatattctcttcaatatgttgcaaaaatcttggaaatatgtagtagctaggatgattacttttaaatcttgcttgccataacaataatgtcttttgaaatccctggatacattcaacaccaacatgagttttagcaagaagaaaccacatccataccatagcacttacaaacttttgttttatggagaagtatgcatgccatggatatataccaaatagtaacataattcacagtatcctgcagcttacgtttctctccttaatgatataaaagaatgaggttttagcagtcaatttacatactggtcactagtgacattctgggacttgggatttctccttttgctcattacatcaggacaggtaccaatcctcccacttctttggttctgttaccagtgtagggtcttgacgagtcatccaggttcttgatgtgttgagcaaagaattggacaaaacacacaaacaaagcaacaaaagaacgaagcaacgaaagcatagatttattgaagcaaaagtacgctccacacagcaggagctgaagaaacaggcggctaaagagccccagttgcaaaatcttctggggtttaagtaccctttagaggtttcctattggttacaccctgtgtaaatgaacacctgacctgtgagcagtcagaggctgaagtgaagttataccctatgcaaatgaagacttgtcctgcaaccaattgaaggctgaagtggagttacaccctatgcaaatgaagacttggcctgtgaccaatcacaggctgaagtgaaagctccctatctccagaccctattctcctgcttcagttctattcaagtgtcctgaatccaaaccataaccatttgcaaataattccatctaaattactagaatttcctttatgtaacctgtgtgccaccttacaaaatatagtgcccataattaattgaaacagcatgccaccaacctttggtcttcatcccccagccatatcatcttcaactggtagtaaattgaattgatgcttatcatgcccagcataatattgtttcccagtaacttgtccatcttctactgacagttttcaagataataccttactttttgacaaaagaatacaaaacgtatcttttaagatactttttaaagagctagagtctccctatgtttcccaggtttgtctctaactcctgggctcaagggaccctcacacctcagcctctgaagtagctgagggtacaggtttgtgctaccacacctccacattatgtatcagtttaaaaatgatctgtttctactttttcatagcttagatatacatgttactaccttagagacaaagaaattgacccaaagatgttcagtgacttgcaagtccagccattttccctagagtatcacttttgataaggagtcttaaaaagttggactacacttgcttggattttccaacttgggggtatttctgccttctactctcaacaaggcagcttttggagttaggattggtttttagtcccccgtctcctaaggtccttcctcccctttaatgtcattctctttcaaggatagggagaagctgtaggagagctgtatataaatgctgctaggccctcctcatcaatacatactcaatgggaaaatcatccacttcccaacttttttatgtaggttctgacctgattgatcagattgcaaaacatgccccactctactgtctttgcaattatgaaagccttgaggtcaggccttgagtcactcaaattgtgttcgtaaatggcagtgagaacattcaaaacagaaaaagcacacattttataaaagggaaacaaatattctttgtaagaatcttgcacccagtgcattttgttctagcactcagctcacaggatgaaacgtctacctcttggggctcttccctctgaaatggttgtcggacctctctggcagctccagattgtgtttatcacttctttaattttatcttaggctaaaaccatagagttcctttaatgactcttttcttcattcactcttttacatcatgcttaagattgctataaaagtatgattcaattatgatagtaattcttgtttaggcacatacatttgtgccacattattgccagccactaatgttaaatccttctaaagcactgctctaccaagttttgaaatcatttgcttattctaagtatctttttgctgatttcaaaagaaaaagaactgtataaatagcttacagaaacataatttgaaattacttgtttgaatgataattattagagctgatttcacatgaattttcttctgaccctctggcctaaaggacatatcagtctcttttccaaataaatctgtcattgtgtttttattcagatcattgttaccttaattgaaagtatttaatctgtaaaatcaggcagcttgcttttgactacacattgaaaatgatggaagattgaattttaggaaaatagccaaactggttctgaattacttatacatcaaggcagattgcttgttggtttgctctggtgccagatgtcttggattgaaatcccagctccgatgttcagatgttaaatgaccttgactttatcattatgtaacctctctgagcctccctttcctcatctgcaaagtgaggatgataacagagcctacagtattttatgtgttaaagattaagttactacctgtaaaattaaaatctggtttactaattcagtttttgcctaagctttgtttttatccattcaaaataaatgcccaattatttctctgtaattttttccaaaggggaaagaattagactaaaaattttttatttcccagaatgccaaaaaacagagaaattgaattatgcaagcaagcgtgcaaaaaacattcatgtagattaatctttgggtattccaaagtaatgtagacaatataaaagagctacattttattgtgtttttctaaggttagcatcatgtaattatttaaatcacatatatttattggtatttttggataaattgaaatagagtaaaaggaagtggtgacctgagagactgggaagagagagattaaagtctcacctgcagataaaggaaaatttactatagatcagatacttgataagtttactttattctacttggtgcggtttgattccaaatttgtaaaagagtctgttattttttaggagtgcaactgtgattggcaagtgtacaggagaaagagatgtaaagcaattttttaaatgatgtaaaccaaaatgttagtactgcttacatcttatgatggaactacaagtgattcgttttcatttttgctgtttttgttttgttttgttttgttttgttttgttttgttttgttgagacagagttttgctcttgttgcccaggctggaatgcaatgacgcaatctcggctcacccgcaacctccgcctcccagtttcaagcagttctcctgcctcagcctcctgagtagctgggactacaggcatgcgccaccacgcccggctaattttgtatttttagtacagacagggtttctccatgttggtcaggccggtctcgaactctccacctcaggtgatcgcctgcctcagcctcccaaagtgctgggattacaggcatgagccaccgcacccagccccatttttgctgtttttacaggagtgaaattttatataattcacttttttcaatcctaaaagtgatagttatataaaaagttaatgatgtgtaattttaggagcaaatttattgtgtaaaaagtcttcatacatctatatttaatagtttttacctgtgaatatatatccatattagtgaagccaatgagtactttgacaatttcagcttttcgatattatcctgagatgaatgctgtatctagactctactttttcttctttgggcttttttaaatatcgaatcttgcatattttcatctggatttttaggtgaaattcattgtgaacctgtacagcctttagtaaatcatacaatgtttcttataacatgtccagttcctcttagaattatagaatgttggagtaataatgtaccttagagacctcattcaggagtcatttttatgaccacagggttctttaaaaagctatataactaagtgaagtaaaatatattactataaaacaagcagctttagtggccatagtattagtttggaccaaatttggtgttttatctaaattccatgccctcatgggacatctgagttcagaattccaggtgtaatccaactccctctatttgtccatttgtttagtgagctaactcctctccccagctcttctttttccaatttgcattccaagggctccctcccttgatgccagataattaaataatatgaaatggcagacatttcgaatcttatcagtgacccataatacctgcaaataaacatgattgtaagaaaagcactttgataaatgcagtgaatagcattgcaattgagggtgatctttgtatcaaagtaagggataggtaatcagtcattttgaagcagagatttgattataatatataaaattaattataatcactaatatgtattgagtatttatatgccagggacttaattagacatgttataaatgttatctcacttaatgcacaggcagcctgtaaggtaggtttgtattataccattttacaagtgaggaaactgaggcctaaaggagtaacttgaccaggtttcataactagtaattgggtcaagtttcctttttatcttttaaatacttctcctacatacgttaaagtcttgaactactggactacttttcatttgggattaaggtccaggtttagaagtaacctaatgtagcttcttcaccagcctgaggtctctcctaggaacaatatataattttgaccttcagtcaacatctgtgtactaaactttggggttggagagggagctgaggaggaatgtctggtggcaaggaaccccaaacagaaccattagaaaacaaggtgtttctggagtgtttgagtactgaaagactacaactgcctaaacttgtacatactattaatgatgatagggatcatgtgatgagaatcttgtagttggatatggagagtgatgatatttaacatattttaacagtaaattatttggtatagttagtaaaggggaaaaccctcattacttatttttccctctaaagtatcatagctgaaaatataaataactccaagtctttaaaaacactcttggattctgactgaccattttagggaggatccagaaggagcacagttatgtatttgtaatttcttgtcacatggaaaatatagacttgtaggtcctttgattcagcaaatttggttttgggtttttgttcattatgttcattgaacccagacatttattcatctggtattttccatcttttattcatactgattttctatttattttgtattgtattttcagaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctgggatatgtagttgggcgctcagattccgtctctactcgcctgtccaattgtgatcccccgccaacctatgaggaagccactggccaagtgaacctgcagaggagtgaaacagaacctcatttagacccacccccagagtatgaggacatagtcaactccaactcagccagtgccattcctatggtgcctgtggtcaccaccatcaaatgaagctgcaaacttctttttactctaatcatttttaaaatactaatggaagaactttctagcactttaccactacataaatgttcattgacttattttattggactcttaccgcataccacttcacacttgttttattttctttagttttgtttcttgttatagaatcattatccatgctcatttttgctaggggaaatatatgaagagggaaaacatactaatgggggtctttctgtgatgtgatgagacatacatgtaagtgtatatatgtgtgtataggcatatatacgtgtgtatgcatcaacacagtatatgtaaaactgtcttaaaaatccattaacttctacctaaatcacctggaaggagagcattactcaccaaaattgcaaaacaagggtatcaagaatttgtgtaatagccagtgacatgctgtagatttttgcaaactggatgtacttagcatgttttctaattctgactggcttttgttaacttgataattcttcatctaccttaaaaagaaaaaaattacacatagtcattcttgatgttataaatagagaaaaagtgtgtgtgagcaataatgcataagctactgataacttgcttacagcagatagcaataaggtatttggtggcattcggcttgttttgtaatagggattttttttttggttgaccactcccccacacttccaaaattaaacagtgttttcttagcatcttgaatatctcctgcggtgtatattaacatcttgatgagacagatttccaggcaacaaaataatttctaaaatggatatatgtgtggattaatgacaggcagtaaatacccattactcctttactcatagctggtaaaattattcccactgttttattgccttttactgtacgttctacactctgtcctactcccacagaattttcaagcccttaagagtttagttaaaataaaatttttgaaattattgtcttaatatttttatataggctgatgtctttgcctcaagattgttaggaggtaattttccattgaattatcaactgtgatttttatattgccctccaagtggtagaagaagattgcaaagtccatgttatgctaggtgcacaataaatctagtaatagccccacacagatctcatcattgttgctacttccttttgtattttcatcaggtatttttttaactgtagggtttttacttttttcttggagcagagagaacaggctgtaaatgggttgccaacataagctggctgagaaataaaagaaaacaagacagttgttcataaagtttcattttgtatgcactgatggcaaattcattaggtcagttaagggaaatatttgtaccacttccaaacttttcagcgttggataaaatgattgatgaggcaggcagaaggaatgtaggtttcaggtgtgtcatttcctgctgcttccagctccatccctacagactcctccccgagtcctgccctggaaccaaaggaaggaggaacactgaggggaatcctgaagtaggagtcagatgacctgaactcagatctccctctatcacatgcttgccaccactgtaccttgagcaagaatcatatctgaccctcaacctcctcaactctaaaatggggataacatcatttgtcctgcacttctctaagggctttacaaggatcaaataagatggtgtgtatgtaagaaatttgtaaaatgtgaagagctatctacactaagttcgtaatgttattattattgtgcttcatggagaattttcccctctgttttcctaaattgtatgagagctttcacacagtgagaaatagagcaggctgccccataaatgggtaacatattcctaatctgagtgtgtgggctgttagagaacccctgccatgctctggtctgttctgaaactgtgccaactgaaagatgatagtccacacagcacaaacaggtttaagcaaatgatagaaagggaagtaaggcgtgtgtgctagttaataggtttagtagcttttatggactaaaaatgattgattgtatcttgaccctggtctcagaaatgacatttttacttttgccatgagtacacatcagatatctttggcttctatttaaagctaaaggtagaagtgtttgatccagtgaactgtgtatgtatgtgtggggtttttttctttatttttaaatgaaaattaagacaccttttgtgtggacatgtttttgtctttaatgtcaggctttagattagaccagcagttttcaaagtatggccaatggacccctgggttccttgagagcctttcaggggggactatgagatcaaaatatttttattataatgtgaagacattgtcttttcactctatctcaaaaaaagtgttgcaaatgtaaaacattgccatcttctcacaaatctctttttttgtttttgaaaatatggccatttttcataaaatgttatttgtgttagcatgtaatgggtttactatgtttaaataagttaatactttaaaaattttcaggtttttttagtatggtgaatattgatagatataaacctcatgaacaaaagtactttggcatccagattctcaataaatgttaagagcgtaagtgtaagggggtccagagaccaaaagttttagagctacaggattagacataggagcaggatattctgttagtgtgatttcttgcaactttattttacattttaaactgctgatattggatataatgctgctttttagagacacctaaattgcagtatcagaatgaatgttgatgtttgaagccaaaaagccaaatgcttaaactgatcaatgactgtagctttttagactgttggtcaaagaacattctacttcacagtaatagctctatcagccacagatctcatggtggctgttgcatgataatgataggataaacaaaataccactgtcttcaagaaacattatcttaggtttgtttgtttggtttgagtttgatttggcttttatattttttaaaatcccttttgctaccccatctggttttataaactgagtttcttagcattcgttaaaattaaggggtttgtttggaataatatatattttttatgcttttgtctttcttacctgattgatattacattcacctttgattgttttttaaaagtttatttttacagaatatatttagtacctttcttaaggagtaactgaattgaatcaaccagtttgcatttaaataaaagaacaggctcagtggtcttcctgtagaatggtttacatgcctgcatgtgcagtagttgtgtctggaatcctagaattggcactttctgcctccttgctctaaatgtcacaaaaaattatacttccttaaagtaaatgtaatgatttcttcttttcctattgaccagtacagatagatatgttgtgtttgcttcatttttaatgatgacttcaagattgatgatgtgatccaataactgtggaggtagctttaacttggttctgtgtaaatagtatgtattttattataatatttctcattttaagatgcttggtttacattaaattatggtatttaactatttttatgtttatactaggtagggtctttcttatgtttctgtgtttttggtatgctaaataaagctatttttaaacccaagaga

SEQ ID NO: 1444 - DNA, 108021 bp, Homo sapiens; identical to SEQ ID NO: 1443

SEQ ID NO: 1445 - DNA, 92950 bp, Homo sapiens
tctttccacctcccttccagtccgctcccggttcctggctccagctaggctcggcagaaataggagcgcgcaggcgcgacgtgcggctcgcagaacggcgagtagcggagcgggacccgctgtgagtgtggcggccgcgctgggttcctagctggggaaacgtgatccaggcgaagcgccccaggaaggattggggtgtgtgggggtgacttcggttctgcgaggagaaacccgtcagatatgcggtagcgttggtagcgacgctgcctgtgggtgtccggccagggccgcgtggggagcggagtgcgtggtagcgggagtgggtgagggtgggtatgacgagaaaaaaaattgaaggaatggggtttacaggctggaagtccgcacacagactgggcaggaccgcgaggcttgccaacggtgctggagggtgtcccagcttcaagttcagtcccctgcttggtgcccatgagggacgtcccaagctcatcccttcctccagcgctgctttctctggtgcagagttgctagaaacattccccgtcggaggggaaaggatttggaggcggtgggctgtcggcccgggctagtcccaaggagggcgtggcgttcgtgtgactttcctttacccacccccgggaatgtgtccctcttctgatccattgtgcccgtggacattttaacaaaggctatgactgttttgtaggcagtggcgggtgacagtgggagggggtgcgtgcgaggtcggtcgcggtgcggccctgggggatgggagagcggggggagggggaggcggcgtggggggaagtgaaaggaagagaaacagtcttcctgcttcaggtttttccttcttcctggtccgctgaatttgatcactggtaggaacagccccaagagggatatgactggaaagtagtgtgtgcgcgtttggactctggctccagccactggtttttgtgattgtgctgtgcaagtattttctacgagtccctttaggagaaaagcgaaactaatgggatttgagaggaaataattgaatgaaaggatgaagaggttgagtgacaaaacttagagcttaattatttgtctgttgatggtcatactataaagccagactttgaaggatgcgaaggtgttcaagccagggtaagtgaaaagttggttaggctactgttgattgtttcaatcaagagtggattattgggcatgtgtgtggatgtgctgtcaagatcttgggccgactcactttagaacctttgaaaataatattaaggatacaaaacattagggcaaatattgtaatattggataaagctccatatgctttcattttcaaacttagggacttttatgaaagatagtatatgtgttcccaagcatagatgttgatatttttactcatttgttttaagttaatacaacaaaataaactgaacttcctcctctccacccctttccctcgattgtaaatcccgttttataaacgtttactttctgatctgaagtatacttaaaaacacaattaccccgcccaacccccacccctgcaccaaccccaggcatgaggtgaacaggatttcttctggttttattgttatgttattctttctttttctattttcccaaatttggggcaggtggagggcggggagtgttagggatgccttttctcttttctagtgcctgatgaactcctattcatctttctagacttagcctgattcacttcttgaaaaattttgccatcttctccagagtgaattaatcacacccttttctgttaaatttatataacttgccttatttctccattactactagaacctcagtcttttgtgttacccttgtacctagagctgcctggcatgtgataagcacctaataaactaacttacagatatatattaataaatgctgttagaaagatggtaattcataggccgggtgcagtggcttactcctgtaatcccagcactttgggagtctgaggcaggtggatcacaaggccaggagatccagaccatcctggctaacatggtgaaaccccgtctctactaaaaatacaaaaaaattagccgggcgtggtggtgggcgcctgtagtcccagctactagggagactgaggcaggagaatggcatgaacccgggaggcggagcttgccttgagctgagatcgcgccactgcactccagcctgggctacagagcgagactccgtctcaaaaaaaaaaaaaagaaagaaagaaagaaaaaaaagatagtaattcatattgcataaagttcatgggataatacaagaaattcagaattctgaaattgtatttaatatttgagcagcattatttggaatatggataagtactgtgtggaaatatgttctcatgtattagtcatagtttatccctctaaaaagaggtgcaaaaactctacagataaagggaaaatagggatcagaaaaaggtgaagtttttaaaaaggccagtttctgatactgaaactagtgaaattaactatttgtagaaagacacaaataggttgctgctggaatttaggaagtactacaaatgaatcaggttgccagatggtattctctgaagggtgatgtaactaaagaaagctgtaatctaaccagttgtattatacttcttttacatcttaaagtattttcggcctttggctaatgggtctcttcatgttacagttccctgataggcttggtctaaccatttctgccaaactgtctttgacatctctcttaactccaccaggatcactggccttccagttacctctggctcctaacaggaattatcttccccctgttcctcacctccagccttcttctcctgaatggatatatgtatttgagaaaataccatgaacaaatgatcacttactttataaaagaatggaattggttctttagtttaaaaataagtcagaattggctacctgcttagtctagccttctgtgcctgcaaagcagacagagaactatgagcattagtaacccttatttttcatttctcccttattcatctaaatgcaaaagcactttttttcatttcacttttaaaaatagcattagtcattgttcctaaaacacttcaagttagtctctttttttgactaaaactcaaaactcagggaggaagagtagtagcatccataaaacttttttaaagttctacatcatctgtggacctactgactgaaaaaatattccaaaccaaccattgtgattataccttccttcttaaaactttcctcttagacttccttctcatatttctgattttttttctctaattctttgaccggttaacctcagtcacctccacagtcttctcagggttctgttcaaaactctttttctcactgtatgcacaagagtcaagggcatggaaactggagaaatcgaaaattggaggcaagacaagaagttaaacttttctttccgagcattagtttcctcacttgtaaaaatgataattataatacttacctgataattaagatcaggtatatagtgatgtgacgcataatgacattttggtcaactatggacaacatgtgtgatggtggttcccataagattataatggagctgaaaaacctggtgactttgtagcctttgtaatgtcacagtgcaatgcattacagtatataacacttgataataaataactatgctaatggtttatttactatactatactttttaattattattttagagtatacttctacttatatattttttaaaattaactgtaaaacagcctcagacaggtccttcaggaaggcaagaagaaggcattgttatcataggggatgatatctccacccatgttattgcccctgaaaaccttccagtggaacaagatgtgaaagtggaagagtgatattgatgatcctgaccctgtgtaggtctaggctaatgtgtatgtttgtgtcttagtttttaataaaaatgtttaaaaagttaaacaaattaaatagataaaaacttatggaataaggatataaagaaagaaaatgtttttgtacaactgtccagtgtatgttttaagctcagtattattacaaaagagtcaaaaagtttaaaatattaaaaagtttatgtagtaaagaagttatagtaagctaaggttaatttattattgaagaaagaattacattttttatatatttggtgtagcctaagtggagactatttataaagactacagtagtgtacagtaaatgtcatagggcttcatatccacttaccactcactcactgacttacccagagcagctttcagtcctgcaggctctattcatggtaagtgccctatacagatgtaccattttttatcttttatacctatttttactgtacattttctgtgtttagatacacagacatcattgtgttacaattgcctgttcagtacagtaacatgctgtacaggattgtagcctaggaataatagggtataccatattgcttaggtgtgtagtaagctataccatccaggtatgtgtgagtacattctatgatgttgacacaacaacgaaatcgcctaaaggcatttctcagaccatatcccagttgttaagtgatgcatgactgttaacagcttataatgtctagcacatagtagtgcttttaaaatgttagctgttgttatttatgtctgctgtttcttgtgagctcccattatttcaatagcaattaacttcagaatgtggatgtattgatatttcccaccctgtttgagctccagttctgtatttgtagataactcccatgtatttccaacaggttgcttagcacagtggttctgaaacttcagcatgtacaataatcacaagatgcatagatttctggaccccatacccaaagtttgtgatgtctaggatagagtctaagaatttccatttctaataagttcataaatgatggtgattctgctgtccctgggaaaacattgagtggcatttaactgtatggcattcagacaggttggtggagaggaagggagaggagaacaaaagaccaaaaatttatgaaaattaagaacagagtgcactttaagctggtagtgctttttttatttttatttttatttttttattttttttttttattgggacagagtctcactctgtcgcccaggctggagtgcagtggcatgatctcggctcactgcaagctctgcctcctgggttcacgccattctcctgcctcagcctcccaagtagctgggactacaggcgactaccaccatgcctggctaatttttttgtatttttagtagagacgggttttcaccgtgttagccaggatggtctcgatctcctgaccttgtgatccgcctgcctcggcctcccaaagtgctgggattacaggcgtgagccaccacgcccggccggtagtgcttttaagactgtttagagtgtcctctaaaatgtagagaggataggactgacagaagatgcttggatttgatgaccacaaggttttcttttgtttgtttttggtgtgtttcaggtgcagattgttggtttaattatacttctcagttggtattatattatcattattgtgaccaggagaacatatcacaggtatttgaggtaatggcttttttgtttgtttgtttgttttttgagacagggcctttctgatgcccagactagagtgtagtggcgcaaacacggctcactgaagcctcaacctcctgggctcaagcaatcctcccacctcagcttcctgagtagctgggaccacaagtatgtgccactatgcccagctaatttttaaattaaaaatttttttttgagatgaggtctcactatattgcccaggctggtctcaaactcctgggctgaagtgatcctaccacctcagcctcccaaagtggtgagattacagacgtgagccaccatgctcagacatagaggtaatggttcttaatctggtgtgtgcatcagactgtcatagggagctgtttcaaacaatacacttaagtttagtgcccctccccacaatattgactcataaaatctggatttcagggtgtgggatctaggcatgaaaaaattccctggttaagaaccatctcttcagcaatgttgggcagaatatggaagaactgaaaatagttttattggtaaattgctggtgaaaggagaatagaagaaaaagactggagtttgaagatttttggagttcaagaaaatgggaatatgtaaaggtgaaaagcctgctggagtcaaggagcgattgaatgtgtaatgttatgaacatataattgatggaatacagtactggagcaggagagcaggagagaatggaattagtaggtaccataaaaagagaggagaaaggagtgaaaaaagtaagtttaaagatggaagtgggagaagctgaaagaactctctttaagggaggtttgtttgcacactactgttcttcagtggaacttaagtagtcttgaactcttaagtggaatggattttttcaagtttaataatgctagcaaataaatcaataatttcagctattccagctaccactaatggctacaagtgtatttttcttcaacttagtttgaataattattttttgaaattaagtctagacatgctgtgttgtaatgttattgccctagcccttgccgtaagactgctatatcataagtttcatatgattttcattcagttattcaacaaatatttgtatgactgtcaatggccaggcatccttctaaacactgaggatacaacagtatataaaacagttatattttattagaaatttccgcctttgaggcgcttgcatcgtatttgagggaggcagataataaagtaaatgagtaaaatataagaaatatatatataattttctatacatatacacataaatatacatatatgttaagtgacatggtgctgcattctttggagaaatacaaagcagggaaggtgaatggggggacctacaggtattcatctataggtgaatagggcatgttggagggaggtaatcagggaagacttcactgtcagcaaagacttgtagaagataagaaaaccatttatttggaggaagagcttcctaagcacagggaacagcagttgtaaaagtcttgaggtgggttctttttgagacctttcagctaaatatagcaaaatggtttttgcggctggagtagcatgaatgagaaggggtgaataataaggcatagagtcagataagcaagaaggattgtgggagtggtgggaagattgcaagaggagaaatttttgaatggggagatcaagaactacatactggccatgttgagttagagatgattatttgatactccaggtagaattcatgggataggtatgggtaaacaggaaactctaggaatggatcacaacattataagggaagagaaggggtcattgttttgctttgtttttaaattaaaaaactttagttttttagagcagtgttaggttcatggaaaaattacaaggaaagtacagagagttctcatataccccctcttcacatacacaacctcctgcactatcaggacatcctgtaccacagtggtacatttgttgctgttcatgaacctccattgacatatcattatcacctaaagctaattgtttatattaggactcactcttggtattgtacatcttatggatttggatgaatgtataataacatatctactattgtattaatattatgatatgatatagtttcactaccccaaaaattctctgtgttctgccttttcaactgcccttccttccagcccctggaacccactgatccttctactgtctccatagtttttcctttttcaaaatgtcatatagttggaattataaagtatgcggctttttcatattggtttctttcacctagtaacgttcatgtaagcttcctccatgttttttcatggtttaatagcttatttctttttagtgcttaatactccattggatgtaccacagtttattcattcacctactaaaaaatatcttggttgcttccaagttgtcgtaattataaataaagctattataaatatctgtgtgcagtattttatgtggacatagattttcaattcatttgaatacaaaggagctcaattgctggatgagaatatagtagtccccctccccatccatggtttcactttccacatttccagttacccaaggtcaactatggtctgaaaatattaaatggaaaattccagaaataaatgtcgtaagttttaaattttgtgccattttgacatgatgaaatctcgcaacatcctaccacattctgcccaagacatgaatcatccctttgtccagagtatccatgctgtatatgcctttcgcccattagtcacttagtagccatctaggttgtcagatcaaaaaaccatagcatgtataggagttggtactatccaagatttcaggcaccctttggggtcttggaatgtattctccatggatcaaggaggactactttatgtttagttttgcaagaaattgacaaagtgtcttccaaagtaacttaccgcttttattcccaccagcagtggatgagtttctgttgctccacatccttgccagcatttggtgttgtcagtgttctgtattctggccattttaatagatgtgtagtgccagctcactgttgttttaacttgcaattctctaatgacatatgatgttgggctttccatatgtttatttgtcatctgtatccatctgtatatcttctttggtgaggtgtccacatatttagtccattttcaaatcatgtttttttttttctcattgctgagttttaagagttgtttgtatattttggataatagtactttatatgttatgtcttctgcaaatattttctcacagtctgtggcttgacttctcatattcttgacagtgtattttgctgagtaggagtttataatattaaatccagcttatcagtcctttcatgaatcatacctttggtgttataactaaaactcattaccatattagaggtcatgtagattttttcctatgttctaggagttttatagttttgtattttacatttaggtatatgatccattttgagatttttatgaagggtgtaaggccatatctagattcatttttttttcatgtggatgtccagttgttccagcatcatttgttgaaaagtctatcttcattgttttgcctttgctcctttgtcaaagatcagttgacgatatggatatacctctctattctgttacatttacctgtttgtccattcttttgccactgtctttattactgtagtttaatagtaattcttgaaattaggtagtgtcagtccaccaactttggtgttctacaatattgtcttggctattctgtatctgctgcctctccatataaactttagaatcagttgttttttaaaaaaaaaaattcacaatatcacttgctgggattttgattggggttgcactgaattcgtagatcaagttggaaagaactgatatcttgagactatcgagtcttcctattcgtgaacatgggatatctttccatttatttagtcttgatttttttcaccagagttttgtggttttcccaatggagatcttgctcatcgctgatatataggaaaagaattgacttttatttattaaccttgtatcctgtaaccttactattatcacttattagttccaggagattttatttaaaacaatcaattctttggaatttttctacatagacaatcatgtcatgtgtgaacaaaaacagttttatttcttccttcccaattggtataccttttgtttcctttccttgtcttatcacataagatgggattttcagtatgattttgaaaaggagtggtgagaggggacatccttgccttttttctgagcttagagggaatgcttcaagtcttgcaccattaagtatgatgtcaactgtagtgtttttatagatgcctttttccatttgagtgagttcccatctattcctagtttgctgagagtttttttttttttaaatcatgaatcagtgttggattttgttaagtgctttttctgaatatatggatatcattgtgtaaattttcccttttggcctgttgatgttctggagtacattaattggttttcgaatattgaaccagccttgcatacttgtcatacatctcacttgatcatagcgtataatttttttatatatggttggtggatacaattgataatattttgttgaggatttttcaatctgtgtttatggtagatattggtctgtagttttcttttctagtaatgtctttgtctggttttggttttagggtaattctgacctcatagtattgccttggcttctaacttcaggagaaattgtagagaactggtatagtttattccttaagtgttcggtagaattcagcggtaaacccatctgggtgtggtgctttctgttttgcaggttattattgtttcaatttctttagtatagtcctattcacattgtctatttcttgtgtgaattttggcagattgtatctttcaaggaattggtccatttcaaggaattggtccatttcaaggaattggtccatttcatctagcttatcaaatttgtggggataaaattgttcataatattcctttattatccttttaatgtccatgggatctgtagtgatgtcctttctttcatttctgataataatttgtgtcccctctcttcttttcttaattaccctggcaagtttattgaattcattgatcttttcaaaaaaccagcctttggtttcatttatttttccctattgattttctgttttcagtttcactgatttctgcttcaattgtattatttcttttctcctatttacttcaggtttaatttgctcttctttttctaatttcctaggatggaaacttagatgattgatttcagatctttctttttttctaatgtatgcattcaagctataaatttccctctaagcactacttttgctgcatcccacaaattgtgacaagttgtattttaattttcacttagttcaaaatatgtttttaatttctcttgggatttttttcttcaataatccatgtgttatttaaaggtatgtagtttaatctctacatatatgggggaattccagctatccttctgtaattgttttctagtttaattccactgtagtctgagagctgacattgcataatttctattcttttacatttgttaagatatgttttatgtcccagaatatgatctgtcttggtgcatattccacatgagcttgagaaaaatgtgtaattttctgttgttggacgaagtagtttatatatgtcagtaatacccagttaattgatggtactatcaaagctgttgagttcagccatttccttactgattgtcttcaaataacactataccccttcatgggtacaacctctttgtattgcaacacctttcctacaatggcaaagtgatttggttatcctgaaaacctgagggaccatagaaataatgttgccattgcaagttgctttttgaatctcctaaggaaataactgtatgtcaaaccttagttcagcatttactgaacacctttggtatgtaaggggtgtgtgtgctagctttaccttttgtaaattagcgacataattacttctcaagatgtcattgggcataatgaaatgagaatcaaagtgccacagggctggggtaatcatagctcttaaaaatgctcaaggccgggtgcggtggctcacgcctgtaatcccagcactttgggaggccaaggccggcagatcacgaggtcaggagatcaagaccatcctggctaacatggtgaaactgcatctctactaaaaatacagaaaattagccgggcatggtggtggtagcctgtagtcccagctactcaggaggctgaggcaagagaatggcgtgaacccgggaggcagagcttgcagtgagccgagatggtgccactgcactccagcctgggcgacagagcgagactcagtcaaaaaaaaaaaaaaagctgaataattgctattctttctccattattgtggggtaataattggtatagttattttcaacctcattcaaataccgatgatgagtttttgatagcacttgttatcttcttgaaaggcttgcaaattaaatgcactagaattaaaataacaatttcacaatttgaacttttaggtacattttttcagtgcctcagaattcgtaacctattatttctttgggagaacatgttatattttaatctttgagttggagtaagttgtctgtggtctatttcttcccttctttcaaaactgtgtctgagatgtgtgttgttttctggagtcctagttaacaaaacacctcctttttcagtgacaaagccttgttactgaaagcactttatgttctgtgaatctcctccaatctgtccccagtgtgcttgttctttgtggtttggtttctaatattatgcattccaattttgtaaaaaaatctatatgagtaacttgccacagtaatcctctctgacatgtttgcttcagggaaaaagcaggaaaagtcagaaacgtaagcctaggtttaaaatttgctgtcgctgcaaaaaagtgaatagaatatattccaagtttctttttctgtattagtattacctatgggaccagaataattattttggcaaggatatagttaatttcctgtgtaattttatcctgcttcagtatcttagtcatttttcctttgatttctcaaaaaaattatagaagtaaaaaaagaaatttagttatttaggtttataaacagtctaaaaatacaaatatttttgttgcattaaatatgaactatagtataaaataaatacatgtgctctttgaattttaaacttcctttaacttataatgcaaatagtagatattaatatgtacttttttatatatttcattctctaaactatgaatgttaacacggtttatatacttgacctttgcaaagttttgaacagtccactcctactgctgttgttctagcattatttccttcctaatatggtagtcatttttttttttttaacttttctccccagtcatttctggcctgtccttaacccaagtctgcccatccacagatattgaaagcttccaaccttcaggaactacccttcacattactcctagaaagccccatctagccctacagatcaaactgttcactttcaaaggttgtttgtgcctaacctttcttctgttttttctgtttgcattcctcatttgcatttcagttcttcaccttttaactgaggctagttttctgccagaatctcagccccatttaaccaggggtcagaccatcatattgtctttgtctacttggtttctggttggttcccactaccaggaaccaggatgctgaatatccctagaatccttaccgttggagtgggtggactctagtctacttcaactggggctgtcaagaggaaaaaggtgtcagagtcctcagcagactgggagggggcctggagcaaatcctgtgttaaaatgggattttgttttttcctctgcgacccaaacccactcttgacagttctcttcttcacatgagagtatagtgattgttcgttattcagaagattgcccaaattattttttcctctcatctgttgagcaattcctggccatatggattatcttccttagtaataatacgaatgacaacaataataataaccattctatgttgcactagatattttatttttatcatttttattaccctgtaagatatatggcttttatctccattttctagtaagtacattgcagttcaaagagtttaagtgcccaagctcactttggaggtatacagtagaactgaaatatcaaatcaggtttctctgacattacagcatggagctttttttttaggagacccgttgcatgaagcatagttttgggctgtctcttctcattctcagtttcatacagtaagactttgtgtttacgaagataaaatatatattgaggatttactatgcatgcatttcatgcatctagcattatgatctaacatggattagtgcttgatgaatattaactaaaggaatgagaggagactctaaatttgttagaaagggtaatctccctgtgcttaacacagtggcaggcatatggttggtgctaaaaaatatttgttgaattgatgagatcacctactcaggtattgttgaattaatgatattatccactatatctttccattaaaagagatgactgtgaatttaaatagctgagccattgatccagttgtctagtaaaggaaaagatcagtttaaatggatgttttttcctttggatgcctgaaagtgtacttggtatcatataatgaattctgcttccaaaagaaggctgtcacttacttgtttcatcttacttgacctttcactcattcaccccccaaaacttcttccttgacttttgcctcttccctggataatgccattaattcccacaacttccacctcattcttcacactgaaaattctcacatctgtacccagtcaaaatttttccctgaagatccagaggcatatacatgactgcctaccttaaagtaaactgtctaaaacagaacttctccccctacctaacaccccacctatatgtctgctttttctccttttttttctcattttgttaaatagtgaaggaggccctgtatttgggataaagacttctggatcctgggtataaacaggaatgtgaccacatgggattccctttgccactcctttggagaaatcacagtcctggtgctagagttaggacccctatattaaggagctaatggtagtctatatcaccccctccaaaaaagtttctgcttttttttgcttttctgttaaccatctactcctccttgctgatacaagcagggatgataagaaagtgagccctctttctcattacctccttttctcaagcatatgtgagagaatgcaatctgattatcatttataggctctcatcccaaacttattttaaatgcaaatcttgagattaaaaccattttatcttttatctaacattggattgactgcaataatcatgtgatttcatagattactttgagagtttatactgcactctaggtttagatatcccagtgtctatctgtagcccataattagtgaagacaataatattctcttgaatttttattgtggtttcatgtccacagaacactctcaaggcttgtgtggattttttccccattctccatttctttcttagctggataataggccacaaattgttttatggattccttttcgtgttacttcccatcttcacaaaggtagagttaactctcacctccctccctggacctatccacggtttaatccttcttgtgctgtagttactggacttcaactgatggtattaatgttttttcatgttacattgctacaatggcatgtggttttgcttctctttttttccatcatcacacacttggcaggaccaatttgtctaaaaccatatatgaattgtctccaaacagccttatttaagtcagatgttgtctctgtaaaacgttggcaaagaaaagtattcccttcctacatatagtcatattaaatagaactttgtgaggcattgcattctttttattccaaaaatgtttaatatagctccatatgtagtattgacggaagctatgaattctattaagatggccaaaagttagtgaacttctgccacggaccctggtggactgaacaaaggaggacaaatgcgggaataaagacaaagacaaaagagtatgtttggaagaaggagtcgggggctccttgcttctggtgaacaagggccctgagcttctagagcccttcgtatttattgggtaaaagaaatagggagaaggggtggttgtcagtcagctgcttgatttagtgcaggcctgcatgactactttctccagatgttccagtagataacctcaaggagcatggcaccaggaagtgactgccctcagcataccttctggtggcaggtgcagatgtgagtttgcccacatcctgcattcatgataaacagtttgctgtttgatcatatagcctccagtggaatgctgagttggtcagcattcagcttacagctcccaacaaacttctagcctcctttttggtataggtaaatcttagttgctatataataatctgttatctgtctgtccatatctgcatttaaagaaatgtgattaaaactcattttgttggaggttctccagccagccagggttaaagcagagtatttcagagagcactgacttgatcttattttatagcttatgttctagcactttcttgggtagatatttctcattgtagtgcctctgttgttttagaaccattgcctttgatttgaccagaagcaacagcattattttcagggagtattaccagaccttaagggtatccttctgtgggaccaagagtgtgtggtgaggtagtacaagtgcttccttcactgtgcatagcaatatcctcccacaaataggtcccctgcttcaggggtgcctgtattttgagtgattaattgcattagcctttatggtaggtgacaggatattctgttcaaaactttatgcttaccctactccactaccactttcttttaactaattcaagtctcagccgagactgcaaaaattttgaaattaaatgttattctagtacttctggttcaccaaaaatcaggtaagttcagcatattacagaacagccttgctgtgcagcactctgacaactttgcacaacataatataggatatgggggcaatgcttgactgtagtctgacccaattcttggtgaaatgccctgcaattctggctagagcaaggaagataacaagcctggtaagctgctgtgagacagtttctcatccctgtcatgtaggaaactgccataataccatttctcacccattttctagtttcagttgaatgcagaacttttcaccttataccctgtgtgggataagcctatgaattttcttgggtttagtttagagatggctcttcaacagcaccatgatccattgcttggaccatttgttatctgtatcttctagtttggtgtcatgatgtgagactagggacttggggaactgataccatgctgatttagctttcgatgtctgtgtaagtaatcagttgtctgaattcatctgggccaaatctcctttaccagccaaatcaatggaagtgtggcaagccaacctaacagctgtatcagtaatacttgtggccctgttagccatcacattgctgctttggtaatgtttaactgtgtaacaaagtgggactcttactgaccaaacacccagctagtatatgtactatgggatattccttgagccttctacttgtctctgggcataatggagcccccagtttggcaggtggacagaggccagagctgtatatcagaattactctgaattgcttttctcacattgtcagcccaaggaagataccaagacccgctcattggaaagtcttatttacacaactagaagggccataccaattctgaagctgccctcacacacacatctacctgagtgtggtaagaaaggaagcacagtaacagtgtttgggcctactcagaatggtgcactttgaatatgtggttgcctcctgctcgtcaatcctgtggtctcctcagtctatggtgttttgtgtttcaaagaaaccaaatgtttgaccatataagcatctgtaaaacatttctagtttggcataatatctggaaaaaatagaaggcaacatggagaataatctctaaagtatacatttttgtaaaaaaatatgcaatacttgattttgcattatattcttttctaatataggcatttaaggcatttttgccttctaagcactattttaactgtgtttgtagattttgatatgtatttttattatatttagttcaaaattttgtctactttctcttgtaatttattctttaattcaatgattaatttacaattgtgtttttactgtccaaatatgtagggttttcctggttttcatgtaggtaaatttgagaggaaaatgttaacatagcagatctgtgttaacattcagcagatctccttcatatctccaagggaacttggatcatgattgactcttgaccagccactgggaatgtgaccctttggatgtcttttacataaatggtggatttttttttttgtacacctggagcaatggactatgtaggtacctgcttgtcaaaattgctttgtacaaacatcaagattgataaggtatacctagtttctaagtcttggttattgtggctggtcctatagctggatatgcctatatggccagccctctataaaagctatgaatgctgagacttaaatgctcttgcgctcttcttcaaatagagatattctgtatatgttcctgtattgtgctactagagagaaagcacgtatagaaagcctatgtctgacctctctgggttctacccaatgcatatctttttcctgctgcttttactctgctccttttgctgtaatacattttagccttgattataacctaatattgagtcgttttgatgaacctcgaacttgagggtggtcctgggttccccaaaactgtattctaatttaattctattgtggtcagagaatacactccatatgattcctttttttaatgttgagacttgtttcatggcctagaatatgatctttcctggtaagtacatcacatgccctgaaaagaatgtgtattttggcattactggatgtattgttctatgaataccagttatataaaagtagctaatagagttcagatcttctgtgttttgctgattttgtttttctagttcagttaattgctgaaacaagattgttaaaatctctagttatgattgtggaattatggatttctgcattcaattctgacagttcttgtttcatgtattttaaaatgctattatgggatccgtatgcatttggtatgatcttttctattgaattgacccttttatcattatgaattgttcctctttatctcttataatacatttgttttttatatttgtcttctgatggccattctagctttttgcttaactctttgcgaggtgtatcttttccatctgtgtactgttgacacatctgcatatttatatttagaatgaatgtcttataaacagtatatagttgcttggatttttaaaattttaccttctgataatctctgcctttttaattgaaatctagttcagtaatttttaatataactgccaatatagttaggtttagacctaagatctgtttttttttattttctacatgcctcttctgttttttcttcctcttttccagctttttttaaatccgtaaatgttttcagaattctattttatttttcctattgatactctagctattcttttttttgtactttttttgatagtggctgccctagggattataagatacagccatagctttcatagtccacttacttagttaataatgtgctacttcaagtaaaatatggaaatcttacaaatttccaggcccacacccctattcttttgattgtagttattacatgtaaaacaaactcccctctactcacacagcccacaaggcactattatcattttacttttaaacagttatttggtttatatagaggaaaaaaaggataaaatagtattttgcattttctccaccatttaccctttctgattttcttcattcatttctgagtatcccaattccatctggtatcatttctcttctatgtaaataacttctagcatttcttatagtgcaggttggctgatgacaaatgcttttagttttatgtgaaaatacctttatttcactttcacacttcagtgatatttttgctgaatataaaattctgggttaacatttcattttttcatgctttaaagatgttttaacagtttttcagtcctccattttttttaatttaaaaatttaattgatgaaaattacatagatttgtgtaagatgatgttttaaaattgagcttgttaacatatatgcattaccttacatgtcatttttgtggtaacatcacttaaaatctactttctcagcaattttcaagtatataatacattgttattaactacagtcaccatgttgtacagtagatctcttgaatttattcctcctgtctaactgaaattttgtatcatgtgaccaacatctctttgatcttcccccacccagttcatgataaccacctgatatggtttggctgtgtccccacctaaatctcatcttgaattgtagctcccataatccccacgtgtcataggagggacctggtgggaggcaattgaatcatgagggtgggtctttcccatactgttctcctgatagtgaataagtctcacgagatctgatggtttcatgaagggcagtttccctgcacatgctctcttgcctgccatcatgtaagacatccctttactgcccctttgctttctgccatgattatgaggcctcccaaccatgtggaactgtgagtccattaaacctctgtttttttttttaataaattacccagtctcaggtatgtttttattagcagcataagaacaaactaatacaccaccacttactctctgcttctattagttcaacttttttaggtttcatataaatgagattatatgatatttaactttctgtgcttggcttatttcacttaatgcccttcaggtttatccatgttgctgcaaatgacagggaatcctttcattttaaaggctgaaatagtattccattgtgagtatataccacattttctttatccatgtatctgttgaaggatacttaggttgattctgtatcttggctattgtgaacactgctgcaatgaacatgtgagttaagatatctctttgacatactgatttatatttttttggatatataccccatagtggaattgatggcgcagtggcccacctagagcagtcgctgccatgacactggctgcagtgggggaggtacgaccaaggctgctcactccatggagccagcaggggctgggactaggcaggagctgtgccctccagggcacagctgtagccacccaagtcatggctgtggacccaggacttcctgtgcccttgggggctgggagcaggctggagccctaccctcctgggtgcagctgcaactgcccaagttgtggctgcagacccaggcctccctgtgcaccttggggccaggagcagacaggagccccatcctcccaggcacagctgtagctgcccagccatggctgtggacccaggagtctctactctcagtggtctgggaaggccccccatgcgcctgccagctcagaagtatctgctcctgctgcctggcctttccccactcctggtacccactctgatctcagagcaaagttgaggctgagcccaggcactgttgcaactggccaggtgggtgccaacgagcatgggagggaggtcaagggggagctgagagcagtttggtgctggcgtgcaggcacccttcagcacaaacagcctggatgccatgaacagcggcaggaggcagacaggctcctgagtagaaagggataggtcaccagtgaagccccaccttcaagtcagggaaggcctgaagcttgggagccaggctgccagtcacacagactggagtgggaacttatggtgcttttcccagcccacccatagccactcatggactagttagtcagcatgcacttcctcccctctgaagcacataaaaatcccagatatcaaccagactcaaggaaaggatgagatgtccagctgtggagagtagctacccactccagggtgtcctctctgctgagagctgaacactcatcaagacaccctgcctgtggagaggagctacccaatgtgggtctcctctgagctgttctgtcgctcagtaaagctcctttttgccttgctcgccctccatttgtccatgtacctcattcttcctggataaaggacaagaacttggaacccaccaatggcagggcaaaaagagctgtaacacaaacagggctgaaacacactccttgctcattacgttgtaggcaacaagaaggagagaagagagaaggagagaagagctgcttcccttctgggagcccagacctaggagttccctgagccagggctgtgacaccctgtttgaggcgttgcggttcctggcatttccaagcttctgggtgctactgtgttccctggtgccagccgtggaagctgcttgcagtacgcctggcccagccacagccttgcagggagccagcgcccatgccagcatctggagtttcctgccccacttcagccagcatgcctggctatgcacagaggctggaccctatacttgctcacaacgctcctcaccgctctatgcctggcttgcccttggcaggcttgggagccaggctggtagtgtgagccgagtgtagcctgccaggctgagtgggtggaatgagctcagcaggcccaagtaaaactcaggcaaagatgccactggccacagaggtttctggctggtgaagcaacaccacaagaatcctgtgacagaactgctggatcatatggtagtactttttaaattttttgaggaacctccattctgttttccaaaatggctatactaatttacatttccaccagtagtgctgaagatttcccttttcttcatatctttatcaacacttgttgtcttttactgttttgataagtgctgttctaataagtgtggggtatgtctagttgtggtttcaacttgcatttcccttagtgatgctgagcatttttttatatacttgtagactgtttgtatgtctttgagaaatgtctgtcaggtactttgcccattttaaatttaagttatttatttttgagatggagtcttgttctgttgcccaggctggagtgcggtggcacaatctcagctcactgcaaccttcgcctcccaggttcaagtgattctcctacttcagcctcccaagtagttgggattacaggtgcccaccaccatgcccagctaatttttttgtattttcaatagagacagggtttcaccatgttgaccaggctggtcttgaactcttgacctcttgacctcaagtgatccacctgccttggcctcccaaagtgctgggattacaggcatgagccactgtgctgggctaacttcgcccatttttaaattggactatttgttttcttgctcttgagttctttgagttccttatatattctggctattaactccttatcagatgtatagtttgcaaatattttctcccatcccatgggttatctcttcattctgtttattgttcccttggctgtccagaaactttttagtttgatgaaatctaatttgtctatttttgtgcttttgttgcctgttcttttggtatcatattcaaaaaactattgcccagaccaatgtcgtggaccttttccgttatgttttctactagtaggtttatagtttcaggtcttacctttaggtctttaatccattatgagttgattattgtatatagtgtgagataatggtccagtttcactcttttgcatgtggatatccagttttcctatcactatttattgaagagactctccttttcccattatgtgttcttggcccctttttgaaaaatcaattgaccattaaatgtatgggtctgtgtctaggctctctatcctgttgtatttgtctatgtgtctgtttttatgccagcacaatggagttttgattactttagctttgtaggatattttgaagtcaagtactgtaatgtgtcaagcttttttccccctcaaggctgctttggctattgggggtcttttgtagttcaacatgaattttaggatcattttctctatttctgtgaaaaatgtcattgaaattttgatagggattccattgaatctatagattgctttgggtggcaaggacattttaacaatattaattcttccattccatgaaaatagtgtgtctttccatttattcatgacttttccaaattttttcaatgttttacagttttcagtgtacacaacttttacatccttggttacgtttattcctaagtgggatttcttttttggtagcaactataaatgagattggtttcctgatttattttgtaggtagttcattattagtgtatagcaacactactaactttttaatgctgattttgtatcctgtacctgttttaaccaaatttgtttattacttctaacagttttttggttgagtccttcaggttttctctatataagaccaatagtttaactttctattttctgattttcattcctttaattttttttctcttgcctaattgctcttgctaggacttccagttctattttgaatagaagttttgagaatgggcatctttgttcctgatcttagaggaaaagctttcaacttttcatcactgagtatgctattagctgtgggcttgtcatatatggcctttattgtgttaagatacattcttctgtacctaatttgttgagagtttatcaggaaacaatgttgaattttatcaaatgcttttctgtatatattgagatgatcatatagtttttgtctatcattctgttaatgtagtgtgtcatatttatagctttctatatgttgaattatccttgtgttccaggaatatattccatttgatctggtgaatgatcttttaaatatgctattgaattcagtttgctagtattttgttgagtatttttgcatttgtgttcgtcagggatatttgtctgtaattttattttctttagtgtccatgatccatagtttctgatgagaagttaagcattaactgaattgttgttttgactgtgatatgtcatttttctcttgctgctttcaaggctctttctctttgacttacagtggtttattatttacctcagaatggacttctctgtatttattctgctttgaaatcatttcgtatcttgtatatattcattgctatcattcatcaagtttgggaaattttcatttattattacttcaaatatattttatgtcccattctatctcctcttctactggtatactaaattcgcttatgtatgactgttcgatatcatctattaagtttttgagcttctgttcaatttgtgtcatttttttctctgttcttcaacttgtgtaatttctattgatctgtcttcgagttcacttattcctgttatgtccattttgctgttaaatccatctagtgatttttttcataaattatattttgtattttaaaatttccttttttattgcctttatttctctgctgaggcttcctatttctctactgaggttttcatgaattgataaatccaaggtctctgtcataattgaggttggttctgatgttctgcctcatcaaactgtgcctttttagtatgctttgtgatttttttgtcaaaagctggaaatgatgtattgggtaaaaggaactgaggtgaatagacctttagtgtaaggttttatgtttatttggttagggattaagctgtgtttagtattttctgtagctgtaagtgtcaggaaataaaatatcctctgctgtctttgttttttacttccctgttacatttgagttcctctagcaactttttcttaagatctgagatatgtaattctttctgttgtatccccctgttattatacaggatccctattgatgtagtaaggtgtagggagagaagtgttctatggtcctatgattgggtctcaatcttttagtgagcctgtgccctagactgtgaccttcgcaagtgcttctcagttttgctttgtttttcccaccttaggtgaaataggaaggctaaatggggacaggaattgggcatttccttcttccaggtcagttaaggtctgctaaatccccagttggttatgttctagtaatatagttgggtcctctgtatccatgagtttaacacgcatggattcaaccaaccatggatggaaaatgtttgggaaaaaaagcaataaagaataacaatacaataatacaaaataacacaaataaaaattgcagtatagcaactatttacctagcgtttatattgtatgaggtattataagcaatatagagatgatttaaagtatatgggaggatgtgcataggttatgtgcaaatatgacaccattgtatataagggagttgagtatctctggatttaggtatccgtggatactcaggaaccactatagtttcacctgagggcaggccttggtaagaaagagaatgttcttgagtgcttcataaaatggcttttttttaaactctccctgcctgaagcccaaaataatttttcttttatctttactgtaagaacctgatagggttcctggagctaaaactcacagaactgggtatgggtctaagattgggcctccctggagtttctaactctcaaactacagtttatgttttcttagcctgatactggttctggagttttctcctgggcttctgcttcagaaagttggattttctgtatctgcctgtctgtctctatagtttgggggcagtgatttgccctgtaattgcaacctctaatggatctaggaagagttgttgattttcactttgtttagcatttttcttgtgaggataagagtgataactttcaagctccttacattctgaaccagaaaatgaaagtcaggttttcatgaattagaaacatgtctatttgcatttcattgatgataaccagtttaaaatcttcatgttacttccaacatctggttcatcatggagttggactacatcgattttttttttcctgtttatagtgtgttctattttcttgattctttgtatgctgggttcttttgagttatatcttagatattatgaatgctaaattgaggaaattctggattatgttattttcacccaaaaagtattggttcctttgttttagtatctagttttgttgactgggcttgaacagctaactctatttcttttgcagcagctcttatcttcattcagatctttgtttttggatgggctgctgaaagtctggactgtataagcatggttcagtgtttagtcagaaatgtgagtgtatatatatatatatatatatgtgctgaggagggagaggatcctataggttctgagctcatcatacccagaaatggaaagttttcaggaatatttccttgcgggcaaaaaatctctgctttactgaataatctcttagcaaccaggaccatgtgttccttcagtaacttttggtgaggtagaatcttgtgatgtcccagcctcttgatttccatataacagggagtaggggagggagacattgtggagataatcagaaacctttggaggctatgagcaacctatataatcccacctccctcagttatactgaaatttgagtagcttttcacagaatctgtaaattttttattaacctagttaggacttttttgagccaaatgctcatttctactgttcttaatacaatgcctgtcacaaagttaggtattcagtaaatactagttgaatctattaattagggattcaccataaatttctcgccactaataaattacctaagtgtgaacgttttgtttatctcggaaataagatgattaaataaaaatatttgcatatttttcatcttgcattcatgttgatacacagccaatatatttcaagtcattttaaataaaagattaatctgtccatgatatactttgttagataaagctatttaaatgaattgtttttggataaatcctgtaatggtgttttctacttcttctttttaactcatttgttgaaagacggtagggaatagtggaccaggtaattaaataaagttcatgttgtagtttctgcctcatatgatagccaaagtaaatgagattattaacatgaacactttaaagatgtgtatcaaaattaggaggcttatagagagtctcaagtaattaagtgtgtagcgtagcaaataatgactttctctaatattggggttaagatgttcagcagagtatgaattataaaatcctcaaaatacaacttgaaagacttttgacttttagcccattatcctcttgttaatgcacatgtaagagattatgtggggtttttatgtcattatggcaaattataggctgtactataggtgctattcagtattggatacgaatgagttccaagtagctttgttgatctttcactaaaactagggatttggcattgacttatcagtgtgattattgtaaaagagatgtagtgtggaactgtttcctgagattaatccaagtattcagtatcataatttagaaactcccttcagttatctgccctacgtctccatttactcagtaatgtacgcagactgggaaaccttaagaagggttgagacttctgggttcattacagagctgtgggtagccatcttgctgttgttgactctagtgacctgtaactacagatcaagctgtatgcagcctttttctccttcaggtaagttgggttgaaatccagtgctccaagctgctctgaggctttaattgcatgagtgaacactgaaaatgtgaaaaacaattttagaccagaatagcaaggtgagtaaggccaaagaatgtattttatggatattcatgaatgtcacccacagaattcaatattttttccagacgattctgaaagattataatttaatggatgtttgttttattcttctgaggacccagttgaaatcctgttgattctgtagcagactacattactatcctttgtcttactcttatatctctgaggtagatgaatgcttcagaggtaaggtgttatattttcaaaggacttttctatgtttcgttgtatctgtgtgatcagaaggacagggagaaagtctgttttaaaattagcagcatgagatattagaatcctataatgcttatatgaagtttggtgaaatggttagccaaagagaattttctcctcagactagtaactaaattgatatgtaggagcagcctttcctgagtgactttccttgatagttaaaactgcagcaagacatttcagaagcagtttccaaggaagtgaatggatagtgaggtaattttcttaagtacttggattctgattgtctccagaggttttgaagctgttagttacacaatagacggatttgatctcctaggatctttgccaggttcgtaattgcactgagatttttaatgataacaaatgacaacatgatgtccttctctttattctgggagtgaggtgatttgtacataagaaacaaaattaggttttagtttgaaaggcttggagaatcagacttcttttaggccaaatacagtggtatatctgagagaagagttatacagccattgagttgtaattgcttgattcattaaggtatccttgaaaatcattagactgtcagcagcatgagggcaggttttatgtcattttggtaatcactgagtcctagcacaatagttgactgtggtaagtccttatgaatttttgttggaagaatgggaagtatattgaattgcgacatctttttgctttttttttttttttttttttttttttagcatgggattagaggcagcagttttggacaggaggcaagtcttttggccttctgctcctggcaggcaagtcttcattttttaagactctcaagtgtcaccatgtttgtgaagacttcttatcttttctaggtgcaattgacctgactagtcttcctataatgtgtcctttacttactgcttttatagcgtctgtgatgggtttattgcatttttatttgcttctttctaccatagtagaaagtgcaattattattcatctgtctattcctggtatatatattagtagaaaaatgttccactgcaagtaacagttagcaataattatcggccaaggaagttaatctcagaaaatagtaagaaatgtgtataaaacataggtagatatatgtttagtgctatttataatgaagaaatagaaccatcctagactaaaaccaatagaggactgattaaataaatgataaatatttatataaggaactatgaagtcacaattaaaatttatgcattttccaaattgcctgccttaagtatatatgagtttggtgaacagaaaatattcctgacccatatcatacaataatctgtattcaacccaatattggttttgtgttatagataaagtaaaaaaggagcagtaaagaggaaaatgggaaattaaaatattgttcaaatctacagtgaaataaaggtagtgaagtaggcaactggtttgtttagacagtccaggggatttggtatcttattcatcagttattgagtgtattctctgtgccaactaagtgttggatgctgtgacaaatgcagataggccaagtcatggcctcctccctcaaagaacttgcaatctggggagaataatatacacacagaaaatgggggagcaaacgaaaatgagtactacagatttgaatgccatagatattcagaggacagagtgattacatcctcctgggctgatgaagatacatttctaaggaggagaagaattatactgtaattaacagtggctttaggatttaaataaaaatggaaggaatatcatatttaaatgaaggagaatggtgtgaacaaaggcatggagatgggaaagtagacagcatttgcagagaactagcttgactcaaattttaagattcttcttgtagtagaaaagcaaataaaaagggccagaactccgagagcctgtcttagaacctctgattcatatttgcatgcctttatatttgttgcttttaatttgcaagttgcaaaaatgggcattttaatattagaaaatctactgtaggacagtaagctgagagctgataattttccattcttggttcaatactttagtgaggacaacattagattaagaatcagacctggaatgtggtactacaggttataataagtagtagctctgtaaccaaactaagccttggtttcctcatctgtaaaacaggtatgattattcacctctctggactcattgggtttttaatgagcagatcaagtaaaatggtatgaatgtgcttgatgtagagctgggggagcaagaaaaaaatcttcagacagaactccctccatacctctgttcctgtacctcaactctgatgaaaagatatgtaactaggggaaagaaggaatttacagatagatttgaatccacctgaaaatggagtactaaagtggtaatagtccagaaaatgttccctccacccagtaccatatcctttagtacattgtttcccgacagttagactccagtataaggttttggggatactttttagctataaccatataataacaaacatcctattttcttttggctgattgatcccagggctgcactgattctgtaaaccaacttggcaggatttccacaaactgcttctggggagtagtaattcttagggaaccaaggctacccccaaatgaactataatactttgcccttaattctttagaatggaacaataatcagaattatcttggcccatggagttgcttatcagcagttctctcaggactgctgttctttttggagaagggccagtagagtgagtcagatcttttatgttttgtttatagagtgaccatctgacattggtctgaaccacccaggtgcaatgagtttcctttggcatgatcattccactaggtatgctttcgattgtgtctaagttgttttaagaagccatttgagtgggccagtttctaaatatgttatacaaatacagagtacattgcttctatgctatcttgcccttggccgacttataagaaagaagttataagaaattatggcattaaatgtgttattgtatatactataaggatgttgaagacatcattcattacatttcttcttttgaggacactggataatttttctgtctaatctcgaaatcataagtaataaagtttctgggcaactggtttatttttatcttaggataccatagctcatgtaacaaattatttttttggcattggctactaggaggtttaccccttactttgtcaaaattacagaaccttctatatcctgtctctgtcttatctctcttattattgatctttccctttgtcatgtttttctcaaatgcttatttttaaacttttattttatcttcttttattacatgattttgtgtaaatcatgtttaattctttccagaacaggcctacctagtgtgaataaagtgaatttgatacagaaatattaaatttaatttgttgaattggtgtacatatttccttttttatcatgatttggtgataatctaggacaccaattaagtgatatccagaaatatataacaactgaaattttatataagataatttgtgaggtaaagcaacaattgatcatatgcatataataacccctgcaatgaacaaacaaagtgtgcacagattatatcttggccctttcttctcaagcttccctgagtcttcatacatttcacctggaagccttttataggagaggaaacatactcctaaaaatatctcacagttggtgaaggaacagaatggacttgtctgttgtgtattgcctggtcggaatcaattattccacactcaccctttgtgatctaactctttcactgccataccatctccacttcactataggaaagcttcaatttttgtagtttatttcagttaagtattaagaggcaggctggttaaattaattgacacatgtgaagagctgataacccccctgtttaattttaccagtagtatgcacgtgcttgccccaaagaataagatagctctgtctccagatgtcttgatctaggttttcacactcttcttccccaaggaaataatgtagcagtgtactaagatatacacagctatgtgtatatcttgcagctatagatatatatgatatacacagctatgtgtatattttgcagctacaaaaatataatcaaatcttaaaggctgcataattttccagtgtatggatataacaaggtttatttccaaatggtaaaacatttaggaatggttaaattatggtacatgagtataatgcaactattaagaatcatgtttataggaagattcttataatgtatgaataaaaacatagaatacaaactggaataacatatgagctcaactcattaaaatatctttttaattcaatagatttttgcatgtctagtatgtgtcaagtttagtgatgcatatgaggaaataacatcaaataagatacacatgatttctgaaagcattaactaaaataggacatcattacaaaatcaaatctccctttgaggattggtcatttttaatcaaatgtgattaagctcattttctagtttgtggactttccaggacccttgtttcatttctcttctgctttctctccgagaattcatagcactccagttcaattagattgagttgaagagtttaaaagcaaaagaaatcgataattcaagcctagaattccacattatttttagattttctttacctatgtagttagtgtaacctaagaacatcaccttctcccaggaatccatccttgtaattttgtctgggctacttctgcaggaaaagatactagtttgcaaagggaaaaagtgcttctgcacgtgccttttaattttatattacaaacaaacccacactcatgcttttatgagatgtaattcttattgttatgtagctttaacaatttaattttttgttgagacaaatttcctttgaataatttttaatgatatttatagaacatggatctttacttagaaagtctttattgaacatgtaaatcttatttaagaattcatcctgcaaaatatatattcttgagaattgaggctaatgttttattatctctgtcaagtcattacattttggttctcctggtagttgtaatgtgatattcttaaacattcactacagtgacatgatttagtatctagtgatgcaacagtgttacatctcacagaaataactgtgtccttctaaggcctcagaggcatatcacatttgtcccatatgctatttgcaatgatttctcaatgtcatttttttgtgacatgcttatacagtatgacaatgtgagagttaaaaatgtgagaacctatttctctctggttgaattgtctatattgacctcttgaagtaatttagtgtatctgaccttatttattttaaaattaaaatacctgaacttcttatatgatcacttttaaaacaccagattgttacatttggagctaaaattctgtgctgtggtatgcctaagatgatacaaccaaagccacattgtttattctactttttcacttatacatggtgtccattatgcattgatcttgtccagcaaaattaactttttaaactgattgttctgctatctgaagaatcttactaaaatttaatcggtaaactaaaaataagcacctaatgccatagtgcattctggtaactcataaaagaaaaaaaaaaaagaaactaaagcctaatgtaggcttgtgaggttaaaggaaggttagtatatacttactggccattcaagggtatatataaatgaccatttttcctcttttgagaagggtgatataatgcaaccacacttacaagtgatatactttcccgtttgcagaatatttactgttttgcctactatcactgaactgccctgagttatataccgctatataatagggttaaaactcatccgtgtcccttcatttccatggaaaagactttctggacagtggctaaggctaacataagattcttgagctatctcctatgtgtggcttacttcccacccaccaaaatgaagcaaatcctgtccagatgcattgtcttcataatggcttctctcttttttgtctcatttctaccttaaggattccttctgccttactgctgttcttatttctcttatatttctagaagaggcacgtaactatattcctactattagttctatcttccttttattttgatgactgttctgttgctccaagactcttattttcacaatattatacagaactcataagtttaggaaattatggcctttagctgatccaaaaattgatgtatgtttaaatggacaaaagacttgaaacaggcacttcacaaaagatattcaaagggccaatgtgcaaaaaggtattcattttcatcacttatcaggaaaatgcacaatgtgataccattaccccctcaagagtaacaaagatgaaaaagacaataccaagagtttgtaagaatatagagatatagaataattgaaactctgctgggagtgtaaattggtacaaccacattggaaaactgtttagtagtaatgagtagagctgaatataggcagcatgtgacccattaattctacttctacacccaacagaaatagaaatataggcatacacccaacagaaatagaaatataggcatacatccaacagaaacagatacatagtttcatcaaaagacatgcacaagaatgtttacagcactacttgtaataaacctaaacttgaaataacttaaatttctgtcaatagaatgaataaataaatggggatatatacctaacatggaatcagtagtgagaatgaatgagctacaactatatgcaacaatatggatgaatcttacaaacatgatgttgagcaaaagaagcttgatccaaatgagtacatactatgattccatttatatgaaattcaaaaacacacaaaacgtgtaataagtcagggtagtcgttacccttattaggaattagtaactggacaggaagcagaaggagggtttctggggtgctagtactattctgctaagtgtcttgatttgggtgctggttacctgggtggactcactttgtgaaaattcaacaaggtgtatactaatgattcgtatacttttctgtatgtatgagatatatatgtgtatatatatatataatataattttacaaaagagcagtactatatgctgtattatttatctaccactgcataacaaattaccccaaaacttagcagcttcatgtaataaacatttgttatctcacacagtttctgagagcaatctaggagcaactcagctgggtggttttggcatagggtctctcatgagattgctatcaagatgtaggctggggctgcagtcatccaaaggcttgactgggcctgaagcatctgcttccaagatggcttccttttttttttttgtttttcagacggagtctcgctctgtcgtccaggctggagtgcagtggcgtgatctaggctcactgcaacctctgcctaccaggctcaagcgatactcctgcttcagcctcccgagaagctgggattacagatgcctgccaccatgcctggctaatttttgtatttttagtagagatggggttttgctatgttcgccaagcttatcttaaactcctgacctcaggtgatccaccggccttggcctccccaaagtgctgggattacaggcgtgagctactggtgcccagcccaagatggcttcttcatgtacctgttgagggatgcctcagtgaaagctctttgtattgccagaggctacaaaataacctcacagataacattttatatatgtataatatgctcttacatatgtgtttatacatatctaacaaatgatatcatgaatactgttttataattttttctctactcaatacattgtggacatccttttttattttttgattggcttatctgtagatctattttatcctttttcacagagctctgttgaggtataattgtcatataattggcatacatacacatatttgaagtgtacaactggagattttttttatgtatgtgtacactcatgaatttatcatcacaatctagataatgggcaagcagtcacctgcaaaagtttcctactgtccctttgtaatcctcttctcatactttttaatggctgaaaagctttatttgcatatatgaagtgtctttaaaatccatacttacatttgctcacacatagctcaacctaatattttgtttaaattgtaggatgctcaccccatttagagaaagaaatccacctccccaaccccaatcaagaacctgctattgtatatcatcatagagccagattacctaggtaagaatcttagccttgccactttgcagacattatgatcctgggcaaattgtttaaccactctgtatcaaattccttacctgtaaagtggggataataatagttttatatttaactcataaaattgcaaagattaaaggaattaacacaatgatctgataacaaagcactatgttattatctgctgctgttattattcccatggtttgttatgctaaaagcctcttttcagtttctcctgatgatattaaagatacgagttgccaggaccttgtattcaaatagcctaccagaacttatctcctctttttaattcctacttctctgtcacctccctctgagcatcttgataaaggtgaggagaagtatgtagctaatcataggctgtttaagtattggagagtttggctttagggacatttcataaggtgagagatacccaaaatagaacacttaaaacaattccaagaccttatcaaccaagatgtcaaaatataaattacatttctacattaaaaaatgttattgatcactttgatggtaatgattacacatgtataataacctttccttgagcacatactaagtgtatattctaggaaagatcctaagaattaaggtatttattgtctttatgaagcatactatattagtctgttctcacattgctataaagaaatacccaagactgggtaatttataaacaaaagaggtttaattggctcacgtttctacaggctgtacaggaagcatgatactgacatctccttagcttttgggaaggcctcagggaacttaaatcgtggcagaaggcgaagagccagcacttcacatggctggaacaggaggaagagagagaggggggaggtgctacacagttttaaacaatcagatctcgggagaactcactatcacaagaaaagcaccaagggatggtgctaaaccgttcatgagaaactgaccccatgatccaatcacctcccaccaggacccacctccttgattgtgagatttgggtggggacacagatccaaaccatatcattctggcactagccccccacaaatcacatgtccctctcacattgcaaaatacaatcatgccttcccaatagtcccccaaaatcttaagtcatttcagcattaactcaaaagtccaaagttcaaagtcttatctgaaacaaggctagcccctcccaccaatgagcctgtaaaataaaaaacaacttatttccaaaataaaatgggggtataggcattgggtaataaatccccttccaaaagggagaaatcaatcaaaagaaaggggctataggctccatgcaagtctgaaatccaggaaggtagtcattaagtcttaaacctccaacctccaaaataatctcctttggctccatggcctaaatccatggcccagtgatacaaggcgtgggttcccaaggccttgggcagctccacccctctggctttgcagggttcagcacccttggctgctttcaagggctgatgttgagcaccttctgcttttccaggctgagggtacaagctgccagtggatctaccattctggggtctggaagatggtgaccctcttctcacaggtctactagacaatgccccagtggtgacgtgtgtgggggctccaaccccaaatttctcctccttactgccctagtagaggttccccatgtgggctctgcccctggagcaggcttctgtctggacatccaagcttttccatacatcctctgaaatctaggcagaggctctcaggcctcaactcttgctctctgtgcactcacaggcataacaccatgtggaagctgccaaggcttatggcttacatcttctgaagcagtggcctgaactgaacctgggcccctttgggccacgactgaagctggagcaactgcgatgtcgggagcagtgtcccccggctgcacagggcagcagggccctgggcctggcccatgaaacagttcttccctcctaggcctccaggcctgtgataggaggggctgccatgaagatctctgaaatgcctttgaggagtttttccccatcatcttggctaatagtatttggtttctttccacttctgcaaatttctgcagccttcttgaattcttctcctgaaaattgacttttctttcctaccacgtggccaggctgcaaattttccaagcttttatgctctgctttccttttaaatatgttccagttttatgttatttctttgcctacacatattagaataggtggttaaaagcagccaggccacatcttgaatgctttgctgctgagacatttcttctgccagatatcctaaatcatcattgtcaagttcaaagttccacagatccctagggtgggggtacaattcagtcaaattctttgcaaggacataacaatagtggcctttgctccattttccagttagttcctcatgtccatctgagacctcttcggcctggccttcactgtccatatcactataaccattcaaccagtctctaggaagttccaaactttcctgcattttcctatctccttctgatccctccacactcttccacctctgcccattacctagttccaaagtcacttccacatttttaggtatctttatagcagtgctgcactccttggtaccaattttctttattaattcattcttgcagtgctataaagaaatacatgagactgggtaatttataaagaaacaaggtttaattgggtcatggttccacaggctgtataggaagcataatgctggcatctgcttggcttctgggaaagcctcaggaaacttacaatcatggtggaaggtgaagggcagccagcacttcacatggctggaacaggaggaataggtagaggggagaggtgctacacacttttaaacaaccagatcttgcaataactcactcactcattctcacaagaacagtactaaggggatagtgctaaaccattcatgagaaactgctcccatgatccagtcacctcccaccagacctcaccttctacattgggaattacagttgaatatgagatttgggtagggacagagatccaaaccatatcacatattatcaatttaaagagatgtggctaggatttgtaggggtgagaatagactgggatctgctgttagagcaaaggaagtgagtaggtcttactgattggtaatgttagattgagccatggatattgccactgttttaaacctgtgtaatgggagtttgttttactactttccctaaactgaaaacaacctgtcttagttgattcaggctgctataacaaaatactttaggtaatttttgaaaaacaaaaatttattgctcacagttctggaagctggaagtcaaaaatcaagatgacagcagatttagtgtctggtgagagcttactctctgcttcaaagatggtaccaccttattgctgtgtcctcacatggcaaaaggggatgggaagctccctcaagcctcttttataaggatagtaatcccattcatgagaatggagcctcatgacttaatcccttcccaaaggctccactccttaacactgtcatattaggtattaatttccaacatatgaattttggagggacaccaacattcagaccatagcacaatccaaatgtctatcactggtagaatgaaaaaatgaacaggggtgtgtgtgtatgtacgtgcctgtgtgtgtgcgtataatatacagagccagtggtaagaatgaatctgctacaattacatgcaacagtatggatgaatctcacaaacaagatactaagcagaagccaaaaagatctaaaagcatacactaatgatttcatttatatgaagatcaaaaacataaaactcatttatggtataagaaatcaggctagtgattcctagtgcttgccactcctttcctcactctgctaattccaaatacagagcttgtcctcatcactgtagacaccaccactactcttactgtcacagagtgtccaggatcgtcttcttcagggcttataagttccagggaagttacaaggatggctatctacaaggaaacattgaatgggaactggctaaagcctcaggcatggataaaaattggatgggaactggctaaagcttcaggcatggataaaaactggatggcaactggctaaagcctcaggcatgggtaggcatccttaaggtagggaggtcatcagcaagggagtggctactgcccaagggaagccctcagcacatagccccaggaatgattctgaccatgtgcttgctcttatggtctgtagatgctgaacccacccccaagggcctcctgagcattcaagaaatggtcgtcactaaaaatgctccttcatttttaatctgtttgattcctttcagatctgactcttccaacctaggcctcactgatttctctctttccttcaatccagaggagactttctagcctgggaggtgggtttggatgggtaggattggaggaggaactttgctgtcattattttatttaatcatttcatctgctagaagacttcttgcttttcccgagtaccttaaaagacagaaaaacttattttttctctttttctgacccatacttgtctttcatttgaagcaataaacacaaaatggcttagctacttgcagggcagatggtaaatacacagtaaagaaagaagcagaaaaaaaaaatcaactattgggagaaacaactttagttaacatcttaaaatgtcattccataaaacttgggttgaattaggtaataaaagtattattaatattatggaatttcgaggagaaacgagtttatatgtgtggtggagaaaatatttgtttttagattcatagtatttcaggtggtggcaagatatccaggtgtagatttctctgaggcatttagaattgtagaactgaaggggtgggtcaaggctgaatgtatagatttattgggatggaagggaaaattcaaacatcattgtggatgaaataaactatttctgttagagaatacaattgactttatgaagtgatttatagggcatctagattgtttgatgtggtatgcaatgacgtttttattcactgaggtgtttctatagttaggataattttatttagatggttgtaccattatctttaatattttattgtgcactagaaatataagtcccactgtcatataaaattagtatctctcacttgaaagagaattctcttactgttgttattgatggtgctggatctctgtttcaatgatacttacactgggcttccttgttttttttttttgacttgttgatgtgtgaaaattcagtaagccatttcattgtatacaccagggattgtcaaataatggctggctgccagttttttgtgtccatgaactgagaatggttttacatttttaaatgctttaaaaaaattaaagaagagtattttatgatacatgaaaactatataaaattcacatttcagtggccataaataaagtttttattaaaatatagccacacacaaatttgtttctgtggctgctttcatgctataatagtagagttgggtagttacaacagagaccatatgaccctcacagcctaaaatatttattctctagctttttactgaaaaagccaactgacccctgatatacaccaactgatgtatcattagaaaactagtgccaggtgtggtggctcacacctgtaatctcagcactttgggaggctcaagcttgcctagctttgcccaggtgggtggatcacttgagcccaggagtttgagaccagcctgggcaacatggtaaaaccctgtctatacaaaaaaaaaaaataataaaattaccaggaggcttaggtgggaggatcacttgagcctgggaggcagaggctgcagtgagccgtgatcacgccactgcaccccagccagggtgacagagcaagactctgtctcaaaaaaaaaaaaaaaaaagaaagaaagaaaactagtaaagacaagtatcctcccaaaataaataaacccacagaagtacttctcttacacaggcaatagttatttaaataacatcttttcctgccttatttttctccttgataggtaccactatttatcactgttttacacactatacttttgcttgtttaaataaacagacacaggttaactatttcttccctctagattgtacctttagtgagggcaggggtttgtgtctgtattgcttactgttggattctctagcacctaagcatgtagtagacacacaatgtatattttatttgagtatttacatatctgttgaattgagaaaccaaccactgaatttgctacatattactgtatccaactctgaggatgattggacaacagaaacaaagtatcctttgttcatttgcatagcttgcctagctttgctctagagattgtaggaggtatctctgaatttcagcaacatctaacagcattttgatgctcttccctagtgtatatagcactgaagagcagcatgtataaatatacatatcagacacattcattttttaaagtatttaataatatacttttataatgtattttatataattatgttaatgtataatatattaattttatattatatttaatattaattatacataatattaatataaatttacatatatctatacctcaagcttttatatcaattattgtttttatacatttgaaacagtaggctttgtgaagtgaatggcacatagtaaatacctaaaggttaaaataattgaagaattaagcaagctcttaggtaataggttattttatgaagacagaggtattgcttagtggtttcccactgcatttacaaggaaatccaaatggttttccagccagtaaagccttgtatgatttgactgtttgtctttgtctcccaccttctcccttgctggttatgctgaaatcaaactgaacttctttaagttactctattaccttaaggtcctttatttatagttaaacaaaatattatgactcccccatagactctaagctctattagggcagggatcgcagatgccttattcaccattaacaacccaatgtttagcaaaatgactgaaatataataagcagtaagtaaatattttttgaacgactacatatgtgattaaaagaacactggggttgatgtcagaaaccctaggttaaaatcttgggaatgcattctgaatcttgatctaggtgccaattacacaactgtgtttgtgaaaagtcatcgagttttaatgttggcattttttatgtaaatgtgttgataagttttaaaaaacccagtcctaagatcctcctatttactatgcaaacatgagtaagtccatttctctgaaatttagttttatcatttatcaagaagtctttttgtacctatctcatagagttgttgcaagcactgatgacataagtgaaattgccttatcataatagatatacaacaaataccagttgaatttctattctttgaaggatgtagaagcagaaagatgcagaggtgaaactcccagaggccaaataggatgaaactttcacttacagaagagctcttagatagccaaagagagttgtgactttaagagacaccacgaggagggaatgaactccagggagcgcctgatctctagagtatgccacagggcccttagatccttttacccttaaaaattagaagggccttggggtctggggaagagcaagaggctgggattggcaaagccttaaggagagtaaccaggtattatagtcatgttgtgtccaagcactgtggtggacagtgaagtgattgacctgcctaattaaccatgagagagccatgtggctaaaaagtaaagtcaacatagaagtcctctacaaattaaaatgtagcctgcagtgtttcaaaactaataaagagctagatataattgaatcgcagaggattactggaagaagaataactaccaagaataggagtttccagtctattgtcacaggaagcctgggaaagaggggcaagtacatttaaggaacatcaaaaatggcaaaggaactcttagagaacctccagttctctaagagttccaaatttaaatcattccaaatttaaaacatcaaagcagctgaagccaaatcatatttaacttaaaacattcagcttacaaaatataccttatatcactctctgtctgaagtagtaatagttacacttaatgtattgaaccatattgaccaactagaagataaacctcaagaaccagattgtaccaaaacattttgaggggaaaaataccaaatctttgttagtatcctcataggtcctgcttactgttactaagaactattaaaactgttatttaatcctccctcaaagcctgtgaaattagagctactattaataaccccattatggttgaagaaactaagtcttaaagaggctaaataactttcccaagatcagatagatggtaattggcagacaaggcctcaagcccacatatgtatgatagcaaaacccatgctcttacctgttgttggaactctttgttgagatgtatataacgtgtcatcatttaaaagctcacgcttgtatgtgtctattaagataagtatatcaaggctgggcacagtggttcactcctgtaatcccagcactttgggcggccaaggcgggcgaatcacgaggtcaggaggtcgagaccagcatggccaacatggtgaaacccctgtttctactaaaaatgcaaaaaaatagctgggcatagagatgggtgcacataatcccagctactcgggaggctgaggcaggagaatcgcttgaacccgggaggcggaggttgcagtcagctgagattgcaccactgcactccagcccaggccacaaagtgagactccatctcaaaaaaaaaaaaaaagatatcaaaacatcaagttatacaccttaaatatatacaattaagaaagactatagtaaaaaaattcagactgaaaaatcaacaggaaacaaacctgatatggttctcagaaaagatatactttccaaaaggtagataaaatatgatacagattctattattgtcccaaattaaggaaattttagtgcatctaataagataagtaatatataaaagagcctaacattttccctagtatattataacatagtaattattcaatcaacattcaaacaactgtatattatacagtggtattttgtttggtattttctgaactgaaatgatagcagctcccaggaaattgatataaagtcagtctggatctccatctaaaacatagtgtccactttgcaaccttcagcctgtatttggggatgcatacttctgtatatagttgtttgacagttttagtgatgctgggctcctaataatgtggatattagtttgctctacctaagtactgtactgaacactgcatttctgcattgttaagttgtcatttctaaactgtatgaacaatataaagatcaataaagtcttaacttacaattttaaaagctgtggtactggacatctgttcagtgccaatatgacttccatatacaagaaatgcacacagagaagaaatcctgaaaactgtagattgttgactcttacttgaatatacttgatacggtttggctgtgtccccacccaaatctcatcttgaattcccacgtgttatgggagggacccagtgggaggtaattgaatcatggggggcaggtctttctcgtgctgttcttgtgatagtgaataagtctcatgagatctgatggttctgtaagggggagtttccctgcacaagctttctttttttgcctgctgccaatcatgtaagatgtgacttgctcctccttgccttctgccatgattgtgaggcttccccagccacatgcaaccataagtccattaaacctcttttgtaaatttcccagtctcaggtatgtctttatcagcaatgtgagaagagactaatacaatactgagagtatcatgtataacattgttactgaattgtaaactcaaaaaaaaaaagcagataatttgtctctcgtttgccaatttttttctctaaggcagggttttttaactttgacactattgacattttggactggttaattctttcttgtagggggctgttctatgcattgtaggatgtttagcagtacctggccccaacccactagatgtcagcagcacccctctccagttgtgacaaacaaaaatatctctagacattgccaaatgccccctcgggggaaaattgcctccagttgagaaccactactctgaagaataaaatagcgtgtggcaaataaaagacactcaccaaatatttttggattgactgaagacaggaaagaacagtctcccacaaaatgtaccacttgtgatatgctttgaatatctaggtatgacctggaaaaatttctataactttaatagttatgtattttatatacattagaaaatatataacatgacaaacccatgtttttgcctgctattttataggacagtgctaaagtcgatactgaagttaaaaagtaacttaattgaaagaaacattaactgtacacaacagatacattaaacacaactcatcaaattgattaaggtggtatgtgaattactggagtttgaagcactcatttatactaagggaaacttaagcacaaatgagcttcccctaagtctggtttgtgtaggccactagaatcctctttgggaatgatctactgccttgcacaggctagatacaggtgttgaagacaaattgcttactctttgagaattagtctgatagacactataagatatgaacatcaggatgaggtagcattatgagagttcaaaggaaaaagaaattactttctactcaggtaatgagggaaaatatcactattgatattgaaggatgaatggaatttttgtagtagataatacagaggaaaagagcagaggcaaagagttggaccagttcaaaacatatttaagggatgagtagaggctggtttggctggagtgtagtataactattaaggaaggtggaacctgcttgtagagggtatgtaatgccagggtgggttatccatagaacaaagattatttgattttctaatgtctggctaaaagctgctttgttgttattgtttttaagtgtattgtcattattttagaagtaatgtttagtttgggatggggacctgactgagaatcaagataaataaatactgctgcttacagaagtataaaaactaacacacacacacacacacacacacacacacacacacacatacacgctgaaagaagggaccagatgggggcagggcacagacaaacaaaaaaatagcagtaacctctgcagacttaaatgtccccgtctgacagctttgaagagagcagtggttctcccagcacgcagctggagatctgagaacgggcagactgcctcctcaagtgggtccctgatccccgacccccgagcagcctaactgggaggcacccccccagtaggggcggactgacgcctcacacggccgggtactcctctgagacaaaacttccagaggaacgatcagacagcagcattcgcggttcacgagaatccgctgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtatatcaccatcatcaaagaccaaaagtagataaaaccacaaagatggggaaaaaacagagcagaaaaactggaaactctaaaaagcagagcgcctttcctcctccaaaggaacgcagttcctcaccagcaatggaacaaagctggacagagaatgactttgacgagttgagagaagacggcttcagacgatcaaactcctccgagctacagaaggaaattcaaaccaaagacaaagaagttaaaaactttgaaaaaaatttagacgaatgtataactagaataaccaatacagagaagtgcttaaaggagctgatggagctgaaagccaaggctcgagaactacgtgaagaatgcagaagcctcaggagccgatgcgatcaactggaagaaagggtatcagtgatggaagatgaaatgaatgaaatgaagtgagaagggaagtttagagaaaaaagaataaaaagaaacgaacaaagcctccaagaaatatgggactatgtgaaaagaccaaatctacatctgattggtgtacctgaaagtgacgaggagaatggaaccaagttggaaaacactctgcagggtattatccaggagaacttcaccaatctagcaaggcaggccaacattcaaattcaggaaatacagagaatgccacaaagatactcctcgagaagagcaactccaagacacataattgtcagattcatcaaagttgaaatgaaggaaaaaatgttaagggcagccagagagaaaggttgggttacccacaaagggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactcaacatggaaaggaacaaccagtaccagccactgcaaaatcatgccaaattgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgttcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaaaggatcaattcaacaagaacagctaactatcctaaatatatatgcacccaatacaggagcacccagattcataaagcaagtcctgagtgacctacaaagagacttacactcccacacaataataatgggagactttaacaccccactatcaacattagacagatcaacgagacagaaagtttacaaggatacccaggaattcaactcagctctgcaccaagtgggcctaatagacatctacagaactcttcaccccaaatcaacagaatatacatttttttcagcaccacaccacacctattccaaaattgtacacatagttggaagtaaagcactcctcagcaaatgtaaaagaacagaaattataacaaactgtctctcagaccacagtgcaatcaaactagaactcaggattaagaaacacactcaaaaccgctcaactacatggaaactgagcaacctgctcctgaatgactactgggtacataacgaaatgaaggcagaaataaagatgttctttgaaaccaacgagaacaaagacacaccacaccagaatctctgggatgcattcaaagcagtgtgtagagggaaatttatagcactaaatgcccacaagagaaagcaggaaagatccaaaattgacacactaacatcacaattaaaagaactagaaaagcaagagcaaacacattcaaaagccagcagaaggcaaaaaaataactaaaatcagagcagacctgaaggaaatagagacacaaaaaacccttcaaaaaattaatgaatccaggagctggttttttgaaaggatcaacaaaattgatagactgctagcaagactaataaagaagaaaagagagaagaatcaaatagacacaataaaaaatgataaagggaatatcaccaccaatcccacagaaatacaaactaccatcagagaatactacaaacacctctacgcaaataaactagaaaatatagaagaaatggataaattcctcgacacatacaccctcccaagactaaaccaggaagaagttgaatctctgaatagaccaataacaggctctgaaattgtggcaataatcaatagcttaccaacgaaaaagagtccaggaccagatggattcacagccgaattctaccagaggtacaaggaggaactggtaccattccttctgaaactattccaatcaatagaaaaagagggaatcctccctaacttattttatgaggccagtatcatcctgataccaaagccgggcagagacacaaccaaaaaagagaattttagaccaatatccttgatgaacattgatgcaaaaatcctcaataaaatactggcaaaccaaatccagcagcacatcaaaaagcttttccaccatgatcaagtgggcttcatccctgggatgcaaggctggttcaatatacgcaaatcaataaatgtaatccagcatataaacagaaccaaagacaaaaaccacatgattatctcaatagatgcagaaaagacctttgacaaaattcaacaacccttcatgctaaaaactctcaataagttaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagtgcaattaggcaggagaaagaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggataaaaaatcaatgtacaaaaatgacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaatgaaattaaagaggatacaaacaaatggaagaacattccacgctcatgggtaggaagaatcaatatcatgaaaatggccatactgcccaaggtaatttatagattcaatgccatccccatcaagctgccaatgactttcttcacagaattggaaaaaactactttaaagttcatatggaatcaaaaaagagcccgcatcaccaagtcaatcctaagccaaaagaacaaagctggaggcatcacactacctgacttcaaactatactacaaggctacagtactcaaaacagcatggtactggtaccaaaacagacatatagaccaatggaacagaacagagccctcagaaataatactgcatatctacaaccatctgatctttgacaaacctgacaaaaacaagcaatggggaaaggattccctatttaataagggctgggaaaactggctagcgataagtagaaagctgaaactggatcccttccttacaccttatacaaaaattaattcaagatggattaaagacttaaacgttagacctaaaaccataaaaaccctagaagaaaacctaggcattaccattcaggacataggcataggcaaggacttcatgtctaaaacaccaaaagcaatggcaacaaaagccaaaattgacaaatgagatctaattaaactaaagagcttctgcacagcaacagaaactaccatcagagtgaacaggcaacctacaaaatgggagaaaattttcacaacctactcatctgacaaagggctaatatccagaatctacaatgaactcaaacaaatttataagaaaaaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccataatgagaaaccatctcacaccacttagaatggcaatcattaaaaagtcaggaaacaacgggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgtggcactattcacaatagcaaagacttggaaccaagccaaatatccaacaatgatagactggattaagaaaatgtggcacatatacaccatggaatactatgcagccataaaaaagatgagttcatgtcctttgtagggacatggatgaaattggaaatcatcattctcagtaaactatcgcaaggacagaaaaccaaacaccgcctgttctcactcataggtgggaattgaacagtgagaacacatggacacaggaaggggaacatcacactctggggactgttgtggggtggggggaggggggagggatagcattaggagatatacctaaggctaaatgacgagttaatgggtgcagcacaccagcatggcacatgtatacatatgtaactaagctggacattgtgcacatgtaccctaaaacttaaagtataataataataaaataaaataataaaataaaataaaataaaataaaataaaatgaatcttaacacacacacacagacaaaaaagaagggaccagagactagaacagcagaggatccgaatggaaagatcattccatcagaagaagcaaggaggtaacctgggcctgggggagtttggggcttgaggtgatatgggtattaggccttgagccttttatctctctaagaaaattgtcttatttaaaataagatgctgatctttggaagtttattactgaaacgctcggtgaggtggctgacatgtagtattgatttttgcctccttggttttatcttcccctggaagatggctgcctccagtgatgcttgttgtctccaccatgctgacctctggagcagcaattcctctttgaaaatcctggcccatgcctgacagctcgttcctttgtggtttttcctaacacaactgaaataggtttgattcttttctaaaagactttattaaatattaaagaataaacaaaaaataaaatatgagaagtcctgccagatttacctagcatctctgatatcactgtccctggtcaagccactctcacacctcaaatctcctttccctactgctgccagaggtgtcttctttaaatcccaatttagctatatcactaccctgtttaactctttcatgcttctcattcgtacatggattatattttagtatattaactttcttttggtatttcctggagtaaggatggttttatagttatgttgacataatgattatttcatttatctgatttgaatgggttacagttaaaattgagatgacacttgggaagggtgagcaccttcctgtaaaaaggtatgagttctaacactttcctaaaggtttcccagaatagctttatctgaagggtcaggagtcactgtatttcaaattgtgcttcctatagtgctaggtttctgatgaggtatgtccaggccacctccagaaaaaatctcaatgggtgagactacaaccctccaccccaattctgcctgaagagttccaccctaacccattttttatatattggtggtccgcataaaattttttgagggctgtctgctgctttcaaaaaagatgtgttgatgagaagtcattagatgatttctaaagttcctttcaactccaaaattatctgagaatccagcccccttgacttctttcttgattcactttatgctaattttgttccatatgattaaaataatagaatttcagagctgcaagaaactttagcagttatcttgtccagttttccaaaatgagctccaaagaacaagactcctgagaaacgcccatcgcttacagaaaggactgtatagctaaatattttgagactgtacttttgtcccattgctcattagcattttaaaggctctgaaaagtcttataataaagaaacctgattaaattaagtcggtatttcctacatgggaagcatgggctctgtatcaacttactatgaccttctttatctggtactagtttctgccctattaccagatcaaagagctctgtttttgaataacacactttttaacatgctgtggaggataatttgggaaaactcatatagttgagcctcctccttttgcaaagaatttatgataggaaatgattgatcaagtgtcacacagctgattatcaggtctcagtctaatatttattccttattggtctctgcttaacttcaagtaggttatagattccttaatggactgatagtttatgtcttatagctttacctttcaggcgcttagtttcatattgggaacatgacaagtgaataataaatacatgatagctctatgattgaaccctgtgagaaaatgaagcattatgatatgaattggtttctgtgtatgtatgagtgtttttttttttcatcttttggaaacagaatttctgctcccctgtgtacaccctttctctgtaattgcagtgtatgttttttgtttctccaaagtttctgttgtcagtagtttatgatcattggttcatactgtttattggaaataactctgtgggctgctttgcctcagggctaatttgattagggatgctgttgttttacaccgtttgggaaaatgttacactttaaagggtattggatttgtcacagaatgatattgaagggaagccggagacaggaaagctagtaacttgctggcctggttattagcattggaccttttgggatttttgtctgccatttttgttgatactgctgttttctgaagagataagtgtgtgaccaatttgaggattgttatttggcacacgcagaaactagtaccagataaagaaggtcatagtaagttgatatagagcccctgcttccagaatattgtgcttctgtcctctgaggttagattttctctttgtgagggagaaaacatttatgtaagggagaaagattggaatgtactgaaatgaaatgctcacattgaccacatcagctgtactggagcttatctgatgtagccactcagcctctatcaatctgactgtgtgtatgtgctctgttttgtacagggaatcatcatccagggacgtgccagaaaccacaagaaaacatggggaggggtaagtttctcttcctttttaagtaattcagactgtctccatagctattatagtcaggaaattaaatttctaactcatagtatatttgtggacacctaaattgtatttcttgttagtgttagaaagtttttgtctgaagcagggcttttcagagaaagaccatcaaccacatttattcactggatctttgattttcttcttttgtagagacctcccagtatagggagagatggatcaagcttgatactatatatatagtatatactattttatatatataactcacagatactatatatatacaccttccccaaacccagcttctttataagtcttttttctgttttctgttttcttgctagtaacacaaaataaagagagtctactatgcagccaataacagtagtaaaaaaaaatcatctgtgaggttgatttgtaatttttttaaaaattttaaagcccggcattaagaaccattagatgaattccttttgtttatttttgccttctcataaggctgtttatgggcagtggacaacagataaatttaagttcatttcattgttaatattaagcagccaccacagggacttcataaataattctaattaatgtatatcatgtcaacctaaaataatcaaaagggtcagaatctagtttaaagagtttatttgagtgcaaaggttgaggacggactccaaagaatggaaatcactgtttccagttgtagaagtttggggatcactcgaatagacaaagtttaggatattttaacagaattttaacatctttctatgtaaggcttactgcatagttacaatgacctgattgatccgggtggtccttttctttcaggaaaggtatatttaacattccacactgaagatgtgattgtcatggggtctctgtttggggcaccatctggtctgagttaggtacaggataatagagtagcaaagatcagtgactgaaagggggaggtctggcctctggtctttgctattcatttacaaaacaatagcaatgaggaagagtgttaaactataacctaagaaacagaactgcaaaatgttatgtgactgaaaccacagtcacatgtctcccaaggcttaaagtgttttggggggtcccaacagcttttacattttattaattttcacaattataaaattagaatgccttgaaggatctcagaggaagatttggtgtgtggtgtggtatagtacagtgagaagaatactggatacagaaggcctgaattcaagttccacctctactaccttgatcaaatcctagaacctccctaaactcgtttgttcatccctgaggtgggattaatacattctgcacttctagcctcagaaagttgtcgttggcataatgtgataatacatgtaaaagtgttttgagagttctaaagtgtaatggaatacagcagtggtatctgcccattactgtccttactaactatatcttcattgtttttttaatggataaaaatgaggttatttgaccagatgcttctgtaggcagcatgactgggacttgggtcatgcaagcaactgagaattcttttgttgcactttgcttgccccacccttgtgtgggccctggtaggaagccctaaggattatggatcaatcatggaaaatatcttcttgaatcttgctgaatcagcttttgttcctgttttctccagagctgcccttggaaattgattaggcctagctattctggttctttccagatcttcacaaaagatggcaatctctgatggtttcgaaattttaaaactaaatgaactttttaaaaactattcggaattctgggactaatctgtgccacgtcctgcccgcaaatcagctctcaatggaagcttctagagtagtgatacggctccaatgactgggggaactccagggtccttagtctcatgtcgagttagataaaacgacacagatacacgtggagtggttttaagtagtggagagtttaatagactagaaagaaggaagaagctccctcctacagctgagagaggaaacctcgaatgtggtggaaaacagccagttatatgaggaggctggaggaggcagtgtctgatttgcatagggctcaggggattggtttgaccaggtatgtcgttgacatagcctgcgagaaaactggccctcccaccctagcgttttaatgtgcaaatgtatccccatgatgttctacacatgtgggggatatgtgggggtggccatgttgccaggaacatgttggggcaaggggaagaagatggtgggaatcgccacgtttgtgtggacccagtttccagtggcaggtatttgcatatcaaagcttgccggcccaactttaagagcctgggctttcccgctagacaagaaacgtttctggagcagctttaaaagaaacaaaaacttcccaaggaccccctttcctatctattgcctaaaataatttcttagtaactcctataacattagaacatcatgtttgatcctcacccaatcccaaaagcttcaagtggatttggagaatgttctggttgttggatactgctatagccatatagaggagagagctgcactgagacgaaacccgttctttctcatttcctctattcatttttagactgctcatcaggtcactagcaaagggactgttaggtgcttagtttagaagatgtctcagcaactttttgttcaaatggtcaggcaattagtagttgacctttgaacaatgtgggggctagggatgactctgttgcataatcaaaaatccatgtataatttttgatgcccccaaaacttaactactaatagcctactgttgactgaaagccttaccaataatataaacaattgattaacacatactttatatgctatgtgtattacatacagtattcttgtaataaaatacactagagaatagaaaatattaagaaaatcataagaaaaagaaaatgtatttactagtaagtggaagtagatcatcataaaggtcttaatttttgtcatcttcacgttgaatcagtggaggaagaagaggaattggtcttgctgtcttaggagtggcagagactgcagaaaatttgcatagaaattaacccgtgcagttcaaatatgtgttgttcaagagtcaactgtagttcttgctaaagaacagggcatggtaatgtaatctgcaaagataggcatgtttccaggctggtgatgagataagggaagtgcttcaaagaatgctgcttttacaaatacagaagcttgtgatagcattttcactgtgttgaccactttgaaagtatttgtaatatcctgaatctcaaagagactctatcctttactctctaagctttgcttagtttgcctgattacatttgttaattgctgacactgttattggggagaaaaagatgctactgtatgctcatttttctcttttctggcactgtacaatgaaatttttcctgcacttggcaaagattctcacaaacgtagcccagtgtatcatacagagggacacagaggaaaaatattgcaaagatatgacactagcctcataacataaattaaggatgcatgaaaacaaaaaacacacttggataactgtacagtttaggtgagaaattaaaactgaggtgaatttcttttagcattctttgatattagatgaagaagttatttgtacatatgtgttagaagaatcattcgtttatgtgacatgaaggattataaacaaaatttaaatattaaggtggggaagatgagaacagccttgtatatttaattttttattagtctactactaccagtgtccattgtgtgtggcactgaaatcccattcactatgtatgaattcttaaacagggcttagtatttaggactcttaagaatctataattattctgagattaacacatttctgtagagcactttataactcataggtattccctctacattatcttgagttgtaagacaaccctatgttgtaaatagggattattatcctcattttatgtattataaaactgaggctcataagaaaaagtcttatctgtaatccacagactactaatggagagccaaaatgcaaatctaggtcttatgttacatccagttttttttcttccaataaaccatgttctgcatatcttaatcatcagtagtgtgtaagtcaattaaaaacttaggagctctctgttgctgtgagaggtatggaagaaattattttttgatatctgcaatgttcatattatcatgagggactggacagataggcgaagggaaatggctcattgttcatcaacctttagggtaacagctaaaatacatgtgtatcagatggtggagtgcctcaaatattaaaatcctctgagcagcagtggtctatgtctgtggtaattcaaaaggcagctacactgattggcagtgaccatagtagataacaaaacaactcagttcagaagctcgtgctacacagtccacaagggaaggtgcctaaagtaaagggcctgatgccgcttacctggcctatgtgaaactcacccgtttgactgatgagtttttatctttgttgcttttgttgacacaaggaatataatgcatcatggaacaccagaatagcatgagatgacaagatgagatactggttcaaaaatgaacagcaggtataaataaaattatatgtaaaattctagtagagaacatttttacaaagagaatgtgaggattttacaaatgtgtatgtatagactcacatagcattataatataatcagccttccatatctgtaggttccacatctgtagattcaaccaaccatggatcgaagttatttgagaaaaaaacaaaaaaataagaatacaacaataaagtgcaaataaaaatacagtatgtaaacatagcatttacattgtattaggttttataagtaatctagagatgatttacagtatacagaaggatatgcataggttatatgcaactactatgccattttatataagggacttgagcattttggtatctgtggaagtcctggaaccaatccccagtggataccagatgactgttctaggatatttatctttaatcatcttcaaatggtaattagaactatattttaccttttcatttctcatctgaccaactggcatattcatgataaaatggtaaaaggcccagtactcccagtaagtattatctttacctacaatgaatatttttcagttttcttgctttaaaaattttgtgattattgtttttattacagtgtttcggtagaatttgatttttaaaaatatagctactttccatctgaatttttttctatctcagaacacatttctattactgaatcttctaagtgctgtagtttgtggtatctgctagcctcatatgaagttattaatggctattttcactgtctaccttaaaagcagagcttctgggagaagttcatcatgttgtcttgataatagcaaatcatgagctagctgctcgtacacatcttccacaaaataggaataatacttagccatgaattttcaaaaggattaattttgctttgttatatacaaagcaatatctggaatagcttaatgattgcaatcaggcaggtctactttgtggaggataatctgaattaaaatatgaagataacttaggattttttttttctgtttctcctcttccagtatttagtctttggaaataggtcttacctacctagcttagaagaaaatcttaggtctataaaatcttaatatgaaaagtcagtttccattttcattttctgtacttaatagtaacatgaccttaatgtcttagcataaatgaatttttatggtcgtgctatagcaaaacagtggtagtgttgccagttagtctttgtttcttattaaaacatagcagcataattcctctgggtccttgcatgtgctgggctcctttatcccaaggaactcaaacatatccccctagttgtcaagacttagtggaaggcaagatggtttacagccaccacagtaaatacataagttctttaattcactgctgaactattgttaagttgaagccaattctaaactttaactgagtgtacagctctatattgtcaaatagggaatgaaccttcaaactgacaagccctgtaaagtaactgtcttataatgaagtgcctaattttatttggctttatggttcaagtgaagttatccatttaaagtcaattaattatttcatttttctggcctatattagatttgagagtctctttattgtgacatattcaggcctctttagtttagatgatgtcaataatttattataaattcttatcttcagaattttataacagtaatacgaatttgcttgtagctgacaactgccataattttttcttggcaagtttttctcaccagaaaaaaaaaaagaactaacggagaggttacttttaaaaaactcattatagtgcttgatgctttttgtctttgatgcaatcctctctgccatttacttattaaagaagaaaataacctttggcacataattttagaaaggtttctcaactttagcactattgattttttttaatggaggcaaaatttatataacatagacttgactgttttaaagtgtataattcagtggcatttagtacattttgtaaccagaaggttgctgtgctgtaaggaaaatagttacaaaatgtactaaaggttgctgtgcaaccttccagttataaaacattttcatcacttccaaaggagatcctattcccattaagcagtcacttaatcccttcccattatcaacatcccttaccagagaggtacatttgttacaatcaatgagattacattgacatgtcattatcacccaaagtccataatttacattagggttcactcttgttgttgtatattctatgagtttgggtaaatgcgtaaagaatgacatgtacccaccattatagtattatacagagtagtttcactgccctaaaaaaaaatcctctgtgtgccacctattcatgcctcctgcccactccctctccacccctggcaatcactgatctttttattatctctgtgattttgccttctcagattgaagagaaagaagccttctcagattggcttctttcacttagtattatgcatttaggattctttcatgtctttccatgatttgatgcttgtaaattctcaactgtttgggggtaaatatcaaggagtaccattgctgtatcatatggtaagagtatgtttagttttgtaagaaaccatgaaaccgtcttctaagtggctttactattttacattcccaccagcaatgaaagagagtttctattgctccatgtccttgccagcatttgatgttgtcagtgttctagattttggccagttaaataggtgtgtagtggtatcttcttgttttaacttgcaattccctgatgacatatagccatgagctgcataatgatgttttcttcaatgacagaccacatatatgaaggtggtcccataagattatataccgtatttttacggtaactatcctatgtttagatatgtttagatacacaaatacttacattatgttacttacagtattcactgtattcagtaagttgcttatagtattcagtacagtcacatgccatacagttttgtagcctaggagcaatgagactataccatatagcctaggtgtatagtaggttatgccatctaggcttgtgtaagtatactccatgatgtttgcgtaacaacaaaatcacctaacgatgcatttctcatgatgcatcctgccgttaagcgacacatgaccaaatgctgtggagcatattttcatatgtttatttgccatccatgtatcttttttggtgaggtgtttgttaagatctttggcccatttttatatgcttgttttcttactgttttaagagttctttatacattttggatagcaatcttttaccagatgtacctttttcaaatgttttctcccactcggtggtttgtcttttcattctctcgatataatggtgttttttatagaagtaagttgagtctaaaggagagcagagtatgattctggagaccaaggtacagtcctagtcctatcatcaagtagctgtggctttgggtaagtcacttaacctatagatttcagtgtagtgttctggtcagcaaaatgaaggggttaagatggatcagtggtttccaatgtgttcggtgaagccacagatcttctaaaggggcccctgaggggccaccatgagggaagagaggaaaaggaagtgcccctggtacataacacctctccttcagacagaacaactgtactacattgtattttatctgtttttatttcatgataggttgatttgcagaggatcctatgactaataaaatttagaaagctaccagattcaatgactctcaaagatctctttcagttctgaaaatctgcgactcatgaacattaattaccatccaccttttgaggctgtattaatgtgtgaacagataggaaagaaagtgatagaggaactagtggaatagctaatgttatgtgcttctctgatggtgacaaatcattcactctctatttcatggatttgaagtatataattcttgttccaatgtggcctatgtattaggttgaaccataggaacctacacttaacatattacgttgaaccatatgaaatggccttcaaaaactgtaatttcatgtacttcaaccaatataaatgcagtatgcatagggaacccttgagttcagaggcttcttaaagcatctagatcgtatatgtataaatgaattaattaaaaatgtgtcgcagccagacgcggtggctcacgcctgtaatcccagcactttggcaggctgaggcgagtggatcacttgaggccaggagttcgagaccagcctgaccaacatggcgaagccccgtctgtactaaaaatacaaaaattacccgcgcacggtggtgcaccctgtagtaccagctgctcaggaggcttaagcaggagaatggcttgaacctgggaggcagaggttgcagtgagccgagatcatacccctgcactccagcctaggtgatggagtgagactctgtctcaaaaaaataaaataaataaaaatgtgctgatttcatgggtggttaacagtccactttggaaacaaatgagattccagaattctacacatcagcccaccacctcctttgggattgatgtacatgtagaatcaataggaagagtttattgaatataatcaaaatcaatttggcttttacaattgctacattctttttggcaaatgtcagtagctgccaatagttaaaggcatgtgaggtctaggctccccacaatttgactaccaggttacaactaagtcttaggccgaattttgctatacacggacatttatcaacaagatggcacagttctgccatataacttattatataaactctatgaaatcctatttctttccttatttaggatctcccacaatatcttagataaaaagttcatctaaggcatatgtgacagcattctagcaatggtattcagctaacccatctagttagattaaagcaatcaagaatccttcatatcagcaggtaaacatgaggcctttcaggaatcaagtcttggccaccattcctaagggtacaaactgcagaggctttagatttttctactgtgttcaggcacacccttgactgctgctgtcatttctggagcaaattcacataaaaacatgtctttcaccagtgaaaagtcatttgtgaaattcatgttagtgcttactaacaatagcactaaactcctcaatgaaactccatttcttaaatccatcatgctctattgtgggctggagagaaagatagccaaatgcgtttgtagtagctaccttagaaatgtggctgtttcgttaaatgtaacatgtgtcctactaggacagttatccacttctagagtctagattacaactatcacatagaatacctatcctacagtctatgctgatgagttgtaaagcaatcattgcaatataaaattatgcattataagctatatttcatcttgtgagttttatctacctgtctttattttctattaaatggtgattattagtcacagctattaccatagtcttctatatgagatagaatgtaatcagtatagatagggtccataaactagaaaggaaatcatacggttgtaacaaccgcaaacatcaagactactgatattgctgctggtacaattgaggcaccagtaagagtagaactagctatctttggagttctcctgttttggtgattccatctgattgtgtgcttagtcatgacaaattacactaataattccatatttgtttgtttcttgggagcaaggcattgctcttggttcagaaatatgtattagaataccatacctttaaatcagtttacataattgctattaatttgattggtgtaatctgccatttcatgacgaattctttttgataagaagtagttataaagtttaaaacccctttaaagaaaactttgccttttgccttcctctgtgggagaatatattgcgccatttctctctatgtcctttttccttacaaagcataaaatcattagatgagagacatctgaatgtattctctgaaatttggcttttaagtataccatattgagatagttagtgtcactctggtgggaaccatgtttgttttatttttaaagaatactgactttatagacacactttacctcttttgtcatctctcatagaaatccatttctggcatattatccacactttttccaggaaacctacctgttatctggtatttcattgtatgcctctggtactacagatttgtttaagttttaggtaatgatcataactactgtatggtccttagggggcagatttcaggtattaaatatattaataatcattatttttttctcagtctcttagacttcccactcccactagctcaatcctgcaacttccaattattttttaaatatatgagctttttaatgggtttcagttccctcattcctgtgtaaacatatactatatgctatactaaactctaagtttgcaaaaactggttgggcacatgagtaccaccatacaataaattctgaattattataaacatatcagctatgaaaagttaacttttaattttcagaaatagtttaacaatggtgaaataaattgggacattgtacatatttccaccttcctaagtaaaaataggaggatgatttaaatagtgtctttttagtttgcttaattttgttttttagtaagtgaaatgtcacttcagagtataagactttgatttcctaggaaaagttgtttccatcagtctgtgataagaagtacctatttaacacctatttcagcagaaaaaaaaagtttgaaggcattatatgcagacacaactgaataatagtatcaaaatgacttacaagcgagaaaacaaagaattatgagtttgacacttcataagatgtttaaaaaataaagctaagcacaggattgggtggaatgggtgcttttttgattttctctgtttgtttgtttattattggtttgggatatggtgattgcttggctggaaaattgtgtattaatatcccaaaaggattcggatccaatacactactcccacttcctgaaattctttccaattatagaactctttatggttacaactgaaagtacttaagaaatcatatccaacacctttgcttcatcaattaggaaacacgttcagataaattaagcaacaaatgtaggatcaggtagccagtttactgccagagctgcaacaggaatccatatatcccgactacaaattcagggcctttttaccataccacactttttccttatcctatagtttcacttgcctcaatgcagggttggtgaaaatggttaatagatattggctctcttagacttcaacaacatatctcaaaaggcagctttcatgtgacaaacagaaggctcgaataagcagagagctttgcatgttctatagtcttgtatgagaaatttacaattaagctggattactagagatttattcagaaaagaaatcggcttccttgttaatttgtggactctgtagattcagtctgtggtacagcaacatttatacaatactgggaaaaaattttcaatttgagcaaatatattttgcagattgaggatgcttacctttttaaacatgatttaaaagatttttaaaaaccatatttttatagaaatagctctaaattagattatataatttactgccttcttgaacatcatcctgaacatcatatagccctttattggtaactcacattcaccattgtaaacataatcattgatgtctatagccttgagagctgtcagtgtgatggagtttagatcctactctaaataacccccaaagagccttctgactctcttttcccttgccttcagattaattagctttcacttctgttggctttcagtatgttgatctagttcagcccaccctgccccttttgctttctagttttcatgtgcaatgaggctttgaagtctcaggagccaggctcctgcacatggatagaggaaactgacctttggttagtgtaagaagttgaggttcccctgtagataaagcatcaagtgagttgtaatgtatgaccttggtcatctcttgtgtctaagttcatgagaatgagaatgggtttatttgagcaacttttgcatttctgcataaacgaggtattactgtcattcatatctgtagtgattatgtaaaacattgaatagccacccaaactatcaacctaaagttcaataaagcatattttgttatagttacttgtgattatctaaacatacatatctgtcatgtatgtaacttttctttcataatctatcctttctaagagcttatttgtggtctgttgttaaaattccagtgatgataagctatcaacatatatttgaccaaagttgaagttaataaaagcaagcatatacattatggcaaagggtatttcctcacaagtttgttataagtatcaagtccttataataaggaccatttctggaccatttcttgagaagaagttctgaaattttaaaatctcatgatatccccaaaatatttatgaatcataaaagtatattgtagcaactatacagcattggttaattgaaaagacttataagattctacggggtatattctcataaggctttaataatggctcaaggtatggtacagcaggagagagatcactcacaaggccatttttagttgcacaggacacatttgtcttctaattgtgaaccaccaagattatgtgcaagataaccttggtatcgggagctaaggctcatgtgtacagaagatctttgatatcccactggtcatgtagctgaaactagactatgtaatcaattagtcaggtgcaatcagcctatatgttttccaaaaacagttcaggacaagctactacagtgtgcctccaagcgaatttgagacattaaatagcacttcataaagctactacatgtcatcccagacttgaccaaggagaccaaactcccaggcattcctgaagttaaggagacagactcacggcaagttaatcctatttattctatatttcctaagtgtatttttattatcagcttgataaatatcattttttttatttcacagaataactgccacaatggtaatgacagtgagtcacactactacttattgtaaatctgtttttttgtcaagccctgagcaaagcactcatttataacttataacttgagattggtgttattttttcagttttatagatgaataagtgacgcttaggtttttgttttcttcacatggctatttgttctgacaaccctttttctttctaactagtgcacactaacaagcttgggatatccataagattaaattgattactcaaaacaaccacaaggctccccccatcaatgccataatgtctttattccttttctgactaaccttgttcccacaagaaatccaataactccagggttgcacaataggtctagaggagaggccctgactcttgaattgaagaagagctatggaatgctaggttcatttgtagaaagtcctcattctctgttcttgatgttcttgctactgtttgctactgtttctggtgtatagtcttatatcaaaaatagggcacctatggccaggtgctatggttcatgcctgtaatcccagcactttgggaggccaaggtgggaagatggcttgagcccagagtttgagaccagcctgggcaacatggaaaaaccccgtctatgcaaaaaaaaaaaaaaaaaaagaaaagaaagaaaaaagaaaaaagagaagtcaagtgtggtggcacacacctgtagtcccagctactcaggagactaaggtggaagggtcgctttagcccaggaggcagaggttgcagtgagccaagatcacatcactgcactctagcctgggctacagagcgaaactctgtctcagaagtgaataaataagtaaataaataaataaataaataaactaaggcatccaaaccacaaactcacacacccaccagaaatatgcctgccttctgaccttgaagaacatccgtcatgttcagtcttacaatagagctctttgtgtatctcttttattatatctttgttacctcttgcactgaagaaccttgagggcagaggtcatctgctacccatctttgtgacttgttgcatccacttattttatttatttttattattttcttttgaagagaaagcatggatgagagcttatttattttgaaattatgaaaaagtggttacatttttttgaataatatacttattttgtgtctgtgtatgtgtaaatatgccttaggtttgaaatattcaatttaataagagtatttcctaaccgaatctgaagaaaaaaggtttaggtttttctttatttcctttaatgggaaaactgcatgttttaaataacacctcagtattgtgttctcaaggcacatttacattctgtatacttgtcacatcatataatccttgattaaggcatgcacatgattcctgatagctgtaatttaactcacacaatttaaggagaaagaggcaattaaggaagtgatcactcaatttaaggaagtgatggactttagtttcaaacatcatggctttagttaaacatcctaacgcaagcccttgcagcctggaaattgccccatgtttttagaggagataatctgatttcatcctatagatcaaagctgccaccttctcccttattttgttttcgcattttaaaaaattctaattttaggggcacatgttctcaggatctcctgagggctgtgtcatgggcaaaaaagaaaataatctagttctggtatcatcatttagggtccattaggtttccaaatactttgatgagcactggcaaattctctgccactacttcctgttccctaataaatggcagacataactaatctataatagtatctttcctacaggtcagattcttactttaagtgatatcttctaatggactggatttggcaagtgagataaaatctacttgccagctgaatccatgtagagttcttagtattatattaccttgccgcccagtacaagaaatacatagaatatgatcatggaatgcttggtaatttgattagacttggattagaagctttgtgtcctgctgtattaccttccatttgcttattcttctaaattagactgctttctggttactggagtcagtggcttgctttgactcacctttttgagttggatagcatataagaaagtaattatctcttagaagcatttagcttttttctcttaaaagttcaaaatacattaatgttgattgatttatcttcagaaaaactgattcgaaacccagggatatcttagaccacattaacatatatattgtctttaaaacaaggaagccaataatcctgaccagttttgcacttgtcagaccaaacacaaagtattgcgctcagcataggtcactgtattttgagaggaagatgatgcagactcaaatccattttctatggcaaacagatgaagaagcaagacatgtttattctggaaaggagaagtcccacgggaaaccatttactgtctttcttcatgtattagttggcctgttatatggaggagacttatgcgttaattcagagggtataaataagactaatggctaggaagttgttaaatcagtaaaatatctcttgaaaaagggtactatagtcaaatatcacaaatgcatgtatcatgttccttttcagatttacaaatacatgcatgcataatgatgtttcagtcaacaacagactgcatatacaatgatggtcccataagattaggagctgaaaagtttctattgcctagtgacatcatagcatcacagtgttaacacattactcacatgtttgtggcaatactggagtaaacaaacctactgcactgctagtcatataacagtatagtacatacaattatatatattgtatgtatatatatttattgtcattctggagtaaactccttctacttatgaaaaaaaattaactataaaatagcctcaagcgagttcttctggaggtaatacagaagaaagcattgttataatagcagatgacagctccatgcatgttattgtccctgaagaccttcaagtgggataagatgtggatgtggaagacagtgatattgatgatcctgaccctgtggaggcctaggctaatgtgtgtgcttgtatcttaatttttaacaaaaaagttaaattttaacaaaaaagtttaatttttaattaattaattttaatttttaacaaaaattaactttttttaacaaaaaagttaaattttaacaaaaaagtttcaaaagtaaaaaatacaataaaatttttaaataggaaaaaggcttatagaataaggatatatataaagaaaatatttttgtacagctgtacaatgtgtttgtattttaagctgtgttattactaaagagtcaaaaagttaaaaaattaaaaagtatgaagtaaaaacattatagtaagccaaggttaatttattactgaagaaggagaaacattttccttctttttattttcatttaattttattttttattttttaatttaatttaattttaatttttttgagatgaggtctcactgtgttgcccaggctggtctcgaactcctgggctcaagcaatcctcccacctcagcctcccaaagtgctgggattacaggcatgagttactgctcccagccaaaatattttttttaagaaatatatttttatacatttaatgtagcctaagtcgacagtgttgataaagtctacagtagtctacggtaatgtcctaggccttcacattcactcaccactcactcaggccaactttcaatcctgtaagctccatttatgataagtgccctgcaaactccttttatggtaggtgccctatacagtaccattttttatcttttatatcatattattcctgtatcttttcaatgtttagatatacaaatacttaccattgttataattgcctatagtattcagtatagtaacaaactgaacagatttatagcctaggaccaataggctatatcatatagcctaggtgactagtaggctatgccatctaggtttgtgaaaatacactccatcctgtttgcacaatgatgaaatagcctaacaatgtatttctcagaatggatccacattgttaagtgatgcatgactgtttatactaaatatatatgaagggccctaaaaagtcattcagtgaaagatctctttaaatttgttaaccctagcattccataaatacttcactcagaatgtttccaaggaactctcattagggtagtgattctcaaactgtggtaatgggagcagcagcagcagcatttcctggaaactggttagaaatgtaattttatagccctacctcagatctatggcatcagaaactctggggtggggcccagcagtctgtgtgataatcagtccttcagggattctgatgcggctaaaaggcaagaagtgttagaaaattttactgttattctccaacttaacagtaaccttttgctttccttcattacacttaaccacaatttgtattttttaaagttctaatgatattctatgaatctgtgaattcatattccataatcataatctattctctgaatttccttccttctgtacctcataaagggtcataaagggaaccctttatgaggtacagaaggaaatactcattgaaggcctatcatggttttcaccctggtataagtgtcatctagctggtgtcaatttggatactttaaagaatcctaaataatgagtccatatattctataaagtaaaatactcatttctataacaaagcaaaactttaatccattgctggctgtcattgtcatttttaaaagagcacataaaaagtttttcatttccttcaaaatgtttttcagaaaatgtagacttttttagcatcttgaaagatctgtaatgtgccttttcttatgtcagaattctataaattaggaaatgttctaatctcttgcattaacggagatgaaattctggtggcattatatttgtctctccaaacaggcaacattcttttagaaaaatgtaattgaaattgaacttaaaatgtatttgtatttaaaaataaaacatcttattttttattttttatattttattattattaaaataaaagcatcttttttacatggtttcataaatgtattttgaatgtttatatgaaatgcctctgtaaatcatgcagaagaattttctttttctaaaggacagtgaaatgaggttgaatgtgttaaagcatcacactatatttaactcaagtacatttagaacaaaattattattaggatttccatagaatgaatcatggccaaatttaacttctcacaatttttttttacctattcttttcatacaagttagagctctctgggtttatattactaggtcaactgaagtgttatttatttttaggtagagggacaaagactgataatctagagactggatttgatttggctgctgctgtctgtcagcagaatgccttggggtatctacttacagtaatgagtataagtagtgctatcattattagtatatttaaacacccatggtttgcaggaatgtgctgaagtctgaatataacatagttaattatgtcactgtccctgcccagggcaactgctattgaaaggacatactcacatcatgaggaagatagcagatacagtggtttggagctaagtgttacttcattgctgactcacggaaagaggtttaggatgttggctatgttttctaaagagcatctagcagttttcatctggtatatcaacttgccacataggttttttatacttatatttctttttagttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactgtaagtatgttggcaattaaaaagttgcacagatttgcctacctttttgatgtatatttgaaatctgcatccctgaattatgtacattgctagcaattaaaaattcctttgttaggaactcggaaaatggcatctaactagtaatattctgtgggttggagagctaggttcacttccccttgtgctggactgtctttgagagccccgttcctataggactctgctgagcgaggatttatcatcttggcgagtaggaaggatttgatttgcacaaagctttgttctagaaggttatagataatatcactttgcctaattacagagaaagtgtggaggaagctaatggatggtgatagtgttttaaaaggttttacttctcgtacaaaagaaaagacatccagacataccttcccactccgcgagaatactcctctttacttctctttactctagactacatgctattcaaagagagcaggaatgggacagcacaaggcaggggtgaaaagtctatagaactgctccacagctggaaattgttaccagaggtagccattgtataaagattcagtcctgggcagcaggaaaataaccctagatgctaaacaagtggtgtcacttatgctaaaaagatactaaatataccttaagagcagcagatgcaaaagttttaaagaaaggggtaagaggaagaagccacatcttagtcaaatcacagggttagaaatagggaaaagaatatatcatccataataccatcatgcaatcacaaagcacggttgaccttttattttctttccagctttttccctttgcatccgcttagtcattgttggttttattttattttattcattttactttttaaaaatagtatatgttcattgtagagaaatttaaaaatgtagtaacataaaatcacttgagtttttagcaccaccagttttataattttggtatatctcattctggcctatttttactacatagatacttcataaataagaaaaataggattgtagtagaaatagtgttttgcaccataaagtttttaataaaaactggctgaagttactataaaccataaacaaaacgtggtttttgatattgtgttttatcaaataatagaaattatagatattctactatggttttcacaaggctaatggctttttaccctactttatcattctcctttaaagaaatcgtaagaacttgtttgggatttattgttctaaaagtactttatacaagtgaataatattcttttacaaaaaaaatttattgagttatgtttgacatataaaaagctgtacttatttaatgtatacgtttctatgagtttggggataggtatacacctatgaaacaaccatcaccatcaaggccacaaacatatccatcacctcctaaagtttcctctcacccctttattattgttgtagttgtgttctgtgagtatggtaagaggacttaacatatgatctaccttcttagcaaaatttaagtatataatataacattgttagctgtaggtaccatgctgtatagcagatctccagaattcatttatcttgcataactgaaagtttatactgtttgctacttctcatttctttctccccaagcccctggcaaccaccattctcctctttgcttctattagttcaccttttttagattccatatataagtgagatcctgtggtatttgtctttctatgcctggcttatttcacttaatataacgtcctccaggtctattaatgttgtcacaaattacaggatttccttcttttataaggctgaataatatttcattgtgtgttgtattagtctgttttcatgctgctgataaaagacatacccaagactggaaaaaaaggattaattggacttacagttccgcatggctggggaggcctcagaatcatggcaggaggtgaaaggcacttcttacatggtggtggcaagagaaaatgaggaagaagcaaaagcggaaaccctcgataaacccatcacatctcatgatacttattcactatcatgagaacagcacgggaaagactggcccccataattcaattacctccccctgggtctctaccacaacatgtgggaattctgggagatacaattcaagttgagatttgggtggggacacagccaaaccatatcattctgccccggcccctccaaatctcatgtcctcatatttcaaaatgaatcatgccttcccaacagtcccccagagtcttaactcattttggcattaacccaaaagtccacagtccaaagtctaatctgagacaaggcgtgtcccttccgcctatgagtgtataaaatcaaaagcaagatagttatttcctagatacaatgggggtacaggtgttgggttaatacagaccttccaaatgggagaaattggccaaaacaaagggtatacaggccctttgcaaatccaaaatccatcaaggcagtcaaatcttaaaactccaaaattatgtcctttgactccatgcctcatgtccaggtcacactgatgcaaggggtgggttcccatggtcttgagcaactctgcccctgtggctttgcagggtacagcctcgctcctggttgctttcacaggctggcattgagtgcctatggcttctctaggcacacggtgcaagctttcagtggatctaccattctgggatctggaggatggtggccctcttctcacagctccactatatagtaccccagtagggactctgtgtgggggctctgaccccacatttctcttctgcactgcgatagcagaggttctccatgagagccctgtccctgcagcaaacttcttcctggacatctgggtgtttccacacatcctctgaaatctaggcagggattcccaaacctcagttcttgacttctgtgcacctgcaggctcaacaccacatggaagctgcttaagtttggggctggcaccctctgaaaccatgggccaagctgtaccttagccccttttagcaatggctggagtggctgggatgcagggcaccaagtccctaggctgcacacagcatggggaccctgggcctggcccaggaaaccattttttccttctggacttccaaatctgtgataggggtgggtaggggctgccttgaaaacccatgacgtgccctggagacattttcctcattgtcttggggattaacattcggctccttgttatgcaaatttctgaagccagcttgagttttttcctcagaaaatgggtttttcttttttactacatcatcaggctgcaaattttccaaacttttatgctctgttttccttttaaaatggaatacttttaacagaacccaagtcacctcttggatgctttgctgcctagaaatttctcccgccagataccctaaatcatctttctcaagttcaaagttccacaaatctctagggcggggcaaaatgccaccagtctctttgctaaaacatagcaagagtcacctttgctccagttcccaacaagttcctcctctccatctgagaccacctcagcctggaccttattgttcatatcactatgagcatttttgtcaaagccattcagcaagtctctaggaagttccaaactttcccacatttttctgtcttcttctgagccctccaaactgtcccaacctctgcctgttacccagttccaaagtcatttccacattttcaggtatcttttcagcagtgccccactctactggtaccaatttattgtattagtcgtttttacactgctgacatacctgagactgggaagaaaaagagatttaattggacttacagttccacatggctggcaaggccttagaatcaggcaggaggcgaaaggcacttcttacatggtggcagcaagacaaaatgaggaagaaacaaaagtggaaacccctgataaacccatcagatttcatgagatttattcactatcataagaatagcacaggaaagactggcccccatgattcaattacctcccccaggcccctcccacagcacgtgggaattctgggatatacaattcaagatttgggtggggaaacagccaaactatatcatgtgtatataccacattttctttatacagtgatctgtcagtggacatttggttacttttagttaggagtaatatttagaaactgagatctgggaactagaatatgctcattgctaccagaatgttgttacttctggatctttcagcaatagagctaggaaaaaaaaatcacacatatgtatacatgcatacaaattctatatatgtctatatgtagaaatgtaaacatataaacatatagacatgtatgcatgtagacatatatgtgaaataactaattcattatgctgatctccaattgcaatccaatccctcagggctcttccagccattctacttttgtagagatgtaaaaattccttatagatgttcttccaaaatgagaattccagcacccaaaaacatcaatatattaataactcatttgcttagttgtataatacacaatggtttcggaattgtaatatctatactgtaatgtggagagggaaaacttatattcattcatgcatgcatgcatgcatttttttaacatcttatttggaaataattatagattcacaaaaaattgcaaagataatacattgaggtcccatgcagcctttactcagtttcccccaatggttacatcttacataactgtaagatcaaaactaggaaactgacgttggtacaatctgtatgtatagttctgtgtcattttatcacttgtatagatttgtgtaaccatcactgcaatcaagtagcagatatatttcattaccacaaagttttccctcatactaccctttaatagtcacacctactatcttccacaaccatccctaacccttagcaatcactaatctgtttccatctctataattctgccattgcaagaatgttatataaatggaataatataatgtggaaccttttgatattggctttttagagtcagcataatgctcttgagattaatccaagttacatatatcaatagttcattcatttttgtttatgagtaatattccatggtattgatacaccatggtttgttgaaccatttgcttattgagagacgtgtgttgtttctagttcatggcttttacaaataaagctgttatgaacattgcataggtttttgtattgacataaattttcatttctgtgggataagtcactgggagtacaattcttgggttgcatggtatatgtgtagttttttaagacactgacaaactaatttgtcattgtataaattaccatcttatagtctcaccaacagtgtttgagagatccagtttctttacatactcatgagcacttggtattgttactgtgttttattttagccattctgctaggagtgtagtgataacttcttgtgattttaatttgcacttccttaatggctcatgatattgaacatctttttatgtgcctattttctatttatgtttcttctttggtgaaatctctcttcatgtcattagcttactttctgatgggatgttttattttattttactattgagctttgagagttctttattatcctaggtttggatctgttttcagatatatggtttctaggctatttgaattttatgtattaattgtatattctactactctcgtattgattaagttttatcattgattctcagtgtgaacaatgtttttttgttgttgttgtttgtttttggagacagattctcgctctgttgcccaggctggagtgaagtggtgcaatctcggctcatggcaacctttgcctcccaggttcaagtgattcttgtgcctcagcctcctaagtagctgggactacaggtgcatgccaccatgtccggctttatatacatatatatatatatttagtagagatgggatctcaccatgttgcccaggctggtctcgaaatcctgagctcaggcaatccacccacctcagcctcccaaagtgctaggattataggcatgagccaccacacctggccatcatggtgaacaatgtttttttttttttgagatggagtctcgctctgtcgcccaggctggagtgcagtggcgcaatctcagctcactgcaagctccgcctcccgggttcacgccattctcctgcctcagcctcccaagtagctgggactacagacgcctgccaccacgcccggctaattttttgtatttttagtagagacggctttcaccctgttagccaggatggtctcgatctcctgacctcatgatccgcccgccttggcctcccaaagtgctgggattacaggcgtgagccactgcacccggaccgtgaacaatgtttttaatgcctacatttctggccttttatccatctcagtgcttctatatatcatttcccacccacagagacaggatgctgcatgtcagcaatctttgaagcaagtagaagaaattccttcaactgtgagagaattgcttgagaaattttctgtacttccggcatcaccttttccttcctatagaatcattctcatcttattagcctacatgccccagaaagaaagagaaaaaagaaaactctcttaacacatcgccatccaacaaccacttcatttcttgaaactctgctctgcctacacttgctcccctggtgatctttcctcttctcatacttcaaatgctaataacttccaaatttatatttgtagttcctggagcgctaaactgaactacagacttgtatggctaactgcctactcaacatgttatcttagaatcaaatatggttctcaaagtaaacaaatttgcaccccttcccccaaatatctacacttactacatcctctctgatctcaataagtagtaactccatccatcatgtttgctgatctccaggctttttgccatctctgactcctctctttttcatatcccacaccccatctgcaatagttggttctaatatgaaaatatactcggaatctagccacctttctacttgttatcactttacatccaagccaccacaaccctctcatctgtatgattttttggcccctgccccatagttgattctcaaaacagcaggttagagtgatcctttaaattctcttacttgcaagggcttcccatctccctcagtaaaggccaaagtgctcagaatcacccaccaggtactacacaatcagtcctcatctatctccaccccacagcttcactcgatatatagttatttctttaccacatctcctatgacaccccaccccttattcactttgctgtggctttcttgtgcgtcctcacatacacagacagcacgtgacctgcctcatgactttggcacttgctctctcctcttctagatggatatgtctgagttccttcaccactctcaagtcttcactcaagttcattttcacagtgagaaagcactctaccttaaattgcaaccgcttgtcccttctgtgactttctttttttcaagcactgacatcatttgacatctatttgtttttttttttaattgttacctcccccgccccatcaggactgttagctccatgagagcaacatttctcatctgttttgttcatagctatggtccctagcatataaagcagtgctggcacataatagaagccaaataagtatttgatggatgaatgaaggaatggattggcaaatcacaaagtaaatttagtttatgggaggaaccgatttaaacccaagttggctgatagataatagactttaaaatggtttttattatgttgttgttatatttccttctttgtgctttaaagtttgtcatctgagtttgttcatgccattaaaacaatcccatttaggataaggtgtgccagcctttgatctagcaaatgtaagtgaagtggcattctcattttttatctgtttcagaacaatgtttgttatctgttaatcaggatctagcattgccagcaaagtttcatcttaatcttggcagtgaagaaaatgattggatttgagatttgctttctacttttagactatctttactatctttttgtttactaaaatttatcgctcagaatacttttactcatacgtggtttcatcatttccaaacatgaagtatgtgaatttagaagtctgctttcagtagaatgtttattgttggaattatttacctaatttggaacacaagtctaattatacaatgggagaaaacatattgtacttcacggtcctcattttcatcatgtagaaaatgggtcagatttattcagacattatctgctgaatgcctactatgtaacagtcacagtatatacaacaatgaataggctgctcctcatggcatttgagttctgatagaaacagcagacatatgcacaaaggcttatatgagcatgctgtaaaccttaaatatacccaatttttatttgtcagttatacctcaataaagctgagttgtcatgccaaaatcctctgctttgagaatcagatggaccttgatctggtgtctgagctctgccatctactgactatattgatttgcgcaaacatttcatcttttaggcctcaatttttgtatcttttaaaaggaggatattatacctacagtatgaggtttgaggctgtgcacttagcatagtttttggaacagagaaaactttcaataaatataatttattctagtttttaggtgctgaattcttgccactttatttaggaatcattatttcaccactatcactttttctctcttctctctatgagactatgagggttctctacattttggagctgttaatcttgcactgacattgagaaaatagtagtaattctttaaaacaatgattatagaacttttaatcgtatataatttctagtttattttgcttgactttccacagtggttgtcttcaaagttaagcgtgcataggaacagtctgggtgcttagcacacctgcatagtcccacctagtgcccagatctgggtttctaattccattctatagtgaaataaaacaggactttctggggacatggctcattattgggctggagtgtggagaatacaagatgagctggagaacattgtggtaccagaaagtaaggaagtgtgataatccaaagaatgggagcatgttaaagggacacaggaggtaacctaaagaagctctcagtggccaaagctgaacaattttagccacaaaataaatgatgtagtattggattatagcccaaaacacaaaataaatacacatgattatataatgatataaatgcatgactgaatgaaaaggtgaaaagagaaaaatccacactatagaattccaaattatgtatgtaaatactccaccccagatggtggagcttaattttcttcttcccttgagtgtggcttgaacttaaagactagctttcaaagaacagagtatgggaaggatcagcgggtggggggaggtggggtaactttgcaatggagaaacctgtcaaactactttgacctggtaatcaaagttactaagtcacacatatgatatactgagaacagacatcatttatttccatcaccgcaaactcataaccccagtctaaccatgagaaacttacagagaaatccaaaaaccaaaagacattctccaaaatgtctgactactatcaaaacagtcaaggtcatgaaaaaaaaattagaaaagactaggaaactgtcacagaccagaggaaactagagacatgattagacgaaatgtcaattagattctggaaaaaaaggacattaatggaaaaactaatataatctaaaaaaagtgttatatttagttaatagtaatggactaggattgattcattaattataacaaatttaccatcctaatgtaagaagctcacattaagggaaactgggtgaggagtacaggagaatgttatgtattatctttgcaatttttctgtaaatttaaaattatttcaaaataagaaagttcatttttaaaatgcacagtccaggggtcacaagtctccttggaccagggaacttgccttatttggtaacactttattagattctaaagaaagcagtttagctaaaaccacttagaatactcagagctctgcagtgggtggtatttctagggatatggatgactcttttgtctgggtgcatcatcccaagtctttatcccattcttgtgcactccatgtgccattctgccgccaagttgctgctatattttagaaactgagttattgatatccaaggatctgagatctgagttcagcaatccctttttagataatatctctcattccaaagtgtcaccatttaaatttgtttatgtagaaattattggggaagaaagagatatgcagtcccccttcacactaggatatgttacaaaaactacatttggagattgtggaattcagagcccatggcaggaggtggcatgtagacacttgtgagttgggattagtgattacaagaaatactgtgtctgaggtatctaaaaattgatcactaggtcctggagattactcatggcacttgcaggcagaaagtccgattctttggcactgttagggaaactcttatttcacttagcctctcatgatctgctgatggcactagagccagattcagaatattttccccacccctagtgactaaagagttgttagggatgagagaattcaggaaagaagggaggtggaagtccagtctgggcaagaaatataggaggcaaacatggggcattgctgtggccttcttctagccataccttattcatttccattgagaccttctcctgccttccctagacgcatcccagaccctccttggggaaccaaatatgaagtttccctttaggcacatgggtggtttcctggaactcccaaaggcttcctcgctacttcttttggaacctcttgaaaataagttaaatagggccaaaatatgtcattttgtgcaactggtattctgagctaccttctgtaaagatgagggaggtctgactgttgcaggtcaataacatgttgttccttatatgattcatttaaagtacgtttttattgattatatcattgatattgtttttaagttagtggtgaactttagtctctggcagttgggcccatttgtaggttataaattatttgtagtgtcaattattcatgtcaggttatggtagtaactgaattaggagagtttcagcctgtatgatattaataaagtagtagacttcttcagtcagggcggggggggaggtgctctcctgcccatgccagcagtatgttaaccttgacctataaagttacctcagcaagtttcctctcccagtaccagtgccaacctttttcagaactatcctcagagactgggtaccagtgaggctgacagatctatttgttgtcacttgtagaatcatttgcaccatggatttaatttaacttgtggacctgtcacctatcatgctgctgctttgggatccttcactgcttaataagcagtactgtcatggttaggaaatggctcatgtatccattacagagctgcaaccagtcaatggaattgatgacaataaaacactgacattcaaattgggatttgagtagaaccctagggcagcaactttgcttggtaaatgtctaaggcatctatttttccatctgaaagatgatgtcaacatgtctcccatagcatgctgggaagaagttagctatgaattcagagaataaggggctagctgttacctaaggaattatattctttagcctaatacagtaaacctctccctctaaaaaaggacaagaagcagcaaaaaccactcaaccaatgatgagagagaggtgttgtgaaatgatattgatagccagcagaaaataccattttttttttcttttttgttggtttctatgggaggctgaggtgggcagatcacgtgaggtcaggagttcgagaccagcctagccaacatggtaaaaccccatctctactaaaaatacaaaaacaaattagccaggcatggtggcatgtgcctgtagtcccagctactcgagagggggaagcaggagaatcacttgaacccaggaagcggaggctgcagtgagccgagatcgcaccactgcactcagcctgggtgacagagcaagactccatctcaaaaaaataaataaattactaaaaagtataaataattatgggtggtgaaaaaatatagctactttgataaatgtatccaggcaagtagatgaccaaaccaattaaacatcatatttcattgattctctaatcatttattcatattttaacttctctgaaattgaggtgcagtttacatactatgacatggcatggattcgttgaaagcagaattttttcctttttttttttttttttttttttgaaacacggtttcgctcttattgcccaggctggagtgcaatgccatgatctcagctcactgcaacctctgcctcccaggttcaagtaattctcctgcctcagcctcccgagtagctgggattgaaagtgcccaccactacgaccagctaatttttgtatttttagtagagacgaggtttcacaatgttggccaagctggtcttgaactcctgacctcaggtgacccacccactgcggcctcccaaagtgctgggattacaggcgtgagccaccatgcccggcccttttctcttttttaatacataaaaatggtgtactcttcaattcgtgctatgttatatttgataaagtacagcaaccaaccaccactgctactcacttctcagaggttctgatctggatggggtgactactgtaattcaattattgttatagtgggtatctgctgatttccttaataacggggtttcactagttccttcttccaatgttagggtacagtcccctctagggcaggacatttgatcatgactctcatggttggtatatcagtaactatagaaataagattcagtttagccatttccaaagtacaataaaaggaattgcaaaagaatttgtaactttgccatagccctatgttgttagcccaagtcttgggtactgtcaagctgaaacaggaaatctgtctcctagtgaactacaacaaccagtagatccaaagaaggctctggttttccttgaactgtatatttcagagggtcacactaatgctataacttaaaatggcattattatttaaatattaagatagtatccaattccaaaagctaatatttgataccaatcactgctcatcatgaataggctaaaggctgccttttcattccatcccattgttgaagaatgacttatggaattggttctaatcatcttttcatggagtccacaaaaaccaaataggtcaaactgttcatttcacaaatgaggaaatagccccagaactgttgatttgcccatgttctcattacagcatactgatgaagcccaaaataggagccaggtcccaggtcatctatttccatcttcctcattcccttcctcccctcctcctcattgaacacagtgccctcctagtttaattagtgatggttatgccaggggctttacaatgaaacaatttaccttcaggcttcttatgccagtccttattgggccagtagtaaagacacatgacatggtacttattcaagctcagatatgatagaaacagaaaaagtggtggctggtacctattcttagtcttagcctttgttttaatttctactgctttaaaattcttttttttttttttttttttgagagggagtctcactcactctgttgcccaggctggagtgcaatggtgcaatgtcagctcactgcagccttcgcctcctggatttaagtgattcttctgcctcagcctcctgagtagctgggactacatgtgcctgccaccatgcccggctaatttttgtattcttggtagagtcggggtttcaccatgttggccaggctggtcttgaactcctgacctcaagtgatccgcctgccttcacctcccaaagtgctcgggttacaggcaggagccaccgtgcctgacctctactaattaaaaattctttagaacaatgtcctttgggatagacaaagcaggtgatattctttccatctttagaccagtattttaagtgtccaaaagaccagtgatacttccaatttctgaatggaattggaacttggggcttttgattcttaagccagttttcattagcatcataccatgtagctaacacacttgcagcctaagacagaatgtcttgaagagaagaaaacctaatagaacctacaatataattaggccgatttgggaggagtataggaggaggctgatttcctgttatctgggaagtggcaatctgaacttttaaacagacaattttgaacttttttggtttgaggcggagatcaagttcaaggcagctaccttttcgttaaaagaaactgatgaggtttcattataagcctagagtaatgtttgaaagggtagaagagatgataaagaagtagttctatctaaagttattgaaaattttcaatgctacagagattcatttttattactttgaaagacagattataaagatccaggagggtattaagtaaaatgggataaattaataaaaattataattccctattaacctaggttttatattagtttttcgttaaaactgttgcattccactttgctgttttctattttattttattattgttttaaaattgagacagggtcttgttctgttgccaaggctggagtgcagctgtgaacatggctcattgcagcctcaacttcctgtgcccaagtgatcctcccatctcagcctcccaagtaggtgggaaccacaggtgcatgccaccatgcctggctaatttaaaaaacaaaattatgtgcagacaaggtcccaccatgttgcctaggctggtctcaaactcctggactcaagtgatcctcctaccttggcctcccaaagtgctgggatttataggtgtgagacaccatgcccggccatctattttaaaatatttaaactcaaggcaaactctagacaaaacagaactaaatctggaaggagctattataccagaaacaagaaaatgttaccaaaaatatcaaattgatattctcagaatttaagaaaacaataggtttgtaaaatgagaagaagctattacagaggggaccaattaggggataagagaaagtccttggacattagaaatgttactgcaaaactaaaaactggacacaggtcagacagtgcagagttcactgggttgcacatggaacatagtactcattctcctccctgcccacttccactgaaaaggaatgcatccctccccagataatggacccaaatacccacttccggccctttccgccattagccatccgccttcagccagctactactaccacagctcccgcctgcctgctcaccacatcccaaggtgcctgccatggccaccaccccagtgttgcaggtgcgtcagaactaccaccccaactgcgaggccgctgtcaacaaccacgtcaacctggagttgcatgcttcctacgtgtacctgtccatggccttctacttcgaccgggacaatgcggccctggagcactttagccgctacttcctgcgccagttgcacaagaagagggagcacgtccaggagctgatgaggctgcagaaccagcacagtggctgcatctgctttcacgacatcaggaagccagagcgtcaagactgggagagcaggctcgaggccatggagtgcgccttccacctggagaagagtgtcaaccagagcctcctggagctacaccagctggccatggagaaaggtgacccccagctatgcgacttcctggagagccacttcctgaaccagcaggtcaaggccatcaaaaagctgggtgactacctgagcaacctgtgcaagacgtgagccccagaagcaggcctggcagagtacctgtttgacaagctcaccctgggcggcagcgaggaagacacctgagccaagatgggccccacagccacggtgtgccttccctgggtcaggccaccaggcgggggcgtgcatgttgccctttcagaacgttctcttcaatttttttcctttcagtgttaccattattggcaataaagttatctgttctcaaagcaa

SEQ ID NO: 1446 - DNA, 107966 bp, Homo sapiens
agaaataggagcgcgcaggcgcgacgtgcggctcgcagaacggcgagtagcggagcgggacccgctgtgagtgtggcggccgcgctgggttcctagctggggaaacgtgatccaggcgaagcgccccaggaaggattggggtgtgtgggggtgacttcggttctgcgaggagaaacccgtcagatatgcggtagcgttggtagcgacgctgcctgtgggtgtccggccagggccgcgtggggagcggagtgcgtggtagcgggagtgggtgagggtgggtatgacgagaaaaaaaattgaaggaatggggtttacaggctggaagtccgcacacagactgggcaggaccgcgaggcttgccaacggtgctggagggtgtcccagcttcaagttcagtcccctgcttggtgcccatgagggacgtcccaagctcatcccttcctccagcgctgctttctctggtgcagagttgctagaaacattccccgtcggaggggaaaggatttggaggcggtgggctgtcggcccgggctagtcccaaggagggcgtggcgttcgtgtgactttcctttacccacccccgggaatgtgtccctcttctgatccattgtgcccgtggacattttaacaaaggctatgactgttttgtaggcagtggcgggtgacagtgggagggggtgcgtgcgaggtcggtcgcggtgcggccctgggggatgggagagcggggggagggggaggcggcgtggggggaagtgaaaggaagagaaacagtcttcctgcttcaggtttttccttcttcctggtccgctgaatttgatcactggtaggaacagccccaagagggatatgactggaaagtagtgtgtgcgcgtttggactctggctccagccactggtttttgtgattgtgctgtgcaagtattttctacgagtccctttaggagaaaagcgaaactaatgggatttgagaggaaataattgaatgaaaggatgaagaggttgagtgacaaaacttagagcttaattatttgtctgttgatggtcatactataaagccagactttgaaggatgcgaaggtgttcaagccagggtaagtgaaaagttggttaggctactgttgattgtttcaatcaagagtggattattgggcatgtgtgtggatgtgctgtcaagatcttgggccgactcactttagaacctttgaaaataatattaaggatacaaaacattagggcaaatattgtaatattggataaagctccatatgctttcattttcaaacttagggacttttatgaaagatagtatatgtgttcccaagcatagatgttgatatttttactcatttgttttaagttaatacaacaaaataaactgaacttcctcctctccacccctttccctcgattgtaaatcccgttttataaacgtttactttctgatctgaagtatacttaaaaacacaattaccccgcccaacccccacccctgcaccaaccccaggcatgaggtgaacaggatttcttctggttttattgttatgttattctttctttttctattttcccaaatttggggcaggtggagggcggggagtgttagggatgccttttctcttttctagtgcctgatgaactcctattcatctttctagacttagcctgattcacttcttgaaaaattttgccatcttctccagagtgaattaatcacacccttttctgttaaatttatataacttgccttatttctccattactactagaacctcagtcttttgtgttacccttgtacctagagctgcctggcatgtgataagcacctaataaactaacttacagatatatattaataaatgctgttagaaagatggtaattcataggccgggtgcagtggcttactcctgtaatcccagcactttgggagtctgaggcaggtggatcacaaggccaggagatccagaccatcctggctaacatggtgaaaccccgtctctactaaaaatacaaaaaaattagccgggcgtggtggtgggcgcctgtagtcccagctactagggagactgaggcaggagaatggcatgaacccgggaggcggagcttgccttgagctgagatcgcgccactgcactccagcctgggctacagagcgagactccgtctcaaaaaaaaaaaaaagaaagaaagaaagaaaaaaaagatagtaattcatattgcataaagttcatgggataatacaagaaattcagaattctgaaattgtatttaatatttgagcagcattatttggaatatggataagtactgtgtggaaatatgttctcatgtattagtcatagtttatccctctaaaaagaggtgcaaaaactctacagataaagggaaaatagggatcagaaaaaggtgaagtttttaaaaaggccagtttctgatactgaaactagtgaaattaactatttgtagaaagacacaaataggttgctgctggaatttaggaagtactacaaatgaatcaggttgccagatggtattctctgaagggtgatgtaactaaagaaagctgtaatctaaccagttgtattatacttcttttacatcttaaagtattttcggcctttggctaatgggtctcttcatgttacagttccctgataggcttggtctaaccatttctgccaaactgtctttgacatctctcttaactccaccaggatcactggccttccagttacctctggctcctaacaggaattatcttccccctgttcctcacctccagccttcttctcctgaatggatatatgtatttgagaaaataccatgaacaaatgatcacttactttataaaagaatggaattggttctttagtttaaaaataagtcagaattggctacctgcttagtctagccttctgtgcctgcaaagcagacagagaactatgagcattagtaacccttatttttcatttctcccttattcatctaaatgcaaaagcactttttttcatttcacttttaaaaatagcattagtcattgttcctaaaacacttcaagttagtctctttttttgactaaaactcaaaactcagggaggaagagtagtagcatccataaaacttttttaaagttctacatcatctgtggacctactgactgaaaaaatattccaaaccaaccattgtgattataccttccttcttaaaactttcctcttagacttccttctcatatttctgattttttttctctaattctttgaccggttaacctcagtcacctccacagtcttctcagggttctgttcaaaactctttttctcactgtatgcacaagagtcaagggcatggaaactggagaaatcgaaaattggaggcaagacaagaagttaaacttttctttccgagcattagtttcctcacttgtaaaaatgataattataatacttacctgataattaagatcaggtatatagtgatgtgacgcataatgacattttggtcaactatggacaacatgtgtgatggtggttcccataagattataatggagctgaaaaacctggtgactttgtagcctttgtaatgtcacagtgcaatgcattacagtatataacacttgataataaataactatgctaatggtttatttactatactatactttttaattattattttagagtatacttctacttatatattttttaaaattaactgtaaaacagcctcagacaggtccttcaggaaggcaagaagaaggcattgttatcataggggatgatatctccacccatgttattgcccctgaaaaccttccagtggaacaagatgtgaaagtggaagagtgatattgatgatcctgaccctgtgtaggtctaggctaatgtgtatgtttgtgtcttagtttttaataaaaatgtttaaaaagttaaacaaattaaatagataaaaacttatggaataaggatataaagaaagaaaatgtttttgtacaactgtccagtgtatgttttaagctcagtattattacaaaagagtcaaaaagtttaaaatattaaaaagtttatgtagtaaagaagttatagtaagctaaggttaatttattattgaagaaagaattacattttttatatatttggtgtagcctaagtggagactatttataaagactacagtagtgtacagtaaatgtcatagggcttcatatccacttaccactcactcactgacttacccagagcagctttcagtcctgcaggctctattcatggtaagtgccctatacagatgtaccattttttatcttttatacctatttttactgtacattttctgtgtttagatacacagacatcattgtgttacaattgcctgttcagtacagtaacatgctgtacaggattgtagcctaggaataatagggtataccatattgcttaggtgtgtagtaagctataccatccaggtatgtgtgagtacattctatgatgttgacacaacaacgaaatcgcctaaaggcatttctcagaccatatcccagttgttaagtgatgcatgactgttaacagcttataatgtctagcacatagtagtgcttttaaaatgttagctgttgttatttatgtctgctgtttcttgtgagctcccattatttcaatagcaattaacttcagaatgtggatgtattgatatttcccaccctgtttgagctccagttctgtatttgtagataactcccatgtatttccaacaggttgcttagcacagtggttctgaaacttcagcatgtacaataatcacaagatgcatagatttctggaccccatacccaaagtttgtgatgtctaggatagagtctaagaatttccatttctaataagttcataaatgatggtgattctgctgtccctgggaaaacattgagtggcatttaactgtatggcattcagacaggttggtggagaggaagggagaggagaacaaaagaccaaaaatttatgaaaattaagaacagagtgcactttaagctggtagtgctttttttatttttatttttatttttttattttttttttttattgggacagagtctcactctgtcgcccaggctggagtgcagtggcatgatctcggctcactgcaagctctgcctcctgggttcacgccattctcctgcctcagcctcccaagtagctgggactacaggcgactaccaccatgcctggctaatttttttgtatttttagtagagacgggttttcaccgtgttagccaggatggtctcgatctcctgaccttgtgatccgcctgcctcggcctcccaaagtgctgggattacaggcgtgagccaccacgcccggccggtagtgcttttaagactgtttagagtgtcctctaaaatgtagagaggataggactgacagaagatgcttggatttgatgaccacaaggttttcttttgtttgtttttggtgtgtttcaggtgcagattgttggtttaattatacttctcagttggtattatattatcattattgtgaccaggagaacatatcacaggtatttgaggtaatggcttttttgtttgtttgtttgttttttgagacagggcctttctgatgcccagactagagtgtagtggcgcaaacacggctcactgaagcctcaacctcctgggctcaagcaatcctcccacctcagcttcctgagtagctgggaccacaagtatgtgccactatgcccagctaatttttaaattaaaaatttttttttgagatgaggtctcactatattgcccaggctggtctcaaactcctgggctgaagtgatcctaccacctcagcctcccaaagtggtgagattacagacgtgagccaccatgctcagacatagaggtaatggttcttaatctggtgtgtgcatcagactgtcatagggagctgtttcaaacaatacacttaagtttagtgcccctccccacaatattgactcataaaatctggatttcagggtgtgggatctaggcatgaaaaaattccctggttaagaaccatctcttcagcaatgttgggcagaatatggaagaactgaaaatagttttattggtaaattgctggtgaaaggagaatagaagaaaaagactggagtttgaagatttttggagttcaagaaaatgggaatatgtaaaggtgaaaagcctgctggagtcaaggagcgattgaatgtgtaatgttatgaacatataattgatggaatacagtactggagcaggagagcaggagagaatggaattagtaggtaccataaaaagagaggagaaaggagtgaaaaaagtaagtttaaagatggaagtgggagaagctgaaagaactctctttaagggaggtttgtttgcacactactgttcttcagtggaacttaagtagtcttgaactcttaagtggaatggattttttcaagtttaataatgctagcaaataaatcaataatttcagctattccagctaccactaatggctacaagtgtatttttcttcaacttagtttgaataattattttttgaaattaagtctagacatgctgtgttgtaatgttattgccctagcccttgccgtaagactgctatatcataagtttcatatgattttcattcagttattcaacaaatatttgtatgactgtcaatggccaggcatccttctaaacactgaggatacaacagtatataaaacagttatattttattagaaatttccgcctttgaggcgcttgcatcgtatttgagggaggcagataataaagtaaatgagtaaaatataagaaatatatatataattttctatacatatacacataaatatacatatatgttaagtgacatggtgctgcattctttggagaaatacaaagcagggaaggtgaatggggggacctacaggtattcatctataggtgaatagggcatgttggagggaggtaatcagggaagacttcactgtcagcaaagacttgtagaagataagaaaaccatttatttggaggaagagcttcctaagcacagggaacagcagttgtaaaagtcttgaggtgggttctttttgagacctttcagctaaatatagcaaaatggtttttgcggctggagtagcatgaatgagaaggggtgaataataaggcatagagtcagataagcaagaaggattgtgggagtggtgggaagattgcaagaggagaaatttttgaatggggagatcaagaactacatactggccatgttgagttagagatgattatttgatactccaggtagaattcatgggataggtatgggtaaacaggaaactctaggaatggatcacaacattataagggaagagaaggggtcattgttttgctttgtttttaaattaaaaaactttagttttttagagcagtgttaggttcatggaaaaattacaaggaaagtacagagagttctcatataccccctcttcacatacacaacctcctgcactatcaggacatcctgtaccacagtggtacatttgttgctgttcatgaacctccattgacatatcattatcacctaaagctaattgtttatattaggactcactcttggtattgtacatcttatggatttggatgaatgtataataacatatctactattgtattaatattatgatatgatatagtttcactaccccaaaaattctctgtgttctgccttttcaactgcccttccttccagcccctggaacccactgatccttctactgtctccatagtttttcctttttcaaaatgtcatatagttggaattataaagtatgcggctttttcatattggtttctttcacctagtaacgttcatgtaagcttcctccatgttttttcatggtttaatagcttatttctttttagtgcttaatactccattggatgtaccacagtttattcattcacctactaaaaaatatcttggttgcttccaagttgtcgtaattataaataaagctattataaatatctgtgtgcagtattttatgtggacatagattttcaattcatttgaatacaaaggagctcaattgctggatgagaatatagtagtccccctccccatccatggtttcactttccacatttccagttacccaaggtcaactatggtctgaaaatattaaatggaaaattccagaaataaatgtcgtaagttttaaattttgtgccattttgacatgatgaaatctcgcaacatcctaccacattctgcccaagacatgaatcatccctttgtccagagtatccatgctgtatatgcctttcgcccattagtcacttagtagccatctaggttgtcagatcaaaaaaccatagcatgtataggagttggtactatccaagatttcaggcaccctttggggtcttggaatgtattctccatggatcaaggaggactactttatgtttagttttgcaagaaattgacaaagtgtcttccaaagtaacttaccgcttttattcccaccagcagtggatgagtttctgttgctccacatccttgccagcatttggtgttgtcagtgttctgtattctggccattttaatagatgtgtagtgccagctcactgttgttttaacttgcaattctctaatgacatatgatgttgggctttccatatgtttatttgtcatctgtatccatctgtatatcttctttggtgaggtgtccacatatttagtccattttcaaatcatgtttttttttttctcattgctgagttttaagagttgtttgtatattttggataatagtactttatatgttatgtcttctgcaaatattttctcacagtctgtggcttgacttctcatattcttgacagtgtattttgctgagtaggagtttataatattaaatccagcttatcagtcctttcatgaatcatacctttggtgttataactaaaactcattaccatattagaggtcatgtagattttttcctatgttctaggagttttatagttttgtattttacatttaggtatatgatccattttgagatttttatgaagggtgtaaggccatatctagattcatttttttttcatgtggatgtccagttgttccagcatcatttgttgaaaagtctatcttcattgttttgcctttgctcctttgtcaaagatcagttgacgatatggatatacctctctattctgttacatttacctgtttgtccattcttttgccactgtctttattactgtagtttaatagtaattcttgaaattaggtagtgtcagtccaccaactttggtgttctacaatattgtcttggctattctgtatctgctgcctctccatataaactttagaatcagttgttttttaaaaaaaaaaattcacaatatcacttgctgggattttgattggggttgcactgaattcgtagatcaagttggaaagaactgatatcttgagactatcgagtcttcctattcgtgaacatgggatatctttccatttatttagtcttgatttttttcaccagagttttgtggttttcccaatggagatcttgctcatcgctgatatataggaaaagaattgacttttatttattaaccttgtatcctgtaaccttactattatcacttattagttccaggagattttatttaaaacaatcaattctttggaatttttctacatagacaatcatgtcatgtgtgaacaaaaacagttttatttcttccttcccaattggtataccttttgtttcctttccttgtcttatcacataagatgggattttcagtatgattttgaaaaggagtggtgagaggggacatccttgccttttttctgagcttagagggaatgcttcaagtcttgcaccattaagtatgatgtcaactgtagtgtttttatagatgcctttttccatttgagtgagttcccatctattcctagtttgctgagagtttttttttttttaaatcatgaatcagtgttggattttgttaagtgctttttctgaatatatggatatcattgtgtaaattttcccttttggcctgttgatgttctggagtacattaattggttttcgaatattgaaccagccttgcatacttgtcatacatctcacttgatcatagcgtataatttttttatatatggttggtggatacaattgataatattttgttgaggatttttcaatctgtgtttatggtagatattggtctgtagttttcttttctagtaatgtctttgtctggttttggttttagggtaattctgacctcatagtattgccttggcttctaacttcaggagaaattgtagagaactggtatagtttattccttaagtgttcggtagaattcagcggtaaacccatctgggtgtggtgctttctgttttgcaggttattattgtttcaatttctttagtatagtcctattcacattgtctatttcttgtgtgaattttggcagattgtatctttcaaggaattggtccatttcaaggaattggtccatttcaaggaattggtccatttcatctagcttatcaaatttgtggggataaaattgttcataatattcctttattatccttttaatgtccatgggatctgtagtgatgtcctttctttcatttctgataataatttgtgtcccctctcttcttttcttaattaccctggcaagtttattgaattcattgatcttttcaaaaaaccagcctttggtttcatttatttttccctattgattttctgttttcagtttcactgatttctgcttcaattgtattatttcttttctcctatttacttcaggtttaatttgctcttctttttctaatttcctaggatggaaacttagatgattgatttcagatctttctttttttctaatgtatgcattcaagctataaatttccctctaagcactacttttgctgcatcccacaaattgtgacaagttgtattttaattttcacttagttcaaaatatgtttttaatttctcttgggatttttttcttcaataatccatgtgttatttaaaggtatgtagtttaatctctacatatatgggggaattccagctatccttctgtaattgttttctagtttaattccactgtagtctgagagctgacattgcataatttctattcttttacatttgttaagatatgttttatgtcccagaatatgatctgtcttggtgcatattccacatgagcttgagaaaaatgtgtaattttctgttgttggacgaagtagtttatatatgtcagtaatacccagttaattgatggtactatcaaagctgttgagttcagccatttccttactgattgtcttcaaataacactataccccttcatgggtacaacctctttgtattgcaacacctttcctacaatggcaaagtgatttggttatcctgaaaacctgagggaccatagaaataatgttgccattgcaagttgctttttgaatctcctaaggaaataactgtatgtcaaaccttagttcagcatttactgaacacctttggtatgtaaggggtgtgtgtgctagctttaccttttgtaaattagcgacataattacttctcaagatgtcattgggcataatgaaatgagaatcaaagtgccacagggctggggtaatcatagctcttaaaaatgctcaaggccgggtgcggtggctcacgcctgtaatcccagcactttgggaggccaaggccggcagatcacgaggtcaggagatcaagaccatcctggctaacatggtgaaactgcatctctactaaaaatacagaaaattagccgggcatggtggtggtagcctgtagtcccagctactcaggaggctgaggcaagagaatggcgtgaacccgggaggcagagcttgcagtgagccgagatggtgccactgcactccagcctgggcgacagagcgagactcagtcaaaaaaaaaaaaaaagctgaataattgctattctttctccattattgtggggtaataattggtatagttattttcaacctcattcaaataccgatgatgagtttttgatagcacttgttatcttcttgaaaggcttgcaaattaaatgcactagaattaaaataacaatttcacaatttgaacttttaggtacattttttcagtgcctcagaattcgtaacctattatttctttgggagaacatgttatattttaatctttgagttggagtaagttgtctgtggtctatttcttcccttctttcaaaactgtgtctgagatgtgtgttgttttctggagtcctagttaacaaaacacctcctttttcagtgacaaagccttgttactgaaagcactttatgttctgtgaatctcctccaatctgtccccagtgtgcttgttctttgtggtttggtttctaatattatgcattccaattttgtaaaaaaatctatatgagtaacttgccacagtaatcctctctgacatgtttgcttcagggaaaaagcaggaaaagtcagaaacgtaagcctaggtttaaaatttgctgtcgctgcaaaaaagtgaatagaatatattccaagtttctttttctgtattagtattacctatgggaccagaataattattttggcaaggatatagttaatttcctgtgtaattttatcctgcttcagtatcttagtcatttttcctttgatttctcaaaaaaattatagaagtaaaaaaagaaatttagttatttaggtttataaacagtctaaaaatacaaatatttttgttgcattaaatatgaactatagtataaaataaatacatgtgctctttgaattttaaacttcctttaacttataatgcaaatagtagatattaatatgtacttttttatatatttcattctctaaactatgaatgttaacacggtttatatacttgacctttgcaaagttttgaacagtccactcctactgctgttgttctagcattatttccttcctaatatggtagtcatttttttttttttaacttttctccccagtcatttctggcctgtccttaacccaagtctgcccatccacagatattgaaagcttccaaccttcaggaactacccttcacattactcctagaaagccccatctagccctacagatcaaactgttcactttcaaaggttgtttgtgcctaacctttcttctgttttttctgtttgcattcctcatttgcatttcagttcttcaccttttaactgaggctagttttctgccagaatctcagccccatttaaccaggggtcagaccatcatattgtctttgtctacttggtttctggttggttcccactaccaggaaccaggatgctgaatatccctagaatccttaccgttggagtgggtggactctagtctacttcaactggggctgtcaagaggaaaaaggtgtcagagtcctcagcagactgggagggggcctggagcaaatcctgtgttaaaatgggattttgttttttcctctgcgacccaaacccactcttgacagttctcttcttcacatgagagtatagtgattgttcgttattcagaagattgcccaaattattttttcctctcatctgttgagcaattcctggccatatggattatcttccttagtaataatacgaatgacaacaataataataaccattctatgttgcactagatattttatttttatcatttttattaccctgtaagatatatggcttttatctccattttctagtaagtacattgcagttcaaagagtttaagtgcccaagctcactttggaggtatacagtagaactgaaatatcaaatcaggtttctctgacattacagcatggagctttttttttaggagacccgttgcatgaagcatagttttgggctgtctcttctcattctcagtttcatacagtaagactttgtgtttacgaagataaaatatatattgaggatttactatgcatgcatttcatgcatctagcattatgatctaacatggattagtgcttgatgaatattaactaaaggaatgagaggagactctaaatttgttagaaagggtaatctccctgtgcttaacacagtggcaggcatatggttggtgctaaaaaatatttgttgaattgatgagatcacctactcaggtattgttgaattaatgatattatccactatatctttccattaaaagagatgactgtgaatttaaatagctgagccattgatccagttgtctagtaaaggaaaagatcagtttaaatggatgttttttcctttggatgcctgaaagtgtacttggtatcatataatgaattctgcttccaaaagaaggctgtcacttacttgtttcatcttacttgacctttcactcattcaccccccaaaacttcttccttgacttttgcctcttccctggataatgccattaattcccacaacttccacctcattcttcacactgaaaattctcacatctgtacccagtcaaaatttttccctgaagatccagaggcatatacatgactgcctaccttaaagtaaactgtctaaaacagaacttctccccctacctaacaccccacctatatgtctgctttttctccttttttttctcattttgttaaatagtgaaggaggccctgtatttgggataaagacttctggatcctgggtataaacaggaatgtgaccacatgggattccctttgccactcctttggagaaatcacagtcctggtgctagagttaggacccctatattaaggagctaatggtagtctatatcaccccctccaaaaaagtttctgcttttttttgcttttctgttaaccatctactcctccttgctgatacaagcagggatgataagaaagtgagccctctttctcattacctccttttctcaagcatatgtgagagaatgcaatctgattatcatttataggctctcatcccaaacttattttaaatgcaaatcttgagattaaaaccattttatcttttatctaacattggattgactgcaataatcatgtgatttcatagattactttgagagtttatactgcactctaggtttagatatcccagtgtctatctgtagcccataattagtgaagacaataatattctcttgaatttttattgtggtttcatgtccacagaacactctcaaggcttgtgtggattttttccccattctccatttctttcttagctggataataggccacaaattgttttatggattccttttcgtgttacttcccatcttcacaaaggtagagttaactctcacctccctccctggacctatccacggtttaatccttcttgtgctgtagttactggacttcaactgatggtattaatgttttttcatgttacattgctacaatggcatgtggttttgcttctctttttttccatcatcacacacttggcaggaccaatttgtctaaaaccatatatgaattgtctccaaacagccttatttaagtcagatgttgtctctgtaaaacgttggcaaagaaaagtattcccttcctacatatagtcatattaaatagaactttgtgaggcattgcattctttttattccaaaaatgtttaatatagctccatatgtagtattgacggaagctatgaattctattaagatggccaaaagttagtgaacttctgccacggaccctggtggactgaacaaaggaggacaaatgcgggaataaagacaaagacaaaagagtatgtttggaagaaggagtcgggggctccttgcttctggtgaacaagggccctgagcttctagagcccttcgtatttattgggtaaaagaaatagggagaaggggtggttgtcagtcagctgcttgatttagtgcaggcctgcatgactactttctccagatgttccagtagataacctcaaggagcatggcaccaggaagtgactgccctcagcataccttctggtggcaggtgcagatgtgagtttgcccacatcctgcattcatgataaacagtttgctgtttgatcatatagcctccagtggaatgctgagttggtcagcattcagcttacagctcccaacaaacttctagcctcctttttggtataggtaaatcttagttgctatataataatctgttatctgtctgtccatatctgcatttaaagaaatgtgattaaaactcattttgttggaggttctccagccagccagggttaaagcagagtatttcagagagcactgacttgatcttattttatagcttatgttctagcactttcttgggtagatatttctcattgtagtgcctctgttgttttagaaccattgcctttgatttgaccagaagcaacagcattattttcagggagtattaccagaccttaagggtatccttctgtgggaccaagagtgtgtggtgaggtagtacaagtgcttccttcactgtgcatagcaatatcctcccacaaataggtcccctgcttcaggggtgcctgtattttgagtgattaattgcattagcctttatggtaggtgacaggatattctgttcaaaactttatgcttaccctactccactaccactttcttttaactaattcaagtctcagccgagactgcaaaaattttgaaattaaatgttattctagtacttctggttcaccaaaaatcaggtaagttcagcatattacagaacagccttgctgtgcagcactctgacaactttgcacaacataatataggatatgggggcaatgcttgactgtagtctgacccaattcttggtgaaatgccctgcaattctggctagagcaaggaagataacaagcctggtaagctgctgtgagacagtttctcatccctgtcatgtaggaaactgccataataccatttctcacccattttctagtttcagttgaatgcagaacttttcaccttataccctgtgtgggataagcctatgaattttcttgggtttagtttagagatggctcttcaacagcaccatgatccattgcttggaccatttgttatctgtatcttctagtttggtgtcatgatgtgagactagggacttggggaactgataccatgctgatttagctttcgatgtctgtgtaagtaatcagttgtctgaattcatctgggccaaatctcctttaccagccaaatcaatggaagtgtggcaagccaacctaacagctgtatcagtaatacttgtggccctgttagccatcacattgctgctttggtaatgtttaactgtgtaacaaagtgggactcttactgaccaaacacccagctagtatatgtactatgggatattccttgagccttctacttgtctctgggcataatggagcccccagtttggcaggtggacagaggccagagctgtatatcagaattactctgaattgcttttctcacattgtcagcccaaggaagataccaagacccgctcattggaaagtcttatttacacaactagaagggccataccaattctgaagctgccctcacacacacatctacctgagtgtggtaagaaaggaagcacagtaacagtgtttgggcctactcagaatggtgcactttgaatatgtggttgcctcctgctcgtcaatcctgtggtctcctcagtctatggtgttttgtgtttcaaagaaaccaaatgtttgaccatataagcatctgtaaaacatttctagtttggcataatatctggaaaaaatagaaggcaacatggagaataatctctaaagtatacatttttgtaaaaaaatatgcaatacttgattttgcattatattcttttctaatataggcatttaaggcatttttgccttctaagcactattttaactgtgtttgtagattttgatatgtatttttattatatttagttcaaaattttgtctactttctcttgtaatttattctttaattcaatgattaatttacaattgtgtttttactgtccaaatatgtagggttttcctggttttcatgtaggtaaatttgagaggaaaatgttaacatagcagatctgtgttaacattcagcagatctccttcatatctccaagggaacttggatcatgattgactcttgaccagccactgggaatgtgaccctttggatgtcttttacataaatggtggatttttttttttgtacacctggagcaatggactatgtaggtacctgcttgtcaaaattgctttgtacaaacatcaagattgataaggtatacctagtttctaagtcttggttattgtggctggtcctatagctggatatgcctatatggccagccctctataaaagctatgaatgctgagacttaaatgctcttgcgctcttcttcaaatagagatattctgtatatgttcctgtattgtgctactagagagaaagcacgtatagaaagcctatgtctgacctctctgggttctacccaatgcatatctttttcctgctgcttttactctgctccttttgctgtaatacattttagccttgattataacctaatattgagtcgttttgatgaacctcgaacttgagggtggtcctgggttccccaaaactgtattctaatttaattctattgtggtcagagaatacactccatatgattcctttttttaatgttgagacttgtttcatggcctagaatatgatctttcctggtaagtacatcacatgccctgaaaagaatgtgtattttggcattactggatgtattgttctatgaataccagttatataaaagtagctaatagagttcagatcttctgtgttttgctgattttgtttttctagttcagttaattgctgaaacaagattgttaaaatctctagttatgattgtggaattatggatttctgcattcaattctgacagttcttgtttcatgtattttaaaatgctattatgggatccgtatgcatttggtatgatcttttctattgaattgacccttttatcattatgaattgttcctctttatctcttataatacatttgttttttatatttgtcttctgatggccattctagctttttgcttaactctttgcgaggtgtatcttttccatctgtgtactgttgacacatctgcatatttatatttagaatgaatgtcttataaacagtatatagttgcttggatttttaaaattttaccttctgataatctctgcctttttaattgaaatctagttcagtaatttttaatataactgccaatatagttaggtttagacctaagatctgtttttttttattttctacatgcctcttctgttttttcttcctcttttccagctttttttaaatccgtaaatgttttcagaattctattttatttttcctattgatactctagctattcttttttttgtactttttttgatagtggctgccctagggattataagatacagccatagctttcatagtccacttacttagttaataatgtgctacttcaagtaaaatatggaaatcttacaaatttccaggcccacacccctattcttttgattgtagttattacatgtaaaacaaactcccctctactcacacagcccacaaggcactattatcattttacttttaaacagttatttggtttatatagaggaaaaaaaggataaaatagtattttgcattttctccaccatttaccctttctgattttcttcattcatttctgagtatcccaattccatctggtatcatttctcttctatgtaaataacttctagcatttcttatagtgcaggttggctgatgacaaatgcttttagttttatgtgaaaatacctttatttcactttcacacttcagtgatatttttgctgaatataaaattctgggttaacatttcattttttcatgctttaaagatgttttaacagtttttcagtcctccattttttttaatttaaaaatttaattgatgaaaattacatagatttgtgtaagatgatgttttaaaattgagcttgttaacatatatgcattaccttacatgtcatttttgtggtaacatcacttaaaatctactttctcagcaattttcaagtatataatacattgttattaactacagtcaccatgttgtacagtagatctcttgaatttattcctcctgtctaactgaaattttgtatcatgtgaccaacatctctttgatcttcccccacccagttcatgataaccacctgatatggtttggctgtgtccccacctaaatctcatcttgaattgtagctcccataatccccacgtgtcataggagggacctggtgggaggcaattgaatcatgagggtgggtctttcccatactgttctcctgatagtgaataagtctcacgagatctgatggtttcatgaagggcagtttccctgcacatgctctcttgcctgccatcatgtaagacatccctttactgcccctttgctttctgccatgattatgaggcctcccaaccatgtggaactgtgagtccattaaacctctgtttttttttttaataaattacccagtctcaggtatgtttttattagcagcataagaacaaactaatacaccaccacttactctctgcttctattagttcaacttttttaggtttcatataaatgagattatatgatatttaactttctgtgcttggcttatttcacttaatgcccttcaggtttatccatgttgctgcaaatgacagggaatcctttcattttaaaggctgaaatagtattccattgtgagtatataccacattttctttatccatgtatctgttgaaggatacttaggttgattctgtatcttggctattgtgaacactgctgcaatgaacatgtgagttaagatatctctttgacatactgatttatatttttttggatatataccccatagtggaattgatggcgcagtggcccacctagagcagtcgctgccatgacactggctgcagtgggggaggtacgaccaaggctgctcactccatggagccagcaggggctgggactaggcaggagctgtgccctccagggcacagctgtagccacccaagtcatggctgtggacccaggacttcctgtgcccttgggggctgggagcaggctggagccctaccctcctgggtgcagctgcaactgcccaagttgtggctgcagacccaggcctccctgtgcaccttggggccaggagcagacaggagccccatcctcccaggcacagctgtagctgcccagccatggctgtggacccaggagtctctactctcagtggtctgggaaggccccccatgcgcctgccagctcagaagtatctgctcctgctgcctggcctttccccactcctggtacccactctgatctcagagcaaagttgaggctgagcccaggcactgttgcaactggccaggtgggtgccaacgagcatgggagggaggtcaagggggagctgagagcagtttggtgctggcgtgcaggcacccttcagcacaaacagcctggatgccatgaacagcggcaggaggcagacaggctcctgagtagaaagggataggtcaccagtgaagccccaccttcaagtcagggaaggcctgaagcttgggagccaggctgccagtcacacagactggagtgggaacttatggtgcttttcccagcccacccatagccactcatggactagttagtcagcatgcacttcctcccctctgaagcacataaaaatcccagatatcaaccagactcaaggaaaggatgagatgtccagctgtggagagtagctacccactccagggtgtcctctctgctgagagctgaacactcatcaagacaccctgcctgtggagaggagctacccaatgtgggtctcctctgagctgttctgtcgctcagtaaagctcctttttgccttgctcgccctccatttgtccatgtacctcattcttcctggataaaggacaagaacttggaacccaccaatggcagggcaaaaagagctgtaacacaaacagggctgaaacacactccttgctcattacgttgtaggcaacaagaaggagagaagagagaaggagagaagagctgcttcccttctgggagcccagacctaggagttccctgagccagggctgtgacaccctgtttgaggcgttgcggttcctggcatttccaagcttctgggtgctactgtgttccctggtgccagccgtggaagctgcttgcagtacgcctggcccagccacagccttgcagggagccagcgcccatgccagcatctggagtttcctgccccacttcagccagcatgcctggctatgcacagaggctggaccctatacttgctcacaacgctcctcaccgctctatgcctggcttgcccttggcaggcttgggagccaggctggtagtgtgagccgagtgtagcctgccaggctgagtgggtggaatgagctcagcaggcccaagtaaaactcaggcaaagatgccactggccacagaggtttctggctggtgaagcaacaccacaagaatcctgtgacagaactgctggatcatatggtagtactttttaaattttttgaggaacctccattctgttttccaaaatggctatactaatttacatttccaccagtagtgctgaagatttcccttttcttcatatctttatcaacacttgttgtcttttactgttttgataagtgctgttctaataagtgtggggtatgtctagttgtggtttcaacttgcatttcccttagtgatgctgagcatttttttatatacttgtagactgtttgtatgtctttgagaaatgtctgtcaggtactttgcccattttaaatttaagttatttatttttgagatggagtcttgttctgttgcccaggctggagtgcggtggcacaatctcagctcactgcaaccttcgcctcccaggttcaagtgattctcctacttcagcctcccaagtagttgggattacaggtgcccaccaccatgcccagctaatttttttgtattttcaatagagacagggtttcaccatgttgaccaggctggtcttgaactcttgacctcttgacctcaagtgatccacctgccttggcctcccaaagtgctgggattacaggcatgagccactgtgctgggctaacttcgcccatttttaaattggactatttgttttcttgctcttgagttctttgagttccttatatattctggctattaactccttatcagatgtatagtttgcaaatattttctcccatcccatgggttatctcttcattctgtttattgttcccttggctgtccagaaactttttagtttgatgaaatctaatttgtctatttttgtgcttttgttgcctgttcttttggtatcatattcaaaaaactattgcccagaccaatgtcgtggaccttttccgttatgttttctactagtaggtttatagtttcaggtcttacctttaggtctttaatccattatgagttgattattgtatatagtgtgagataatggtccagtttcactcttttgcatgtggatatccagttttcctatcactatttattgaagagactctccttttcccattatgtgttcttggcccctttttgaaaaatcaattgaccattaaatgtatgggtctgtgtctaggctctctatcctgttgtatttgtctatgtgtctgtttttatgccagcacaatggagttttgattactttagctttgtaggatattttgaagtcaagtactgtaatgtgtcaagcttttttccccctcaaggctgctttggctattgggggtcttttgtagttcaacatgaattttaggatcattttctctatttctgtgaaaaatgtcattgaaattttgatagggattccattgaatctatagattgctttgggtggcaaggacattttaacaatattaattcttccattccatgaaaatagtgtgtctttccatttattcatgacttttccaaattttttcaatgttttacagttttcagtgtacacaacttttacatccttggttacgtttattcctaagtgggatttcttttttggtagcaactataaatgagattggtttcctgatttattttgtaggtagttcattattagtgtatagcaacactactaactttttaatgctgattttgtatcctgtacctgttttaaccaaatttgtttattacttctaacagttttttggttgagtccttcaggttttctctatataagaccaatagtttaactttctattttctgattttcattcctttaattttttttctcttgcctaattgctcttgctaggacttccagttctattttgaatagaagttttgagaatgggcatctttgttcctgatcttagaggaaaagctttcaacttttcatcactgagtatgctattagctgtgggcttgtcatatatggcctttattgtgttaagatacattcttctgtacctaatttgttgagagtttatcaggaaacaatgttgaattttatcaaatgcttttctgtatatattgagatgatcatatagtttttgtctatcattctgttaatgtagtgtgtcatatttatagctttctatatgttgaattatccttgtgttccaggaatatattccatttgatctggtgaatgatcttttaaatatgctattgaattcagtttgctagtattttgttgagtatttttgcatttgtgttcgtcagggatatttgtctgtaattttattttctttagtgtccatgatccatagtttctgatgagaagttaagcattaactgaattgttgttttgactgtgatatgtcatttttctcttgctgctttcaaggctctttctctttgacttacagtggtttattatttacctcagaatggacttctctgtatttattctgctttgaaatcatttcgtatcttgtatatattcattgctatcattcatcaagtttgggaaattttcatttattattacttcaaatatattttatgtcccattctatctcctcttctactggtatactaaattcgcttatgtatgactgttcgatatcatctattaagtttttgagcttctgttcaatttgtgtcatttttttctctgttcttcaacttgtgtaatttctattgatctgtcttcgagttcacttattcctgttatgtccattttgctgttaaatccatctagtgatttttttcataaattatattttgtattttaaaatttccttttttattgcctttatttctctgctgaggcttcctatttctctactgaggttttcatgaattgataaatccaaggtctctgtcataattgaggttggttctgatgttctgcctcatcaaactgtgcctttttagtatgctttgtgatttttttgtcaaaagctggaaatgatgtattgggtaaaaggaactgaggtgaatagacctttagtgtaaggttttatgtttatttggttagggattaagctgtgtttagtattttctgtagctgtaagtgtcaggaaataaaatatcctctgctgtctttgttttttacttccctgttacatttgagttcctctagcaactttttcttaagatctgagatatgtaattctttctgttgtatccccctgttattatacaggatccctattgatgtagtaaggtgtagggagagaagtgttctatggtcctatgattgggtctcaatcttttagtgagcctgtgccctagactgtgaccttcgcaagtgcttctcagttttgctttgtttttcccaccttaggtgaaataggaaggctaaatggggacaggaattgggcatttccttcttccaggtcagttaaggtctgctaaatccccagttggttatgttctagtaatatagttgggtcctctgtatccatgagtttaacacgcatggattcaaccaaccatggatggaaaatgtttgggaaaaaaagcaataaagaataacaatacaataatacaaaataacacaaataaaaattgcagtatagcaactatttacctagcgtttatattgtatgaggtattataagcaatatagagatgatttaaagtatatgggaggatgtgcataggttatgtgcaaatatgacaccattgtatataagggagttgagtatctctggatttaggtatccgtggatactcaggaaccactatagtttcacctgagggcaggccttggtaagaaagagaatgttcttgagtgcttcataaaatggcttttttttaaactctccctgcctgaagcccaaaataatttttcttttatctttactgtaagaacctgatagggttcctggagctaaaactcacagaactgggtatgggtctaagattgggcctccctggagtttctaactctcaaactacagtttatgttttcttagcctgatactggttctggagttttctcctgggcttctgcttcagaaagttggattttctgtatctgcctgtctgtctctatagtttgggggcagtgatttgccctgtaattgcaacctctaatggatctaggaagagttgttgattttcactttgtttagcatttttcttgtgaggataagagtgataactttcaagctccttacattctgaaccagaaaatgaaagtcaggttttcatgaattagaaacatgtctatttgcatttcattgatgataaccagtttaaaatcttcatgttacttccaacatctggttcatcatggagttggactacatcgattttttttttcctgtttatagtgtgttctattttcttgattctttgtatgctgggttcttttgagttatatcttagatattatgaatgctaaattgaggaaattctggattatgttattttcacccaaaaagtattggttcctttgttttagtatctagttttgttgactgggcttgaacagctaactctatttcttttgcagcagctcttatcttcattcagatctttgtttttggatgggctgctgaaagtctggactgtataagcatggttcagtgtttagtcagaaatgtgagtgtatatatatatatatatatatgtgctgaggagggagaggatcctataggttctgagctcatcatacccagaaatggaaagttttcaggaatatttccttgcgggcaaaaaatctctgctttactgaataatctcttagcaaccaggaccatgtgttccttcagtaacttttggtgaggtagaatcttgtgatgtcccagcctcttgatttccatataacagggagtaggggagggagacattgtggagataatcagaaacctttggaggctatgagcaacctatataatcccacctccctcagttatactgaaatttgagtagcttttcacagaatctgtaaattttttattaacctagttaggacttttttgagccaaatgctcatttctactgttcttaatacaatgcctgtcacaaagttaggtattcagtaaatactagttgaatctattaattagggattcaccataaatttctcgccactaataaattacctaagtgtgaacgttttgtttatctcggaaataagatgattaaataaaaatatttgcatatttttcatcttgcattcatgttgatacacagccaatatatttcaagtcattttaaataaaagattaatctgtccatgatatactttgttagataaagctatttaaatgaattgtttttggataaatcctgtaatggtgttttctacttcttctttttaactcatttgttgaaagacggtagggaatagtggaccaggtaattaaataaagttcatgttgtagtttctgcctcatatgatagccaaagtaaatgagattattaacatgaacactttaaagatgtgtatcaaaattaggaggcttatagagagtctcaagtaattaagtgtgtagcgtagcaaataatgactttctctaatattggggttaagatgttcagcagagtatgaattataaaatcctcaaaatacaacttgaaagacttttgacttttagcccattatcctcttgttaatgcacatgtaagagattatgtggggtttttatgtcattatggcaaattataggctgtactataggtgctattcagtattggatacgaatgagttccaagtagctttgttgatctttcactaaaactagggatttggcattgacttatcagtgtgattattgtaaaagagatgtagtgtggaactgtttcctgagattaatccaagtattcagtatcataatttagaaactcccttcagttatctgccctacgtctccatttactcagtaatgtacgcagactgggaaaccttaagaagggttgagacttctgggttcattacagagctgtgggtagccatcttgctgttgttgactctagtgacctgtaactacagatcaagctgtatgcagcctttttctccttcaggtaagttgggttgaaatccagtgctccaagctgctctgaggctttaattgcatgagtgaacactgaaaatgtgaaaaacaattttagaccagaatagcaaggtgagtaaggccaaagaatgtattttatggatattcatgaatgtcacccacagaattcaatattttttccagacgattctgaaagattataatttaatggatgtttgttttattcttctgaggacccagttgaaatcctgttgattctgtagcagactacattactatcctttgtcttactcttatatctctgaggtagatgaatgcttcagaggtaaggtgttatattttcaaaggacttttctatgtttcgttgtatctgtgtgatcagaaggacagggagaaagtctgttttaaaattagcagcatgagatattagaatcctataatgcttatatgaagtttggtgaaatggttagccaaagagaattttctcctcagactagtaactaaattgatatgtaggagcagcctttcctgagtgactttccttgatagttaaaactgcagcaagacatttcagaagcagtttccaaggaagtgaatggatagtgaggtaattttcttaagtacttggattctgattgtctccagaggttttgaagctgttagttacacaatagacggatttgatctcctaggatctttgccaggttcgtaattgcactgagatttttaatgataacaaatgacaacatgatgtccttctctttattctgggagtgaggtgatttgtacataagaaacaaaattaggttttagtttgaaaggcttggagaatcagacttcttttaggccaaatacagtggtatatctgagagaagagttatacagccattgagttgtaattgcttgattcattaaggtatccttgaaaatcattagactgtcagcagcatgagggcaggttttatgtcattttggtaatcactgagtcctagcacaatagttgactgtggtaagtccttatgaatttttgttggaagaatgggaagtatattgaattgcgacatctttttgctttttttttttttttttttttttttttagcatgggattagaggcagcagttttggacaggaggcaagtcttttggccttctgctcctggcaggcaagtcttcattttttaagactctcaagtgtcaccatgtttgtgaagacttcttatcttttctaggtgcaattgacctgactagtcttcctataatgtgtcctttacttactgcttttatagcgtctgtgatgggtttattgcatttttatttgcttctttctaccatagtagaaagtgcaattattattcatctgtctattcctggtatatatattagtagaaaaatgttccactgcaagtaacagttagcaataattatcggccaaggaagttaatctcagaaaatagtaagaaatgtgtataaaacataggtagatatatgtttagtgctatttataatgaagaaatagaaccatcctagactaaaaccaatagaggactgattaaataaatgataaatatttatataaggaactatgaagtcacaattaaaatttatgcattttccaaattgcctgccttaagtatatatgagtttggtgaacagaaaatattcctgacccatatcatacaataatctgtattcaacccaatattggttttgtgttatagataaagtaaaaaaggagcagtaaagaggaaaatgggaaattaaaatattgttcaaatctacagtgaaataaaggtagtgaagtaggcaactggtttgtttagacagtccaggggatttggtatcttattcatcagttattgagtgtattctctgtgccaactaagtgttggatgctgtgacaaatgcagataggccaagtcatggcctcctccctcaaagaacttgcaatctggggagaataatatacacacagaaaatgggggagcaaacgaaaatgagtactacagatttgaatgccatagatattcagaggacagagtgattacatcctcctgggctgatgaagatacatttctaaggaggagaagaattatactgtaattaacagtggctttaggatttaaataaaaatggaaggaatatcatatttaaatgaaggagaatggtgtgaacaaaggcatggagatgggaaagtagacagcatttgcagagaactagcttgactcaaattttaagattcttcttgtagtagaaaagcaaataaaaagggccagaactccgagagcctgtcttagaacctctgattcatatttgcatgcctttatatttgttgcttttaatttgcaagttgcaaaaatgggcattttaatattagaaaatctactgtaggacagtaagctgagagctgataattttccattcttggttcaatactttagtgaggacaacattagattaagaatcagacctggaatgtggtactacaggttataataagtagtagctctgtaaccaaactaagccttggtttcctcatctgtaaaacaggtatgattattcacctctctggactcattgggtttttaatgagcagatcaagtaaaatggtatgaatgtgcttgatgtagagctgggggagcaagaaaaaaatcttcagacagaactccctccatacctctgttcctgtacctcaactctgatgaaaagatatgtaactaggggaaagaaggaatttacagatagatttgaatccacctgaaaatggagtactaaagtggtaatagtccagaaaatgttccctccacccagtaccatatcctttagtacattgtttcccgacagttagactccagtataaggttttggggatactttttagctataaccatataataacaaacatcctattttcttttggctgattgatcccagggctgcactgattctgtaaaccaacttggcaggatttccacaaactgcttctggggagtagtaattcttagggaaccaaggctacccccaaatgaactataatactttgcccttaattctttagaatggaacaataatcagaattatcttggcccatggagttgcttatcagcagttctctcaggactgctgttctttttggagaagggccagtagagtgagtcagatcttttatgttttgtttatagagtgaccatctgacattggtctgaaccacccaggtgcaatgagtttcctttggcatgatcattccactaggtatgctttcgattgtgtctaagttgttttaagaagccatttgagtgggccagtttctaaatatgttatacaaatacagagtacattgcttctatgctatcttgcccttggccgacttataagaaagaagttataagaaattatggcattaaatgtgttattgtatatactataaggatgttgaagacatcattcattacatttcttcttttgaggacactggataatttttctgtctaatctcgaaatcataagtaataaagtttctgggcaactggtttatttttatcttaggataccatagctcatgtaacaaattatttttttggcattggctactaggaggtttaccccttactttgtcaaaattacagaaccttctatatcctgtctctgtcttatctctcttattattgatctttccctttgtcatgtttttctcaaatgcttatttttaaacttttattttatcttcttttattacatgattttgtgtaaatcatgtttaattctttccagaacaggcctacctagtgtgaataaagtgaatttgatacagaaatattaaatttaatttgttgaattggtgtacatatttccttttttatcatgatttggtgataatctaggacaccaattaagtgatatccagaaatatataacaactgaaattttatataagataatttgtgaggtaaagcaacaattgatcatatgcatataataacccctgcaatgaacaaacaaagtgtgcacagattatatcttggccctttcttctcaagcttccctgagtcttcatacatttcacctggaagccttttataggagaggaaacatactcctaaaaatatctcacagttggtgaaggaacagaatggacttgtctgttgtgtattgcctggtcggaatcaattattccacactcaccctttgtgatctaactctttcactgccataccatctccacttcactataggaaagcttcaatttttgtagtttatttcagttaagtattaagaggcaggctggttaaattaattgacacatgtgaagagctgataacccccctgtttaattttaccagtagtatgcacgtgcttgccccaaagaataagatagctctgtctccagatgtcttgatctaggttttcacactcttcttccccaaggaaataatgtagcagtgtactaagatatacacagctatgtgtatatcttgcagctatagatatatatgatatacacagctatgtgtatattttgcagctacaaaaatataatcaaatcttaaaggctgcataattttccagtgtatggatataacaaggtttatttccaaatggtaaaacatttaggaatggttaaattatggtacatgagtataatgcaactattaagaatcatgtttataggaagattcttataatgtatgaataaaaacatagaatacaaactggaataacatatgagctcaactcattaaaatatctttttaattcaatagatttttgcatgtctagtatgtgtcaagtttagtgatgcatatgaggaaataacatcaaataagatacacatgatttctgaaagcattaactaaaataggacatcattacaaaatcaaatctccctttgaggattggtcatttttaatcaaatgtgattaagctcattttctagtttgtggactttccaggacccttgtttcatttctcttctgctttctctccgagaattcatagcactccagttcaattagattgagttgaagagtttaaaagcaaaagaaatcgataattcaagcctagaattccacattatttttagattttctttacctatgtagttagtgtaacctaagaacatcaccttctcccaggaatccatccttgtaattttgtctgggctacttctgcaggaaaagatactagtttgcaaagggaaaaagtgcttctgcacgtgccttttaattttatattacaaacaaacccacactcatgcttttatgagatgtaattcttattgttatgtagctttaacaatttaattttttgttgagacaaatttcctttgaataatttttaatgatatttatagaacatggatctttacttagaaagtctttattgaacatgtaaatcttatttaagaattcatcctgcaaaatatatattcttgagaattgaggctaatgttttattatctctgtcaagtcattacattttggttctcctggtagttgtaatgtgatattcttaaacattcactacagtgacatgatttagtatctagtgatgcaacagtgttacatctcacagaaataactgtgtccttctaaggcctcagaggcatatcacatttgtcccatatgctatttgcaatgatttctcaatgtcatttttttgtgacatgcttatacagtatgacaatgtgagagttaaaaatgtgagaacctatttctctctggttgaattgtctatattgacctcttgaagtaatttagtgtatctgaccttatttattttaaaattaaaatacctgaacttcttatatgatcacttttaaaacaccagattgttacatttggagctaaaattctgtgctgtggtatgcctaagatgatacaaccaaagccacattgtttattctactttttcacttatacatggtgtccattatgcattgatcttgtccagcaaaattaactttttaaactgattgttctgctatctgaagaatcttactaaaatttaatcggtaaactaaaaataagcacctaatgccatagtgcattctggtaactcataaaagaaaaaaaaaaaagaaactaaagcctaatgtaggcttgtgaggttaaaggaaggttagtatatacttactggccattcaagggtatatataaatgaccatttttcctcttttgagaagggtgatataatgcaaccacacttacaagtgatatactttcccgtttgcagaatatttactgttttgcctactatcactgaactgccctgagttatataccgctatataatagggttaaaactcatccgtgtcccttcatttccatggaaaagactttctggacagtggctaaggctaacataagattcttgagctatctcctatgtgtggcttacttcccacccaccaaaatgaagcaaatcctgtccagatgcattgtcttcataatggcttctctcttttttgtctcatttctaccttaaggattccttctgccttactgctgttcttatttctcttatatttctagaagaggcacgtaactatattcctactattagttctatcttccttttattttgatgactgttctgttgctccaagactcttattttcacaatattatacagaactcataagtttaggaaattatggcctttagctgatccaaaaattgatgtatgtttaaatggacaaaagacttgaaacaggcacttcacaaaagatattcaaagggccaatgtgcaaaaaggtattcattttcatcacttatcaggaaaatgcacaatgtgataccattaccccctcaagagtaacaaagatgaaaaagacaataccaagagtttgtaagaatatagagatatagaataattgaaactctgctgggagtgtaaattggtacaaccacattggaaaactgtttagtagtaatgagtagagctgaatataggcagcatgtgacccattaattctacttctacacccaacagaaatagaaatataggcatacacccaacagaaatagaaatataggcatacatccaacagaaacagatacatagtttcatcaaaagacatgcacaagaatgtttacagcactacttgtaataaacctaaacttgaaataacttaaatttctgtcaatagaatgaataaataaatggggatatatacctaacatggaatcagtagtgagaatgaatgagctacaactatatgcaacaatatggatgaatcttacaaacatgatgttgagcaaaagaagcttgatccaaatgagtacatactatgattccatttatatgaaattcaaaaacacacaaaacgtgtaataagtcagggtagtcgttacccttattaggaattagtaactggacaggaagcagaaggagggtttctggggtgctagtactattctgctaagtgtcttgatttgggtgctggttacctgggtggactcactttgtgaaaattcaacaaggtgtatactaatgattcgtatacttttctgtatgtatgagatatatatgtgtatatatatatataatataattttacaaaagagcagtactatatgctgtattatttatctaccactgcataacaaattaccccaaaacttagcagcttcatgtaataaacatttgttatctcacacagtttctgagagcaatctaggagcaactcagctgggtggttttggcatagggtctctcatgagattgctatcaagatgtaggctggggctgcagtcatccaaaggcttgactgggcctgaagcatctgcttccaagatggcttccttttttttttttgtttttcagacggagtctcgctctgtcgtccaggctggagtgcagtggcgtgatctaggctcactgcaacctctgcctaccaggctcaagcgatactcctgcttcagcctcccgagaagctgggattacagatgcctgccaccatgcctggctaatttttgtatttttagtagagatggggttttgctatgttcgccaagcttatcttaaactcctgacctcaggtgatccaccggccttggcctccccaaagtgctgggattacaggcgtgagctactggtgcccagcccaagatggcttcttcatgtacctgttgagggatgcctcagtgaaagctctttgtattgccagaggctacaaaataacctcacagataacattttatatatgtataatatgctcttacatatgtgtttatacatatctaacaaatgatatcatgaatactgttttataattttttctctactcaatacattgtggacatccttttttattttttgattggcttatctgtagatctattttatcctttttcacagagctctgttgaggtataattgtcatataattggcatacatacacatatttgaagtgtacaactggagattttttttatgtatgtgtacactcatgaatttatcatcacaatctagataatgggcaagcagtcacctgcaaaagtttcctactgtccctttgtaatcctcttctcatactttttaatggctgaaaagctttatttgcatatatgaagtgtctttaaaatccatacttacatttgctcacacatagctcaacctaatattttgtttaaattgtaggatgctcaccccatttagagaaagaaatccacctccccaaccccaatcaagaacctgctattgtatatcatcatagagccagattacctaggtaagaatcttagccttgccactttgcagacattatgatcctgggcaaattgtttaaccactctgtatcaaattccttacctgtaaagtggggataataatagttttatatttaactcataaaattgcaaagattaaaggaattaacacaatgatctgataacaaagcactatgttattatctgctgctgttattattcccatggtttgttatgctaaaagcctcttttcagtttctcctgatgatattaaagatacgagttgccaggaccttgtattcaaatagcctaccagaacttatctcctctttttaattcctacttctctgtcacctccctctgagcatcttgataaaggtgaggagaagtatgtagctaatcataggctgtttaagtattggagagtttggctttagggacatttcataaggtgagagatacccaaaatagaacacttaaaacaattccaagaccttatcaaccaagatgtcaaaatataaattacatttctacattaaaaaatgttattgatcactttgatggtaatgattacacatgtataataacctttccttgagcacatactaagtgtatattctaggaaagatcctaagaattaaggtatttattgtctttatgaagcatactatattagtctgttctcacattgctataaagaaatacccaagactgggtaatttataaacaaaagaggtttaattggctcacgtttctacaggctgtacaggaagcatgatactgacatctccttagcttttgggaaggcctcagggaacttaaatcgtggcagaaggcgaagagccagcacttcacatggctggaacaggaggaagagagagaggggggaggtgctacacagttttaaacaatcagatctcgggagaactcactatcacaagaaaagcaccaagggatggtgctaaaccgttcatgagaaactgaccccatgatccaatcacctcccaccaggacccacctccttgattgtgagatttgggtggggacacagatccaaaccatatcattctggcactagccccccacaaatcacatgtccctctcacattgcaaaatacaatcatgccttcccaatagtcccccaaaatcttaagtcatttcagcattaactcaaaagtccaaagttcaaagtcttatctgaaacaaggctagcccctcccaccaatgagcctgtaaaataaaaaacaacttatttccaaaataaaatgggggtataggcattgggtaataaatccccttccaaaagggagaaatcaatcaaaagaaaggggctataggctccatgcaagtctgaaatccaggaaggtagtcattaagtcttaaacctccaacctccaaaataatctcctttggctccatggcctaaatccatggcccagtgatacaaggcgtgggttcccaaggccttgggcagctccacccctctggctttgcagggttcagcacccttggctgctttcaagggctgatgttgagcaccttctgcttttccaggctgagggtacaagctgccagtggatctaccattctggggtctggaagatggtgaccctcttctcacaggtctactagacaatgccccagtggtgacgtgtgtgggggctccaaccccaaatttctcctccttactgccctagtagaggttccccatgtgggctctgcccctggagcaggcttctgtctggacatccaagcttttccatacatcctctgaaatctaggcagaggctctcaggcctcaactcttgctctctgtgcactcacaggcataacaccatgtggaagctgccaaggcttatggcttacatcttctgaagcagtggcctgaactgaacctgggcccctttgggccacgactgaagctggagcaactgcgatgtcgggagcagtgtcccccggctgcacagggcagcagggccctgggcctggcccatgaaacagttcttccctcctaggcctccaggcctgtgataggaggggctgccatgaagatctctgaaatgcctttgaggagtttttccccatcatcttggctaatagtatttggtttctttccacttctgcaaatttctgcagccttcttgaattcttctcctgaaaattgacttttctttcctaccacgtggccaggctgcaaattttccaagcttttatgctctgctttccttttaaatatgttccagttttatgttatttctttgcctacacatattagaataggtggttaaaagcagccaggccacatcttgaatgctttgctgctgagacatttcttctgccagatatcctaaatcatcattgtcaagttcaaagttccacagatccctagggtgggggtacaattcagtcaaattctttgcaaggacataacaatagtggcctttgctccattttccagttagttcctcatgtccatctgagacctcttcggcctggccttcactgtccatatcactataaccattcaaccagtctctaggaagttccaaactttcctgcattttcctatctccttctgatccctccacactcttccacctctgcccattacctagttccaaagtcacttccacatttttaggtatctttatagcagtgctgcactccttggtaccaattttctttattaattcattcttgcagtgctataaagaaatacatgagactgggtaatttataaagaaacaaggtttaattgggtcatggttccacaggctgtataggaagcataatgctggcatctgcttggcttctgggaaagcctcaggaaacttacaatcatggtggaaggtgaagggcagccagcacttcacatggctggaacaggaggaataggtagaggggagaggtgctacacacttttaaacaaccagatcttgcaataactcactcactcattctcacaagaacagtactaaggggatagtgctaaaccattcatgagaaactgctcccatgatccagtcacctcccaccagacctcaccttctacattgggaattacagttgaatatgagatttgggtagggacagagatccaaaccatatcacatattatcaatttaaagagatgtggctaggatttgtaggggtgagaatagactgggatctgctgttagagcaaaggaagtgagtaggtcttactgattggtaatgttagattgagccatggatattgccactgttttaaacctgtgtaatgggagtttgttttactactttccctaaactgaaaacaacctgtcttagttgattcaggctgctataacaaaatactttaggtaatttttgaaaaacaaaaatttattgctcacagttctggaagctggaagtcaaaaatcaagatgacagcagatttagtgtctggtgagagcttactctctgcttcaaagatggtaccaccttattgctgtgtcctcacatggcaaaaggggatgggaagctccctcaagcctcttttataaggatagtaatcccattcatgagaatggagcctcatgacttaatcccttcccaaaggctccactccttaacactgtcatattaggtattaatttccaacatatgaattttggagggacaccaacattcagaccatagcacaatccaaatgtctatcactggtagaatgaaaaaatgaacaggggtgtgtgtgtatgtacgtgcctgtgtgtgtgcgtataatatacagagccagtggtaagaatgaatctgctacaattacatgcaacagtatggatgaatctcacaaacaagatactaagcagaagccaaaaagatctaaaagcatacactaatgatttcatttatatgaagatcaaaaacataaaactcatttatggtataagaaatcaggctagtgattcctagtgcttgccactcctttcctcactctgctaattccaaatacagagcttgtcctcatcactgtagacaccaccactactcttactgtcacagagtgtccaggatcgtcttcttcagggcttataagttccagggaagttacaaggatggctatctacaaggaaacattgaatgggaactggctaaagcctcaggcatggataaaaattggatgggaactggctaaagcttcaggcatggataaaaactggatggcaactggctaaagcctcaggcatgggtaggcatccttaaggtagggaggtcatcagcaagggagtggctactgcccaagggaagccctcagcacatagccccaggaatgattctgaccatgtgcttgctcttatggtctgtagatgctgaacccacccccaagggcctcctgagcattcaagaaatggtcgtcactaaaaatgctccttcatttttaatctgtttgattcctttcagatctgactcttccaacctaggcctcactgatttctctctttccttcaatccagaggagactttctagcctgggaggtgggtttggatgggtaggattggaggaggaactttgctgtcattattttatttaatcatttcatctgctagaagacttcttgcttttcccgagtaccttaaaagacagaaaaacttattttttctctttttctgacccatacttgtctttcatttgaagcaataaacacaaaatggcttagctacttgcagggcagatggtaaatacacagtaaagaaagaagcagaaaaaaaaaatcaactattgggagaaacaactttagttaacatcttaaaatgtcattccataaaacttgggttgaattaggtaataaaagtattattaatattatggaatttcgaggagaaacgagtttatatgtgtggtggagaaaatatttgtttttagattcatagtatttcaggtggtggcaagatatccaggtgtagatttctctgaggcatttagaattgtagaactgaaggggtgggtcaaggctgaatgtatagatttattgggatggaagggaaaattcaaacatcattgtggatgaaataaactatttctgttagagaatacaattgactttatgaagtgatttatagggcatctagattgtttgatgtggtatgcaatgacgtttttattcactgaggtgtttctatagttaggataattttatttagatggttgtaccattatctttaatattttattgtgcactagaaatataagtcccactgtcatataaaattagtatctctcacttgaaagagaattctcttactgttgttattgatggtgctggatctctgtttcaatgatacttacactgggcttccttgttttttttttttgacttgttgatgtgtgaaaattcagtaagccatttcattgtatacaccagggattgtcaaataatggctggctgccagttttttgtgtccatgaactgagaatggttttacatttttaaatgctttaaaaaaattaaagaagagtattttatgatacatgaaaactatataaaattcacatttcagtggccataaataaagtttttattaaaatatagccacacacaaatttgtttctgtggctgctttcatgctataatagtagagttgggtagttacaacagagaccatatgaccctcacagcctaaaatatttattctctagctttttactgaaaaagccaactgacccctgatatacaccaactgatgtatcattagaaaactagtgccaggtgtggtggctcacacctgtaatctcagcactttgggaggctcaagcttgcctagctttgcccaggtgggtggatcacttgagcccaggagtttgagaccagcctgggcaacatggtaaaaccctgtctatacaaaaaaaaaaaataataaaattaccaggaggcttaggtgggaggatcacttgagcctgggaggcagaggctgcagtgagccgtgatcacgccactgcaccccagccagggtgacagagcaagactctgtctcaaaaaaaaaaaaaaaaaagaaagaaagaaaactagtaaagacaagtatcctcccaaaataaataaacccacagaagtacttctcttacacaggcaatagttatttaaataacatcttttcctgccttatttttctccttgataggtaccactatttatcactgttttacacactatacttttgcttgtttaaataaacagacacaggttaactatttcttccctctagattgtacctttagtgagggcaggggtttgtgtctgtattgcttactgttggattctctagcacctaagcatgtagtagacacacaatgtatattttatttgagtatttacatatctgttgaattgagaaaccaaccactgaatttgctacatattactgtatccaactctgaggatgattggacaacagaaacaaagtatcctttgttcatttgcatagcttgcctagctttgctctagagattgtaggaggtatctctgaatttcagcaacatctaacagcattttgatgctcttccctagtgtatatagcactgaagagcagcatgtataaatatacatatcagacacattcattttttaaagtatttaataatatacttttataatgtattttatataattatgttaatgtataatatattaattttatattatatttaatattaattatacataatattaatataaatttacatatatctatacctcaagcttttatatcaattattgtttttatacatttgaaacagtaggctttgtgaagtgaatggcacatagtaaatacctaaaggttaaaataattgaagaattaagcaagctcttaggtaataggttattttatgaagacagaggtattgcttagtggtttcccactgcatttacaaggaaatccaaatggttttccagccagtaaagccttgtatgatttgactgtttgtctttgtctcccaccttctcccttgctggttatgctgaaatcaaactgaacttctttaagttactctattaccttaaggtcctttatttatagttaaacaaaatattatgactcccccatagactctaagctctattagggcagggatcgcagatgccttattcaccattaacaacccaatgtttagcaaaatgactgaaatataataagcagtaagtaaatattttttgaacgactacatatgtgattaaaagaacactggggttgatgtcagaaaccctaggttaaaatcttgggaatgcattctgaatcttgatctaggtgccaattacacaactgtgtttgtgaaaagtcatcgagttttaatgttggcattttttatgtaaatgtgttgataagttttaaaaaacccagtcctaagatcctcctatttactatgcaaacatgagtaagtccatttctctgaaatttagttttatcatttatcaagaagtctttttgtacctatctcatagagttgttgcaagcactgatgacataagtgaaattgccttatcataatagatatacaacaaataccagttgaatttctattctttgaaggatgtagaagcagaaagatgcagaggtgaaactcccagaggccaaataggatgaaactttcacttacagaagagctcttagatagccaaagagagttgtgactttaagagacaccacgaggagggaatgaactccagggagcgcctgatctctagagtatgccacagggcccttagatccttttacccttaaaaattagaagggccttggggtctggggaagagcaagaggctgggattggcaaagccttaaggagagtaaccaggtattatagtcatgttgtgtccaagcactgtggtggacagtgaagtgattgacctgcctaattaaccatgagagagccatgtggctaaaaagtaaagtcaacatagaagtcctctacaaattaaaatgtagcctgcagtgtttcaaaactaataaagagctagatataattgaatcgcagaggattactggaagaagaataactaccaagaataggagtttccagtctattgtcacaggaagcctgggaaagaggggcaagtacatttaaggaacatcaaaaatggcaaaggaactcttagagaacctccagttctctaagagttccaaatttaaatcattccaaatttaaaacatcaaagcagctgaagccaaatcatatttaacttaaaacattcagcttacaaaatataccttatatcactctctgtctgaagtagtaatagttacacttaatgtattgaaccatattgaccaactagaagataaacctcaagaaccagattgtaccaaaacattttgaggggaaaaataccaaatctttgttagtatcctcataggtcctgcttactgttactaagaactattaaaactgttatttaatcctccctcaaagcctgtgaaattagagctactattaataaccccattatggttgaagaaactaagtcttaaagaggctaaataactttcccaagatcagatagatggtaattggcagacaaggcctcaagcccacatatgtatgatagcaaaacccatgctcttacctgttgttggaactctttgttgagatgtatataacgtgtcatcatttaaaagctcacgcttgtatgtgtctattaagataagtatatcaaggctgggcacagtggttcactcctgtaatcccagcactttgggcggccaaggcgggcgaatcacgaggtcaggaggtcgagaccagcatggccaacatggtgaaacccctgtttctactaaaaatgcaaaaaaatagctgggcatagagatgggtgcacataatcccagctactcgggaggctgaggcaggagaatcgcttgaacccgggaggcggaggttgcagtcagctgagattgcaccactgcactccagcccaggccacaaagtgagactccatctcaaaaaaaaaaaaaaagatatcaaaacatcaagttatacaccttaaatatatacaattaagaaagactatagtaaaaaaattcagactgaaaaatcaacaggaaacaaacctgatatggttctcagaaaagatatactttccaaaaggtagataaaatatgatacagattctattattgtcccaaattaaggaaattttagtgcatctaataagataagtaatatataaaagagcctaacattttccctagtatattataacatagtaattattcaatcaacattcaaacaactgtatattatacagtggtattttgtttggtattttctgaactgaaatgatagcagctcccaggaaattgatataaagtcagtctggatctccatctaaaacatagtgtccactttgcaaccttcagcctgtatttggggatgcatacttctgtatatagttgtttgacagttttagtgatgctgggctcctaataatgtggatattagtttgctctacctaagtactgtactgaacactgcatttctgcattgttaagttgtcatttctaaactgtatgaacaatataaagatcaataaagtcttaacttacaattttaaaagctgtggtactggacatctgttcagtgccaatatgacttccatatacaagaaatgcacacagagaagaaatcctgaaaactgtagattgttgactcttacttgaatatacttgatacggtttggctgtgtccccacccaaatctcatcttgaattcccacgtgttatgggagggacccagtgggaggtaattgaatcatggggggcaggtctttctcgtgctgttcttgtgatagtgaataagtctcatgagatctgatggttctgtaagggggagtttccctgcacaagctttctttttttgcctgctgccaatcatgtaagatgtgacttgctcctccttgccttctgccatgattgtgaggcttccccagccacatgcaaccataagtccattaaacctcttttgtaaatttcccagtctcaggtatgtctttatcagcaatgtgagaagagactaatacaatactgagagtatcatgtataacattgttactgaattgtaaactcaaaaaaaaaaagcagataatttgtctctcgtttgccaatttttttctctaaggcagggttttttaactttgacactattgacattttggactggttaattctttcttgtagggggctgttctatgcattgtaggatgtttagcagtacctggccccaacccactagatgtcagcagcacccctctccagttgtgacaaacaaaaatatctctagacattgccaaatgccccctcgggggaaaattgcctccagttgagaaccactactctgaagaataaaatagcgtgtggcaaataaaagacactcaccaaatatttttggattgactgaagacaggaaagaacagtctcccacaaaatgtaccacttgtgatatgctttgaatatctaggtatgacctggaaaaatttctataactttaatagttatgtattttatatacattagaaaatatataacatgacaaacccatgtttttgcctgctattttataggacagtgctaaagtcgatactgaagttaaaaagtaacttaattgaaagaaacattaactgtacacaacagatacattaaacacaactcatcaaattgattaaggtggtatgtgaattactggagtttgaagcactcatttatactaagggaaacttaagcacaaatgagcttcccctaagtctggtttgtgtaggccactagaatcctctttgggaatgatctactgccttgcacaggctagatacaggtgttgaagacaaattgcttactctttgagaattagtctgatagacactataagatatgaacatcaggatgaggtagcattatgagagttcaaaggaaaaagaaattactttctactcaggtaatgagggaaaatatcactattgatattgaaggatgaatggaatttttgtagtagataatacagaggaaaagagcagaggcaaagagttggaccagttcaaaacatatttaagggatgagtagaggctggtttggctggagtgtagtataactattaaggaaggtggaacctgcttgtagagggtatgtaatgccagggtgggttatccatagaacaaagattatttgattttctaatgtctggctaaaagctgctttgttgttattgtttttaagtgtattgtcattattttagaagtaatgtttagtttgggatggggacctgactgagaatcaagataaataaatactgctgcttacagaagtataaaaactaacacacacacacacacacacacacacacacacacacacatacacgctgaaagaagggaccagatgggggcagggcacagacaaacaaaaaaatagcagtaacctctgcagacttaaatgtccccgtctgacagctttgaagagagcagtggttctcccagcacgcagctggagatctgagaacgggcagactgcctcctcaagtgggtccctgatccccgacccccgagcagcctaactgggaggcacccccccagtaggggcggactgacgcctcacacggccgggtactcctctgagacaaaacttccagaggaacgatcagacagcagcattcgcggttcacgagaatccgctgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtatatcaccatcatcaaagaccaaaagtagataaaaccacaaagatggggaaaaaacagagcagaaaaactggaaactctaaaaagcagagcgcctttcctcctccaaaggaacgcagttcctcaccagcaatggaacaaagctggacagagaatgactttgacgagttgagagaagacggcttcagacgatcaaactcctccgagctacagaaggaaattcaaaccaaagacaaagaagttaaaaactttgaaaaaaatttagacgaatgtataactagaataaccaatacagagaagtgcttaaaggagctgatggagctgaaagccaaggctcgagaactacgtgaagaatgcagaagcctcaggagccgatgcgatcaactggaagaaagggtatcagtgatggaagatgaaatgaatgaaatgaagtgagaagggaagtttagagaaaaaagaataaaaagaaacgaacaaagcctccaagaaatatgggactatgtgaaaagaccaaatctacatctgattggtgtacctgaaagtgacgaggagaatggaaccaagttggaaaacactctgcagggtattatccaggagaacttcaccaatctagcaaggcaggccaacattcaaattcaggaaatacagagaatgccacaaagatactcctcgagaagagcaactccaagacacataattgtcagattcatcaaagttgaaatgaaggaaaaaatgttaagggcagccagagagaaaggttgggttacccacaaagggaagcccatcagactaacagctgatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactcaacatggaaaggaacaaccagtaccagccactgcaaaatcatgccaaattgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgttcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaaaggatcaattcaacaagaacagctaactatcctaaatatatatgcacccaatacaggagcacccagattcataaagcaagtcctgagtgacctacaaagagacttacactcccacacaataataatgggagactttaacaccccactatcaacattagacagatcaacgagacagaaagtttacaaggatacccaggaattcaactcagctctgcaccaagtgggcctaatagacatctacagaactcttcaccccaaatcaacagaatatacatttttttcagcaccacaccacacctattccaaaattgtacacatagttggaagtaaagcactcctcagcaaatgtaaaagaacagaaattataacaaactgtctctcagaccacagtgcaatcaaactagaactcaggattaagaaacacactcaaaaccgctcaactacatggaaactgagcaacctgctcctgaatgactactgggtacataacgaaatgaaggcagaaataaagatgttctttgaaaccaacgagaacaaagacacaccacaccagaatctctgggatgcattcaaagcagtgtgtagagggaaatttatagcactaaatgcccacaagagaaagcaggaaagatccaaaattgacacactaacatcacaattaaaagaactagaaaagcaagagcaaacacattcaaaagccagcagaaggcaaaaaaataactaaaatcagagcagacctgaaggaaatagagacacaaaaaacccttcaaaaaattaatgaatccaggagctggttttttgaaaggatcaacaaaattgatagactgctagcaagactaataaagaagaaaagagagaagaatcaaatagacacaataaaaaatgataaagggaatatcaccaccaatcccacagaaatacaaactaccatcagagaatactacaaacacctctacgcaaataaactagaaaatatagaagaaatggataaattcctcgacacatacaccctcccaagactaaaccaggaagaagttgaatctctgaatagaccaataacaggctctgaaattgtggcaataatcaatagcttaccaacgaaaaagagtccaggaccagatggattcacagccgaattctaccagaggtacaaggaggaactggtaccattccttctgaaactattccaatcaatagaaaaagagggaatcctccctaacttattttatgaggccagtatcatcctgataccaaagccgggcagagacacaaccaaaaaagagaattttagaccaatatccttgatgaacattgatgcaaaaatcctcaataaaatactggcaaaccaaatccagcagcacatcaaaaagcttttccaccatgatcaagtgggcttcatccctgggatgcaaggctggttcaatatacgcaaatcaataaatgtaatccagcatataaacagaaccaaagacaaaaaccacatgattatctcaatagatgcagaaaagacctttgacaaaattcaacaacccttcatgctaaaaactctcaataagttaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagtgcaattaggcaggagaaagaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggataaaaaatcaatgtacaaaaatgacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaatgaaattaaagaggatacaaacaaatggaagaacattccacgctcatgggtaggaagaatcaatatcatgaaaatggccatactgcccaaggtaatttatagattcaatgccatccccatcaagctgccaatgactttcttcacagaattggaaaaaactactttaaagttcatatggaatcaaaaaagagcccgcatcaccaagtcaatcctaagccaaaagaacaaagctggaggcatcacactacctgacttcaaactatactacaaggctacagtactcaaaacagcatggtactggtaccaaaacagacatatagaccaatggaacagaacagagccctcagaaataatactgcatatctacaaccatctgatctttgacaaacctgacaaaaacaagcaatggggaaaggattccctatttaataagggctgggaaaactggctagcgataagtagaaagctgaaactggatcccttccttacaccttatacaaaaattaattcaagatggattaaagacttaaacgttagacctaaaaccataaaaaccctagaagaaaacctaggcattaccattcaggacataggcataggcaaggacttcatgtctaaaacaccaaaagcaatggcaacaaaagccaaaattgacaaatgagatctaattaaactaaagagcttctgcacagcaacagaaactaccatcagagtgaacaggcaacctacaaaatgggagaaaattttcacaacctactcatctgacaaagggctaatatccagaatctacaatgaactcaaacaaatttataagaaaaaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccataatgagaaaccatctcacaccacttagaatggcaatcattaaaaagtcaggaaacaacgggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgtggcactattcacaatagcaaagacttggaaccaagccaaatatccaacaatgatagactggattaagaaaatgtggcacatatacaccatggaatactatgcagccataaaaaagatgagttcatgtcctttgtagggacatggatgaaattggaaatcatcattctcagtaaactatcgcaaggacagaaaaccaaacaccgcctgttctcactcataggtgggaattgaacagtgagaacacatggacacaggaaggggaacatcacactctggggactgttgtggggtggggggaggggggagggatagcattaggagatatacctaaggctaaatgacgagttaatgggtgcagcacaccagcatggcacatgtatacatatgtaactaagctggacattgtgcacatgtaccctaaaacttaaagtataataataataaaataaaataataaaataaaataaaataaaataaaataaaatgaatcttaacacacacacacagacaaaaaagaagggaccagagactagaacagcagaggatccgaatggaaagatcattccatcagaagaagcaaggaggtaacctgggcctgggggagtttggggcttgaggtgatatgggtattaggccttgagccttttatctctctaagaaaattgtcttatttaaaataagatgctgatctttggaagtttattactgaaacgctcggtgaggtggctgacatgtagtattgatttttgcctccttggttttatcttcccctggaagatggctgcctccagtgatgcttgttgtctccaccatgctgacctctggagcagcaattcctctttgaaaatcctggcccatgcctgacagctcgttcctttgtggtttttcctaacacaactgaaataggtttgattcttttctaaaagactttattaaatattaaagaataaacaaaaaataaaatatgagaagtcctgccagatttacctagcatctctgatatcactgtccctggtcaagccactctcacacctcaaatctcctttccctactgctgccagaggtgtcttctttaaatcccaatttagctatatcactaccctgtttaactctttcatgcttctcattcgtacatggattatattttagtatattaactttcttttggtatttcctggagtaaggatggttttatagttatgttgacataatgattatttcatttatctgatttgaatgggttacagttaaaattgagatgacacttgggaagggtgagcaccttcctgtaaaaaggtatgagttctaacactttcctaaaggtttcccagaatagctttatctgaagggtcaggagtcactgtatttcaaattgtgcttcctatagtgctaggtttctgatgaggtatgtccaggccacctccagaaaaaatctcaatgggtgagactacaaccctccaccccaattctgcctgaagagttccaccctaacccattttttatatattggtggtccgcataaaattttttgagggctgtctgctgctttcaaaaaagatgtgttgatgagaagtcattagatgatttctaaagttcctttcaactccaaaattatctgagaatccagcccccttgacttctttcttgattcactttatgctaattttgttccatatgattaaaataatagaatttcagagctgcaagaaactttagcagttatcttgtccagttttccaaaatgagctccaaagaacaagactcctgagaaacgcccatcgcttacagaaaggactgtatagctaaatattttgagactgtacttttgtcccattgctcattagcattttaaaggctctgaaaagtcttataataaagaaacctgattaaattaagtcggtatttcctacatgggaagcatgggctctgtatcaacttactatgaccttctttatctggtactagtttctgccctattaccagatcaaagagctctgtttttgaataacacactttttaacatgctgtggaggataatttgggaaaactcatatagttgagcctcctccttttgcaaagaatttatgataggaaatgattgatcaagtgtcacacagctgattatcaggtctcagtctaatatttattccttattggtctctgcttaacttcaagtaggttatagattccttaatggactgatagtttatgtcttatagctttacctttcaggcgcttagtttcatattgggaacatgacaagtgaataataaatacatgatagctctatgattgaaccctgtgagaaaatgaagcattatgatatgaattggtttctgtgtatgtatgagtgtttttttttttcatcttttggaaacagaatttctgctcccctgtgtacaccctttctctgtaattgcagtgtatgttttttgtttctccaaagtttctgttgtcagtagtttatgatcattggttcatactgtttattggaaataactctgtgggctgctttgcctcagggctaatttgattagggatgctgttgttttacaccgtttgggaaaatgttacactttaaagggtattggatttgtcacagaatgatattgaagggaagccggagacaggaaagctagtaacttgctggcctggttattagcattggaccttttgggatttttgtctgccatttttgttgatactgctgttttctgaagagataagtgtgtgaccaatttgaggattgttatttggcacacgcagaaactagtaccagataaagaaggtcatagtaagttgatatagagcccctgcttccagaatattgtgcttctgtcctctgaggttagattttctctttgtgagggagaaaacatttatgtaagggagaaagattggaatgtactgaaatgaaatgctcacattgaccacatcagctgtactggagcttatctgatgtagccactcagcctctatcaatctgactgtgtgtatgtgctctgttttgtacagggaatcatcatccagggacgtgccagaaaccacaagaaaacatggggaggggtaagtttctcttcctttttaagtaattcagactgtctccatagctattatagtcaggaaattaaatttctaactcatagtatatttgtggacacctaaattgtatttcttgttagtgttagaaagtttttgtctgaagcagggcttttcagagaaagaccatcaaccacatttattcactggatctttgattttcttcttttgtagagacctcccagtatagggagagatggatcaagcttgatactatatatatagtatatactattttatatatataactcacagatactatatatatacaccttccccaaacccagcttctttataagtcttttttctgttttctgttttcttgctagtaacacaaaataaagagagtctactatgcagccaataacagtagtaaaaaaaaatcatctgtgaggttgatttgtaatttttttaaaaattttaaagcccggcattaagaaccattagatgaattccttttgtttatttttgccttctcataaggctgtttatgggcagtggacaacagataaatttaagttcatttcattgttaatattaagcagccaccacagggacttcataaataattctaattaatgtatatcatgtcaacctaaaataatcaaaagggtcagaatctagtttaaagagtttatttgagtgcaaaggttgaggacggactccaaagaatggaaatcactgtttccagttgtagaagtttggggatcactcgaatagacaaagtttaggatattttaacagaattttaacatctttctatgtaaggcttactgcatagttacaatgacctgattgatccgggtggtccttttctttcaggaaaggtatatttaacattccacactgaagatgtgattgtcatggggtctctgtttggggcaccatctggtctgagttaggtacaggataatagagtagcaaagatcagtgactgaaagggggaggtctggcctctggtctttgctattcatttacaaaacaatagcaatgaggaagagtgttaaactataacctaagaaacagaactgcaaaatgttatgtgactgaaaccacagtcacatgtctcccaaggcttaaagtgttttggggggtcccaacagcttttacattttattaattttcacaattataaaattagaatgccttgaaggatctcagaggaagatttggtgtgtggtgtggtatagtacagtgagaagaatactggatacagaaggcctgaattcaagttccacctctactaccttgatcaaatcctagaacctccctaaactcgtttgttcatccctgaggtgggattaatacattctgcacttctagcctcagaaagttgtcgttggcataatgtgataatacatgtaaaagtgttttgagagttctaaagtgtaatggaatacagcagtggtatctgcccattactgtccttactaactatatcttcattgtttttttaatggataaaaatgaggttatttgaccagatgcttctgtaggcagcatgactgggacttgggtcatgcaagcaactgagaattcttttgttgcactttgcttgccccacccttgtgtgggccctggtaggaagccctaaggattatggatcaatcatggaaaatatcttcttgaatcttgctgaatcagcttttgttcctgttttctccagagctgcccttggaaattgattaggcctagctattctggttctttccagatcttcacaaaagatggcaatctctgatggtttcgaaattttaaaactaaatgaactttttaaaaactattcggaattctgggactaatctgtgccacgtcctgcccgcaaatcagctctcaatggaagcttctagagtagtgatacggctccaatgactgggggaactccagggtccttagtctcatgtcgagttagataaaacgacacagatacacgtggagtggttttaagtagtggagagtttaatagactagaaagaaggaagaagctccctcctacagctgagagaggaaacctcgaatgtggtggaaaacagccagttatatgaggaggctggaggaggcagtgtctgatttgcatagggctcaggggattggtttgaccaggtatgtcgttgacatagcctgcgagaaaactggccctcccaccctagcgttttaatgtgcaaatgtatccccatgatgttctacacatgtgggggatatgtgggggtggccatgttgccaggaacatgttggggcaaggggaagaagatggtgggaatcgccacgtttgtgtggacccagtttccagtggcaggtatttgcatatcaaagcttgccggcccaactttaagagcctgggctttcccgctagacaagaaacgtttctggagcagctttaaaagaaacaaaaacttcccaaggaccccctttcctatctattgcctaaaataatttcttagtaactcctataacattagaacatcatgtttgatcctcacccaatcccaaaagcttcaagtggatttggagaatgttctggttgttggatactgctatagccatatagaggagagagctgcactgagacgaaacccgttctttctcatttcctctattcatttttagactgctcatcaggtcactagcaaagggactgttaggtgcttagtttagaagatgtctcagcaactttttgttcaaatggtcaggcaattagtagttgacctttgaacaatgtgggggctagggatgactctgttgcataatcaaaaatccatgtataatttttgatgcccccaaaacttaactactaatagcctactgttgactgaaagccttaccaataatataaacaattgattaacacatactttatatgctatgtgtattacatacagtattcttgtaataaaatacactagagaatagaaaatattaagaaaatcataagaaaaagaaaatgtatttactagtaagtggaagtagatcatcataaaggtcttaatttttgtcatcttcacgttgaatcagtggaggaagaagaggaattggtcttgctgtcttaggagtggcagagactgcagaaaatttgcatagaaattaacccgtgcagttcaaatatgtgttgttcaagagtcaactgtagttcttgctaaagaacagggcatggtaatgtaatctgcaaagataggcatgtttccaggctggtgatgagataagggaagtgcttcaaagaatgctgcttttacaaatacagaagcttgtgatagcattttcactgtgttgaccactttgaaagtatttgtaatatcctgaatctcaaagagactctatcctttactctctaagctttgcttagtttgcctgattacatttgttaattgctgacactgttattggggagaaaaagatgctactgtatgctcatttttctcttttctggcactgtacaatgaaatttttcctgcacttggcaaagattctcacaaacgtagcccagtgtatcatacagagggacacagaggaaaaatattgcaaagatatgacactagcctcataacataaattaaggatgcatgaaaacaaaaaacacacttggataactgtacagtttaggtgagaaattaaaactgaggtgaatttcttttagcattctttgatattagatgaagaagttatttgtacatatgtgttagaagaatcattcgtttatgtgacatgaaggattataaacaaaatttaaatattaaggtggggaagatgagaacagccttgtatatttaattttttattagtctactactaccagtgtccattgtgtgtggcactgaaatcccattcactatgtatgaattcttaaacagggcttagtatttaggactcttaagaatctataattattctgagattaacacatttctgtagagcactttataactcataggtattccctctacattatcttgagttgtaagacaaccctatgttgtaaatagggattattatcctcattttatgtattataaaactgaggctcataagaaaaagtcttatctgtaatccacagactactaatggagagccaaaatgcaaatctaggtcttatgttacatccagttttttttcttccaataaaccatgttctgcatatcttaatcatcagtagtgtgtaagtcaattaaaaacttaggagctctctgttgctgtgagaggtatggaagaaattattttttgatatctgcaatgttcatattatcatgagggactggacagataggcgaagggaaatggctcattgttcatcaacctttagggtaacagctaaaatacatgtgtatcagatggtggagtgcctcaaatattaaaatcctctgagcagcagtggtctatgtctgtggtaattcaaaaggcagctacactgattggcagtgaccatagtagataacaaaacaactcagttcagaagctcgtgctacacagtccacaagggaaggtgcctaaagtaaagggcctgatgccgcttacctggcctatgtgaaactcacccgtttgactgatgagtttttatctttgttgcttttgttgacacaaggaatataatgcatcatggaacaccagaatagcatgagatgacaagatgagatactggttcaaaaatgaacagcaggtataaataaaattatatgtaaaattctagtagagaacatttttacaaagagaatgtgaggattttacaaatgtgtatgtatagactcacatagcattataatataatcagccttccatatctgtaggttccacatctgtagattcaaccaaccatggatcgaagttatttgagaaaaaaacaaaaaaataagaatacaacaataaagtgcaaataaaaatacagtatgtaaacatagcatttacattgtattaggttttataagtaatctagagatgatttacagtatacagaaggatatgcataggttatatgcaactactatgccattttatataagggacttgagcattttggtatctgtggaagtcctggaaccaatccccagtggataccagatgactgttctaggatatttatctttaatcatcttcaaatggtaattagaactatattttaccttttcatttctcatctgaccaactggcatattcatgataaaatggtaaaaggcccagtactcccagtaagtattatctttacctacaatgaatatttttcagttttcttgctttaaaaattttgtgattattgtttttattacagtgtttcggtagaatttgatttttaaaaatatagctactttccatctgaatttttttctatctcagaacacatttctattactgaatcttctaagtgctgtagtttgtggtatctgctagcctcatatgaagttattaatggctattttcactgtctaccttaaaagcagagcttctgggagaagttcatcatgttgtcttgataatagcaaatcatgagctagctgctcgtacacatcttccacaaaataggaataatacttagccatgaattttcaaaaggattaattttgctttgttatatacaaagcaatatctggaatagcttaatgattgcaatcaggcaggtctactttgtggaggataatctgaattaaaatatgaagataacttaggattttttttttctgtttctcctcttccagtatttagtctttggaaataggtcttacctacctagcttagaagaaaatcttaggtctataaaatcttaatatgaaaagtcagtttccattttcattttctgtacttaatagtaacatgaccttaatgtcttagcataaatgaatttttatggtcgtgctatagcaaaacagtggtagtgttgccagttagtctttgtttcttattaaaacatagcagcataattcctctgggtccttgcatgtgctgggctcctttatcccaaggaactcaaacatatccccctagttgtcaagacttagtggaaggcaagatggtttacagccaccacagtaaatacataagttctttaattcactgctgaactattgttaagttgaagccaattctaaactttaactgagtgtacagctctatattgtcaaatagggaatgaaccttcaaactgacaagccctgtaaagtaactgtcttataatgaagtgcctaattttatttggctttatggttcaagtgaagttatccatttaaagtcaattaattatttcatttttctggcctatattagatttgagagtctctttattgtgacatattcaggcctctttagtttagatgatgtcaataatttattataaattcttatcttcagaattttataacagtaatacgaatttgcttgtagctgacaactgccataattttttcttggcaagtttttctcaccagaaaaaaaaaaagaactaacggagaggttacttttaaaaaactcattatagtgcttgatgctttttgtctttgatgcaatcctctctgccatttacttattaaagaagaaaataacctttggcacataattttagaaaggtttctcaactttagcactattgattttttttaatggaggcaaaatttatataacatagacttgactgttttaaagtgtataattcagtggcatttagtacattttgtaaccagaaggttgctgtgctgtaaggaaaatagttacaaaatgtactaaaggttgctgtgcaaccttccagttataaaacattttcatcacttccaaaggagatcctattcccattaagcagtcacttaatcccttcccattatcaacatcccttaccagagaggtacatttgttacaatcaatgagattacattgacatgtcattatcacccaaagtccataatttacattagggttcactcttgttgttgtatattctatgagtttgggtaaatgcgtaaagaatgacatgtacccaccattatagtattatacagagtagtttcactgccctaaaaaaaaatcctctgtgtgccacctattcatgcctcctgcccactccctctccacccctggcaatcactgatctttttattatctctgtgattttgccttctcagattgaagagaaagaagccttctcagattggcttctttcacttagtattatgcatttaggattctttcatgtctttccatgatttgatgcttgtaaattctcaactgtttgggggtaaatatcaaggagtaccattgctgtatcatatggtaagagtatgtttagttttgtaagaaaccatgaaaccgtcttctaagtggctttactattttacattcccaccagcaatgaaagagagtttctattgctccatgtccttgccagcatttgatgttgtcagtgttctagattttggccagttaaataggtgtgtagtggtatcttcttgttttaacttgcaattccctgatgacatatagccatgagctgcataatgatgttttcttcaatgacagaccacatatatgaaggtggtcccataagattatataccgtatttttacggtaactatcctatgtttagatatgtttagatacacaaatacttacattatgttacttacagtattcactgtattcagtaagttgcttatagtattcagtacagtcacatgccatacagttttgtagcctaggagcaatgagactataccatatagcctaggtgtatagtaggttatgccatctaggcttgtgtaagtatactccatgatgtttgcgtaacaacaaaatcacctaacgatgcatttctcatgatgcatcctgccgttaagcgacacatgaccaaatgctgtggagcatattttcatatgtttatttgccatccatgtatcttttttggtgaggtgtttgttaagatctttggcccatttttatatgcttgttttcttactgttttaagagttctttatacattttggatagcaatcttttaccagatgtacctttttcaaatgttttctcccactcggtggtttgtcttttcattctctcgatataatggtgttttttatagaagtaagttgagtctaaaggagagcagagtatgattctggagaccaaggtacagtcctagtcctatcatcaagtagctgtggctttgggtaagtcacttaacctatagatttcagtgtagtgttctggtcagcaaaatgaaggggttaagatggatcagtggtttccaatgtgttcggtgaagccacagatcttctaaaggggcccctgaggggccaccatgagggaagagaggaaaaggaagtgcccctggtacataacacctctccttcagacagaacaactgtactacattgtattttatctgtttttatttcatgataggttgatttgcagaggatcctatgactaataaaatttagaaagctaccagattcaatgactctcaaagatctctttcagttctgaaaatctgcgactcatgaacattaattaccatccaccttttgaggctgtattaatgtgtgaacagataggaaagaaagtgatagaggaactagtggaatagctaatgttatgtgcttctctgatggtgacaaatcattcactctctatttcatggatttgaagtatataattcttgttccaatgtggcctatgtattaggttgaaccataggaacctacacttaacatattacgttgaaccatatgaaatggccttcaaaaactgtaatttcatgtacttcaaccaatataaatgcagtatgcatagggaacccttgagttcagaggcttcttaaagcatctagatcgtatatgtataaatgaattaattaaaaatgtgtcgcagccagacgcggtggctcacgcctgtaatcccagcactttggcaggctgaggcgagtggatcacttgaggccaggagttcgagaccagcctgaccaacatggcgaagccccgtctgtactaaaaatacaaaaattacccgcgcacggtggtgcaccctgtagtaccagctgctcaggaggcttaagcaggagaatggcttgaacctgggaggcagaggttgcagtgagccgagatcatacccctgcactccagcctaggtgatggagtgagactctgtctcaaaaaaataaaataaataaaaatgtgctgatttcatgggtggttaacagtccactttggaaacaaatgagattccagaattctacacatcagcccaccacctcctttgggattgatgtacatgtagaatcaataggaagagtttattgaatataatcaaaatcaatttggcttttacaattgctacattctttttggcaaatgtcagtagctgccaatagttaaaggcatgtgaggtctaggctccccacaatttgactaccaggttacaactaagtcttaggccgaattttgctatacacggacatttatcaacaagatggcacagttctgccatataacttattatataaactctatgaaatcctatttctttccttatttaggatctcccacaatatcttagataaaaagttcatctaaggcatatgtgacagcattctagcaatggtattcagctaacccatctagttagattaaagcaatcaagaatccttcatatcagcaggtaaacatgaggcctttcaggaatcaagtcttggccaccattcctaagggtacaaactgcagaggctttagatttttctactgtgttcaggcacacccttgactgctgctgtcatttctggagcaaattcacataaaaacatgtctttcaccagtgaaaagtcatttgtgaaattcatgttagtgcttactaacaatagcactaaactcctcaatgaaactccatttcttaaatccatcatgctctattgtgggctggagagaaagatagccaaatgcgtttgtagtagctaccttagaaatgtggctgtttcgttaaatgtaacatgtgtcctactaggacagttatccacttctagagtctagattacaactatcacatagaatacctatcctacagtctatgctgatgagttgtaaagcaatcattgcaatataaaattatgcattataagctatatttcatcttgtgagttttatctacctgtctttattttctattaaatggtgattattagtcacagctattaccatagtcttctatatgagatagaatgtaatcagtatagatagggtccataaactagaaaggaaatcatacggttgtaacaaccgcaaacatcaagactactgatattgctgctggtacaattgaggcaccagtaagagtagaactagctatctttggagttctcctgttttggtgattccatctgattgtgtgcttagtcatgacaaattacactaataattccatatttgtttgtttcttgggagcaaggcattgctcttggttcagaaatatgtattagaataccatacctttaaatcagtttacataattgctattaatttgattggtgtaatctgccatttcatgacgaattctttttgataagaagtagttataaagtttaaaacccctttaaagaaaactttgccttttgccttcctctgtgggagaatatattgcgccatttctctctatgtcctttttccttacaaagcataaaatcattagatgagagacatctgaatgtattctctgaaatttggcttttaagtataccatattgagatagttagtgtcactctggtgggaaccatgtttgttttatttttaaagaatactgactttatagacacactttacctcttttgtcatctctcatagaaatccatttctggcatattatccacactttttccaggaaacctacctgttatctggtatttcattgtatgcctctggtactacagatttgtttaagttttaggtaatgatcataactactgtatggtccttagggggcagatttcaggtattaaatatattaataatcattatttttttctcagtctcttagacttcccactcccactagctcaatcctgcaacttccaattattttttaaatatatgagctttttaatgggtttcagttccctcattcctgtgtaaacatatactatatgctatactaaactctaagtttgcaaaaactggttgggcacatgagtaccaccatacaataaattctgaattattataaacatatcagctatgaaaagttaacttttaattttcagaaatagtttaacaatggtgaaataaattgggacattgtacatatttccaccttcctaagtaaaaataggaggatgatttaaatagtgtctttttagtttgcttaattttgttttttagtaagtgaaatgtcacttcagagtataagactttgatttcctaggaaaagttgtttccatcagtctgtgataagaagtacctatttaacacctatttcagcagaaaaaaaaagtttgaaggcattatatgcagacacaactgaataatagtatcaaaatgacttacaagcgagaaaacaaagaattatgagtttgacacttcataagatgtttaaaaaataaagctaagcacaggattgggtggaatgggtgcttttttgattttctctgtttgtttgtttattattggtttgggatatggtgattgcttggctggaaaattgtgtattaatatcccaaaaggattcggatccaatacactactcccacttcctgaaattctttccaattatagaactctttatggttacaactgaaagtacttaagaaatcatatccaacacctttgcttcatcaattaggaaacacgttcagataaattaagcaacaaatgtaggatcaggtagccagtttactgccagagctgcaacaggaatccatatatcccgactacaaattcagggcctttttaccataccacactttttccttatcctatagtttcacttgcctcaatgcagggttggtgaaaatggttaatagatattggctctcttagacttcaacaacatatctcaaaaggcagctttcatgtgacaaacagaaggctcgaataagcagagagctttgcatgttctatagtcttgtatgagaaatttacaattaagctggattactagagatttattcagaaaagaaatcggcttccttgttaatttgtggactctgtagattcagtctgtggtacagcaacatttatacaatactgggaaaaaattttcaatttgagcaaatatattttgcagattgaggatgcttacctttttaaacatgatttaaaagatttttaaaaaccatatttttatagaaatagctctaaattagattatataatttactgccttcttgaacatcatcctgaacatcatatagccctttattggtaactcacattcaccattgtaaacataatcattgatgtctatagccttgagagctgtcagtgtgatggagtttagatcctactctaaataacccccaaagagccttctgactctcttttcccttgccttcagattaattagctttcacttctgttggctttcagtatgttgatctagttcagcccaccctgccccttttgctttctagttttcatgtgcaatgaggctttgaagtctcaggagccaggctcctgcacatggatagaggaaactgacctttggttagtgtaagaagttgaggttcccctgtagataaagcatcaagtgagttgtaatgtatgaccttggtcatctcttgtgtctaagttcatgagaatgagaatgggtttatttgagcaacttttgcatttctgcataaacgaggtattactgtcattcatatctgtagtgattatgtaaaacattgaatagccacccaaactatcaacctaaagttcaataaagcatattttgttatagttacttgtgattatctaaacatacatatctgtcatgtatgtaacttttctttcataatctatcctttctaagagcttatttgtggtctgttgttaaaattccagtgatgataagctatcaacatatatttgaccaaagttgaagttaataaaagcaagcatatacattatggcaaagggtatttcctcacaagtttgttataagtatcaagtccttataataaggaccatttctggaccatttcttgagaagaagttctgaaattttaaaatctcatgatatccccaaaatatttatgaatcataaaagtatattgtagcaactatacagcattggttaattgaaaagacttataagattctacggggtatattctcataaggctttaataatggctcaaggtatggtacagcaggagagagatcactcacaaggccatttttagttgcacaggacacatttgtcttctaattgtgaaccaccaagattatgtgcaagataaccttggtatcgggagctaaggctcatgtgtacagaagatctttgatatcccactggtcatgtagctgaaactagactatgtaatcaattagtcaggtgcaatcagcctatatgttttccaaaaacagttcaggacaagctactacagtgtgcctccaagcgaatttgagacattaaatagcacttcataaagctactacatgtcatcccagacttgaccaaggagaccaaactcccaggcattcctgaagttaaggagacagactcacggcaagttaatcctatttattctatatttcctaagtgtatttttattatcagcttgataaatatcattttttttatttcacagaataactgccacaatggtaatgacagtgagtcacactactacttattgtaaatctgtttttttgtcaagccctgagcaaagcactcatttataacttataacttgagattggtgttattttttcagttttatagatgaataagtgacgcttaggtttttgttttcttcacatggctatttgttctgacaaccctttttctttctaactagtgcacactaacaagcttgggatatccataagattaaattgattactcaaaacaaccacaaggctccccccatcaatgccataatgtctttattccttttctgactaaccttgttcccacaagaaatccaataactccagggttgcacaataggtctagaggagaggccctgactcttgaattgaagaagagctatggaatgctaggttcatttgtagaaagtcctcattctctgttcttgatgttcttgctactgtttgctactgtttctggtgtatagtcttatatcaaaaatagggcacctatggccaggtgctatggttcatgcctgtaatcccagcactttgggaggccaaggtgggaagatggcttgagcccagagtttgagaccagcctgggcaacatggaaaaaccccgtctatgcaaaaaaaaaaaaaaaaaaagaaaagaaagaaaaaagaaaaaagagaagtcaagtgtggtggcacacacctgtagtcccagctactcaggagactaaggtggaagggtcgctttagcccaggaggcagaggttgcagtgagccaagatcacatcactgcactctagcctgggctacagagcgaaactctgtctcagaagtgaataaataagtaaataaataaataaataaataaactaaggcatccaaaccacaaactcacacacccaccagaaatatgcctgccttctgaccttgaagaacatccgtcatgttcagtcttacaatagagctctttgtgtatctcttttattatatctttgttacctcttgcactgaagaaccttgagggcagaggtcatctgctacccatctttgtgacttgttgcatccacttattttatttatttttattattttcttttgaagagaaagcatggatgagagcttatttattttgaaattatgaaaaagtggttacatttttttgaataatatacttattttgtgtctgtgtatgtgtaaatatgccttaggtttgaaatattcaatttaataagagtatttcctaaccgaatctgaagaaaaaaggtttaggtttttctttatttcctttaatgggaaaactgcatgttttaaataacacctcagtattgtgttctcaaggcacatttacattctgtatacttgtcacatcatataatccttgattaaggcatgcacatgattcctgatagctgtaatttaactcacacaatttaaggagaaagaggcaattaaggaagtgatcactcaatttaaggaagtgatggactttagtttcaaacatcatggctttagttaaacatcctaacgcaagcccttgcagcctggaaattgccccatgtttttagaggagataatctgatttcatcctatagatcaaagctgccaccttctcccttattttgttttcgcattttaaaaaattctaattttaggggcacatgttctcaggatctcctgagggctgtgtcatgggcaaaaaagaaaataatctagttctggtatcatcatttagggtccattaggtttccaaatactttgatgagcactggcaaattctctgccactacttcctgttccctaataaatggcagacataactaatctataatagtatctttcctacaggtcagattcttactttaagtgatatcttctaatggactggatttggcaagtgagataaaatctacttgccagctgaatccatgtagagttcttagtattatattaccttgccgcccagtacaagaaatacatagaatatgatcatggaatgcttggtaatttgattagacttggattagaagctttgtgtcctgctgtattaccttccatttgcttattcttctaaattagactgctttctggttactggagtcagtggcttgctttgactcacctttttgagttggatagcatataagaaagtaattatctcttagaagcatttagcttttttctcttaaaagttcaaaatacattaatgttgattgatttatcttcagaaaaactgattcgaaacccagggatatcttagaccacattaacatatatattgtctttaaaacaaggaagccaataatcctgaccagttttgcacttgtcagaccaaacacaaagtattgcgctcagcataggtcactgtattttgagaggaagatgatgcagactcaaatccattttctatggcaaacagatgaagaagcaagacatgtttattctggaaaggagaagtcccacgggaaaccatttactgtctttcttcatgtattagttggcctgttatatggaggagacttatgcgttaattcagagggtataaataagactaatggctaggaagttgttaaatcagtaaaatatctcttgaaaaagggtactatagtcaaatatcacaaatgcatgtatcatgttccttttcagatttacaaatacatgcatgcataatgatgtttcagtcaacaacagactgcatatacaatgatggtcccataagattaggagctgaaaagtttctattgcctagtgacatcatagcatcacagtgttaacacattactcacatgtttgtggcaatactggagtaaacaaacctactgcactgctagtcatataacagtatagtacatacaattatatatattgtatgtatatatatttattgtcattctggagtaaactccttctacttatgaaaaaaaattaactataaaatagcctcaagcgagttcttctggaggtaatacagaagaaagcattgttataatagcagatgacagctccatgcatgttattgtccctgaagaccttcaagtgggataagatgtggatgtggaagacagtgatattgatgatcctgaccctgtggaggcctaggctaatgtgtgtgcttgtatcttaatttttaacaaaaaagttaaattttaacaaaaaagtttaatttttaattaattaattttaatttttaacaaaaattaactttttttaacaaaaaagttaaattttaacaaaaaagtttcaaaagtaaaaaatacaataaaatttttaaataggaaaaaggcttatagaataaggatatatataaagaaaatatttttgtacagctgtacaatgtgtttgtattttaagctgtgttattactaaagagtcaaaaagttaaaaaattaaaaagtatgaagtaaaaacattatagtaagccaaggttaatttattactgaagaaggagaaacattttccttctttttattttcatttaattttattttttattttttaatttaatttaattttaatttttttgagatgaggtctcactgtgttgcccaggctggtctcgaactcctgggctcaagcaatcctcccacctcagcctcccaaagtgctgggattacaggcatgagttactgctcccagccaaaatattttttttaagaaatatatttttatacatttaatgtagcctaagtcgacagtgttgataaagtctacagtagtctacggtaatgtcctaggccttcacattcactcaccactcactcaggccaactttcaatcctgtaagctccatttatgataagtgccctgcaaactccttttatggtaggtgccctatacagtaccattttttatcttttatatcatattattcctgtatcttttcaatgtttagatatacaaatacttaccattgttataattgcctatagtattcagtatagtaacaaactgaacagatttatagcctaggaccaataggctatatcatatagcctaggtgactagtaggctatgccatctaggtttgtgaaaatacactccatcctgtttgcacaatgatgaaatagcctaacaatgtatttctcagaatggatccacattgttaagtgatgcatgactgtttatactaaatatatatgaagggccctaaaaagtcattcagtgaaagatctctttaaatttgttaaccctagcattccataaatacttcactcagaatgtttccaaggaactctcattagggtagtgattctcaaactgtggtaatgggagcagcagcagcagcatttcctggaaactggttagaaatgtaattttatagccctacctcagatctatggcatcagaaactctggggtggggcccagcagtctgtgtgataatcagtccttcagggattctgatgcggctaaaaggcaagaagtgttagaaaattttactgttattctccaacttaacagtaaccttttgctttccttcattacacttaaccacaatttgtattttttaaagttctaatgatattctatgaatctgtgaattcatattccataatcataatctattctctgaatttccttccttctgtacctcataaagggtcataaagggaaccctttatgaggtacagaaggaaatactcattgaaggcctatcatggttttcaccctggtataagtgtcatctagctggtgtcaatttggatactttaaagaatcctaaataatgagtccatatattctataaagtaaaatactcatttctataacaaagcaaaactttaatccattgctggctgtcattgtcatttttaaaagagcacataaaaagtttttcatttccttcaaaatgtttttcagaaaatgtagacttttttagcatcttgaaagatctgtaatgtgccttttcttatgtcagaattctataaattaggaaatgttctaatctcttgcattaacggagatgaaattctggtggcattatatttgtctctccaaacaggcaacattcttttagaaaaatgtaattgaaattgaacttaaaatgtatttgtatttaaaaataaaacatcttattttttattttttatattttattattattaaaataaaagcatcttttttacatggtttcataaatgtattttgaatgtttatatgaaatgcctctgtaaatcatgcagaagaattttctttttctaaaggacagtgaaatgaggttgaatgtgttaaagcatcacactatatttaactcaagtacatttagaacaaaattattattaggatttccatagaatgaatcatggccaaatttaacttctcacaatttttttttacctattcttttcatacaagttagagctctctgggtttatattactaggtcaactgaagtgttatttatttttaggtagagggacaaagactgataatctagagactggatttgatttggctgctgctgtctgtcagcagaatgccttggggtatctacttacagtaatgagtataagtagtgctatcattattagtatatttaaacacccatggtttgcaggaatgtgctgaagtctgaatataacatagttaattatgtcactgtccctgcccagggcaactgctattgaaaggacatactcacatcatgaggaagatagcagatacagtggtttggagctaagtgttacttcattgctgactcacggaaagaggtttaggatgttggctatgttttctaaagagcatctagcagttttcatctggtatatcaacttgccacataggttttttatacttatatttctttttagttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactgtaagtatgttggcaattaaaaagttgcacagatttgcctacctttttgatgtatatttgaaatctgcatccctgaattatgtacattgctagcaattaaaaattcctttgttaggaactcggaaaatggcatctaactagtaatattctgtgggttggagagctaggttcacttccccttgtgctggactgtctttgagagccccgttcctataggactctgctgagcgaggatttatcatcttggcgagtaggaaggatttgatttgcacaaagctttgttctagaaggttatagataatatcactttgcctaattacagagaaagtgtggaggaagctaatggatggtgatagtgttttaaaaggttttacttctcgtacaaaagaaaagacatccagacataccttcccactccgcgagaatactcctctttacttctctttactctagactacatgctattcaaagagagcaggaatgggacagcacaaggcaggggtgaaaagtctatagaactgctccacagctggaaattgttaccagaggtagccattgtataaagattcagtcctgggcagcaggaaaataaccctagatgctaaacaagtggtgtcacttatgctaaaaagatactaaatataccttaagagcagcagatgcaaaagttttaaagaaaggggtaagaggaagaagccacatcttagtcaaatcacagggttagaaatagggaaaagaatatatcatccataataccatcatgcaatcacaaagcacggttgaccttttattttctttccagctttttccctttgcatccgcttagtcattgttggttttattttattttattcattttactttttaaaaatagtatatgttcattgtagagaaatttaaaaatgtagtaacataaaatcacttgagtttttagcaccaccagttttataattttggtatatctcattctggcctatttttactacatagatacttcataaataagaaaaataggattgtagtagaaatagtgttttgcaccataaagtttttaataaaaactggctgaagttactataaaccataaacaaaacgtggtttttgatattgtgttttatcaaataatagaaattatagatattctactatggttttcacaaggctaatggctttttaccctactttatcattctcctttaaagaaatcgtaagaacttgtttgggatttattgttctaaaagtactttatacaagtgaataatattcttttacaaaaaaaatttattgagttatgtttgacatataaaaagctgtacttatttaatgtatacgtttctatgagtttggggataggtatacacctatgaaacaaccatcaccatcaaggccacaaacatatccatcacctcctaaagtttcctctcacccctttattattgttgtagttgtgttctgtgagtatggtaagaggacttaacatatgatctaccttcttagcaaaatttaagtatataatataacattgttagctgtaggtaccatgctgtatagcagatctccagaattcatttatcttgcataactgaaagtttatactgtttgctacttctcatttctttctccccaagcccctggcaaccaccattctcctctttgcttctattagttcaccttttttagattccatatataagtgagatcctgtggtatttgtctttctatgcctggcttatttcacttaatataacgtcctccaggtctattaatgttgtcacaaattacaggatttccttcttttataaggctgaataatatttcattgtgtgttgtattagtctgttttcatgctgctgataaaagacatacccaagactggaaaaaaaggattaattggacttacagttccgcatggctggggaggcctcagaatcatggcaggaggtgaaaggcacttcttacatggtggtggcaagagaaaatgaggaagaagcaaaagcggaaaccctcgataaacccatcacatctcatgatacttattcactatcatgagaacagcacgggaaagactggcccccataattcaattacctccccctgggtctctaccacaacatgtgggaattctgggagatacaattcaagttgagatttgggtggggacacagccaaaccatatcattctgccccggcccctccaaatctcatgtcctcatatttcaaaatgaatcatgccttcccaacagtcccccagagtcttaactcattttggcattaacccaaaagtccacagtccaaagtctaatctgagacaaggcgtgtcccttccgcctatgagtgtataaaatcaaaagcaagatagttatttcctagatacaatgggggtacaggtgttgggttaatacagaccttccaaatgggagaaattggccaaaacaaagggtatacaggccctttgcaaatccaaaatccatcaaggcagtcaaatcttaaaactccaaaattatgtcctttgactccatgcctcatgtccaggtcacactgatgcaaggggtgggttcccatggtcttgagcaactctgcccctgtggctttgcagggtacagcctcgctcctggttgctttcacaggctggcattgagtgcctatggcttctctaggcacacggtgcaagctttcagtggatctaccattctgggatctggaggatggtggccctcttctcacagctccactatatagtaccccagtagggactctgtgtgggggctctgaccccacatttctcttctgcactgcgatagcagaggttctccatgagagccctgtccctgcagcaaacttcttcctggacatctgggtgtttccacacatcctctgaaatctaggcagggattcccaaacctcagttcttgacttctgtgcacctgcaggctcaacaccacatggaagctgcttaagtttggggctggcaccctctgaaaccatgggccaagctgtaccttagccccttttagcaatggctggagtggctgggatgcagggcaccaagtccctaggctgcacacagcatggggaccctgggcctggcccaggaaaccattttttccttctggacttccaaatctgtgataggggtgggtaggggctgccttgaaaacccatgacgtgccctggagacattttcctcattgtcttggggattaacattcggctccttgttatgcaaatttctgaagccagcttgagttttttcctcagaaaatgggtttttcttttttactacatcatcaggctgcaaattttccaaacttttatgctctgttttccttttaaaatggaatacttttaacagaacccaagtcacctcttggatgctttgctgcctagaaatttctcccgccagataccctaaatcatctttctcaagttcaaagttccacaaatctctagggcggggcaaaatgccaccagtctctttgctaaaacatagcaagagtcacctttgctccagttcccaacaagttcctcctctccatctgagaccacctcagcctggaccttattgttcatatcactatgagcatttttgtcaaagccattcagcaagtctctaggaagttccaaactttcccacatttttctgtcttcttctgagccctccaaactgtcccaacctctgcctgttacccagttccaaagtcatttccacattttcaggtatcttttcagcagtgccccactctactggtaccaatttattgtattagtcgtttttacactgctgacatacctgagactgggaagaaaaagagatttaattggacttacagttccacatggctggcaaggccttagaatcaggcaggaggcgaaaggcacttcttacatggtggcagcaagacaaaatgaggaagaaacaaaagtggaaacccctgataaacccatcagatttcatgagatttattcactatcataagaatagcacaggaaagactggcccccatgattcaattacctcccccaggcccctcccacagcacgtgggaattctgggatatacaattcaagatttgggtggggaaacagccaaactatatcatgtgtatataccacattttctttatacagtgatctgtcagtggacatttggttacttttagttaggagtaatatttagaaactgagatctgggaactagaatatgctcattgctaccagaatgttgttacttctggatctttcagcaatagagctaggaaaaaaaaatcacacatatgtatacatgcatacaaattctatatatgtctatatgtagaaatgtaaacatataaacatatagacatgtatgcatgtagacatatatgtgaaataactaattcattatgctgatctccaattgcaatccaatccctcagggctcttccagccattctacttttgtagagatgtaaaaattccttatagatgttcttccaaaatgagaattccagcacccaaaaacatcaatatattaataactcatttgcttagttgtataatacacaatggtttcggaattgtaatatctatactgtaatgtggagagggaaaacttatattcattcatgcatgcatgcatgcatttttttaacatcttatttggaaataattatagattcacaaaaaattgcaaagataatacattgaggtcccatgcagcctttactcagtttcccccaatggttacatcttacataactgtaagatcaaaactaggaaactgacgttggtacaatctgtatgtatagttctgtgtcattttatcacttgtatagatttgtgtaaccatcactgcaatcaagtagcagatatatttcattaccacaaagttttccctcatactaccctttaatagtcacacctactatcttccacaaccatccctaacccttagcaatcactaatctgtttccatctctataattctgccattgcaagaatgttatataaatggaataatataatgtggaaccttttgatattggctttttagagtcagcataatgctcttgagattaatccaagttacatatatcaatagttcattcatttttgtttatgagtaatattccatggtattgatacaccatggtttgttgaaccatttgcttattgagagacgtgtgttgtttctagttcatggcttttacaaataaagctgttatgaacattgcataggtttttgtattgacataaattttcatttctgtgggataagtcactgggagtacaattcttgggttgcatggtatatgtgtagttttttaagacactgacaaactaatttgtcattgtataaattaccatcttatagtctcaccaacagtgtttgagagatccagtttctttacatactcatgagcacttggtattgttactgtgttttattttagccattctgctaggagtgtagtgataacttcttgtgattttaatttgcacttccttaatggctcatgatattgaacatctttttatgtgcctattttctatttatgtttcttctttggtgaaatctctcttcatgtcattagcttactttctgatgggatgttttattttattttactattgagctttgagagttctttattatcctaggtttggatctgttttcagatatatggtttctaggctatttgaattttatgtattaattgtatattctactactctcgtattgattaagttttatcattgattctcagtgtgaacaatgtttttttgttgttgttgtttgtttttggagacagattctcgctctgttgcccaggctggagtgaagtggtgcaatctcggctcatggcaacctttgcctcccaggttcaagtgattcttgtgcctcagcctcctaagtagctgggactacaggtgcatgccaccatgtccggctttatatacatatatatatatatttagtagagatgggatctcaccatgttgcccaggctggtctcgaaatcctgagctcaggcaatccacccacctcagcctcccaaagtgctaggattataggcatgagccaccacacctggccatcatggtgaacaatgtttttttttttttgagatggagtctcgctctgtcgcccaggctggagtgcagtggcgcaatctcagctcactgcaagctccgcctcccgggttcacgccattctcctgcctcagcctcccaagtagctgggactacagacgcctgccaccacgcccggctaattttttgtatttttagtagagacggctttcaccctgttagccaggatggtctcgatctcctgacctcatgatccgcccgccttggcctcccaaagtgctgggattacaggcgtgagccactgcacccggaccgtgaacaatgtttttaatgcctacatttctggccttttatccatctcagtgcttctatatatcatttcccacccacagagacaggatgctgcatgtcagcaatctttgaagcaagtagaagaaattccttcaactgtgagagaattgcttgagaaattttctgtacttccggcatcaccttttccttcctatagaatcattctcatcttattagcctacatgccccagaaagaaagagaaaaaagaaaactctcttaacacatcgccatccaacaaccacttcatttcttgaaactctgctctgcctacacttgctcccctggtgatctttcctcttctcatacttcaaatgctaataacttccaaatttatatttgtagttcctggagcgctaaactgaactacagacttgtatggctaactgcctactcaacatgttatcttagaatcaaatatggttctcaaagtaaacaaatttgcaccccttcccccaaatatctacacttactacatcctctctgatctcaataagtagtaactccatccatcatgtttgctgatctccaggctttttgccatctctgactcctctctttttcatatcccacaccccatctgcaatagttggttctaatatgaaaatatactcggaatctagccacctttctacttgttatcactttacatccaagccaccacaaccctctcatctgtatgattttttggcccctgccccatagttgattctcaaaacagcaggttagagtgatcctttaaattctcttacttgcaagggcttcccatctccctcagtaaaggccaaagtgctcagaatcacccaccaggtactacacaatcagtcctcatctatctccaccccacagcttcactcgatatatagttatttctttaccacatctcctatgacaccccaccccttattcactttgctgtggctttcttgtgcgtcctcacatacacagacagcacgtgacctgcctcatgactttggcacttgctctctcctcttctagatggatatgtctgagttccttcaccactctcaagtcttcactcaagttcattttcacagtgagaaagcactctaccttaaattgcaaccgcttgtcccttctgtgactttctttttttcaagcactgacatcatttgacatctatttgtttttttttttaattgttacctcccccgccccatcaggactgttagctccatgagagcaacatttctcatctgttttgttcatagctatggtccctagcatataaagcagtgctggcacataatagaagccaaataagtatttgatggatgaatgaaggaatggattggcaaatcacaaagtaaatttagtttatgggaggaaccgatttaaacccaagttggctgatagataatagactttaaaatggtttttattatgttgttgttatatttccttctttgtgctttaaagtttgtcatctgagtttgttcatgccattaaaacaatcccatttaggataaggtgtgccagcctttgatctagcaaatgtaagtgaagtggcattctcattttttatctgtttcagaacaatgtttgttatctgttaatcaggatctagcattgccagcaaagtttcatcttaatcttggcagtgaagaaaatgattggatttgagatttgctttctacttttagactatctttactatctttttgtttactaaaatttatcgctcagaatacttttactcatacgtggtttcatcatttccaaacatgaagtatgtgaatttagaagtctgctttcagtagaatgtttattgttggaattatttacctaatttggaacacaagtctaattatacaatgggagaaaacatattgtacttcacggtcctcattttcatcatgtagaaaatgggtcagatttattcagacattatctgctgaatgcctactatgtaacagtcacagtatatacaacaatgaataggctgctcctcatggcatttgagttctgatagaaacagcagacatatgcacaaaggcttatatgagcatgctgtaaaccttaaatatacccaatttttatttgtcagttatacctcaataaagctgagttgtcatgccaaaatcctctgctttgagaatcagatggaccttgatctggtgtctgagctctgccatctactgactatattgatttgcgcaaacatttcatcttttaggcctcaatttttgtatcttttaaaaggaggatattatacctacagtatgaggtttgaggctgtgcacttagcatagtttttggaacagagaaaactttcaataaatataatttattctagtttttaggtgctgaattcttgccactttatttaggaatcattatttcaccactatcactttttctctcttctctctatgagactatgagggttctctacattttggagctgttaatcttgcactgacattgagaaaatagtagtaattctttaaaacaatgattatagaacttttaatcgtatataatttctagtttattttgcttgactttccacagtggttgtcttcaaagttaagcgtgcataggaacagtctgggtgcttagcacacctgcatagtcccacctagtgcccagatctgggtttctaattccattctatagtgaaataaaacaggactttctggggacatggctcattattgggctggagtgtggagaatacaagatgagctggagaacattgtggtaccagaaagtaaggaagtgtgataatccaaagaatgggagcatgttaaagggacacaggaggtaacctaaagaagctctcagtggccaaagctgaacaattttagccacaaaataaatgatgtagtattggattatagcccaaaacacaaaataaatacacatgattatataatgatataaatgcatgactgaatgaaaaggtgaaaagagaaaaatccacactatagaattccaaattatgtatgtaaatactccaccccagatggtggagcttaattttcttcttcccttgagtgtggcttgaacttaaagactagctttcaaagaacagagtatgggaaggatcagcgggtggggggaggtggggtaactttgcaatggagaaacctgtcaaactactttgacctggtaatcaaagttactaagtcacacatatgatatactgagaacagacatcatttatttccatcaccgcaaactcataaccccagtctaaccatgagaaacttacagagaaatccaaaaaccaaaagacattctccaaaatgtctgactactatcaaaacagtcaaggtcatgaaaaaaaaattagaaaagactaggaaactgtcacagaccagaggaaactagagacatgattagacgaaatgtcaattagattctggaaaaaaaggacattaatggaaaaactaatataatctaaaaaaagtgttatatttagttaatagtaatggactaggattgattcattaattataacaaatttaccatcctaatgtaagaagctcacattaagggaaactgggtgaggagtacaggagaatgttatgtattatctttgcaatttttctgtaaatttaaaattatttcaaaataagaaagttcatttttaaaatgcacagtccaggggtcacaagtctccttggaccagggaacttgccttatttggtaacactttattagattctaaagaaagcagtttagctaaaaccacttagaatactcagagctctgcagtgggtggtatttctagggatatggatgactcttttgtctgggtgcatcatcccaagtctttatcccattcttgtgcactccatgtgccattctgccgccaagttgctgctatattttagaaactgagttattgatatccaaggatctgagatctgagttcagcaatccctttttagataatatctctcattccaaagtgtcaccatttaaatttgtttatgtagaaattattggggaagaaagagatatgcagtcccccttcacactaggatatgttacaaaaactacatttggagattgtggaattcagagcccatggcaggaggtggcatgtagacacttgtgagttgggattagtgattacaagaaatactgtgtctgaggtatctaaaaattgatcactaggtcctggagattactcatggcacttgcaggcagaaagtccgattctttggcactgttagggaaactcttatttcacttagcctctcatgatctgctgatggcactagagccagattcagaatattttccccacccctagtgactaaagagttgttagggatgagagaattcaggaaagaagggaggtggaagtccagtctgggcaagaaatataggaggcaaacatggggcattgctgtggccttcttctagccataccttattcatttccattgagaccttctcctgccttccctagacgcatcccagaccctccttggggaaccaaatatgaagtttccctttaggcacatgggtggtttcctggaactcccaaaggcttcctcgctacttcttttggaacctcttgaaaataagttaaatagggccaaaatatgtcattttgtgcaactggtattctgagctaccttctgtaaagatgagggaggtctgactgttgcaggtcaataacatgttgttccttatatgattcatttaaagtacgtttttattgattatatcattgatattgtttttaagttagtggtgaactttagtctctggcagttgggcccatttgtaggttataaattatttgtagtgtcaattattcatgtcaggttatggtagtaactgaattaggagagtttcagcctgtatgatattaataaagtagtagacttcttcagtcagggcggggggggaggtgctctcctgcccatgccagcagtatgttaaccttgacctataaagttacctcagcaagtttcctctcccagtaccagtgccaacctttttcagaactatcctcagagactgggtaccagtgaggctgacagatctatttgttgtcacttgtagaatcatttgcaccatggatttaatttaacttgtggacctgtcacctatcatgctgctgctttgggatccttcactgcttaataagcagtactgtcatggttaggaaatggctcatgtatccattacagagctgcaaccagtcaatggaattgatgacaataaaacactgacattcaaattgggatttgagtagaaccctagggcagcaactttgcttggtaaatgtctaaggcatctatttttccatctgaaagatgatgtcaacatgtctcccatagcatgctgggaagaagttagctatgaattcagagaataaggggctagctgttacctaaggaattatattctttagcctaatacagtaaacctctccctctaaaaaaggacaagaagcagcaaaaaccactcaaccaatgatgagagagaggtgttgtgaaatgatattgatagccagcagaaaataccattttttttttcttttttgttggtttctatgggaggctgaggtgggcagatcacgtgaggtcaggagttcgagaccagcctagccaacatggtaaaaccccatctctactaaaaatacaaaaacaaattagccaggcatggtggcatgtgcctgtagtcccagctactcgagagggggaagcaggagaatcacttgaacccaggaagcggaggctgcagtgagccgagatcgcaccactgcactcagcctgggtgacagagcaagactccatctcaaaaaaataaataaattactaaaaagtataaataattatgggtggtgaaaaaatatagctactttgataaatgtatccaggcaagtagatgaccaaaccaattaaacatcatatttcattgattctctaatcatttattcatattttaacttctctgaaattgaggtgcagtttacatactatgacatggcatggattcgttgaaagcagaattttttcctttttttttttttttttttttttgaaacacggtttcgctcttattgcccaggctggagtgcaatgccatgatctcagctcactgcaacctctgcctcccaggttcaagtaattctcctgcctcagcctcccgagtagctgggattgaaagtgcccaccactacgaccagctaatttttgtatttttagtagagacgaggtttcacaatgttggccaagctggtcttgaactcctgacctcaggtgacccacccactgcggcctcccaaagtgctgggattacaggcgtgagccaccatgcccggcccttttctcttttttaatacataaaaatggtgtactcttcaattcgtgctatgttatatttgataaagtacagcaaccaaccaccactgctactcacttctcagaggttctgatctggatggggtgactactgtaattcaattattgttatagtgggtatctgctgatttccttaataacggggtttcactagttccttcttccaatgttagggtacagtcccctctagggcaggacatttgatcatgactctcatggttggtatatcagtaactatagaaataagattcagtttagccatttccaaagtacaataaaaggaattgcaaaagaatttgtaactttgccatagccctatgttgttagcccaagtcttgggtactgtcaagctgaaacaggaaatctgtctcctagtgaactacaacaaccagtagatccaaagaaggctctggttttccttgaactgtatatttcagagggtcacactaatgctataacttaaaatggcattattatttaaatattaagatagtatccaattccaaaagctaatatttgataccaatcactgctcatcatgaataggctaaaggctgccttttcattccatcccattgttgaagaatgacttatggaattggttctaatcatcttttcatggagtccacaaaaaccaaataggtcaaactgttcatttcacaaatgaggaaatagccccagaactgttgatttgcccatgttctcattacagcatactgatgaagcccaaaataggagccaggtcccaggtcatctatttccatcttcctcattcccttcctcccctcctcctcattgaacacagtgccctcctagtttaattagtgatggttatgccaggggctttacaatgaaacaatttaccttcaggcttcttatgccagtccttattgggccagtagtaaagacacatgacatggtacttattcaagctcagatatgatagaaacagaaaaagtggtggctggtacctattcttagtcttagcctttgttttaatttctactgctttaaaattcttttttttttttttttttttgagagggagtctcactcactctgttgcccaggctggagtgcaatggtgcaatgtcagctcactgcagccttcgcctcctggatttaagtgattcttctgcctcagcctcctgagtagctgggactacatgtgcctgccaccatgcccggctaatttttgtattcttggtagagtcggggtttcaccatgttggccaggctggtcttgaactcctgacctcaagtgatccgcctgccttcacctcccaaagtgctcgggttacaggcaggagccaccgtgcctgacctctactaattaaaaattctttagaacaatgtcctttgggatagacaaagcaggtgatattctttccatctttagaccagtattttaagtgtccaaaagaccagtgatacttccaatttctgaatggaattggaacttggggcttttgattcttaagccagttttcattagcatcataccatgtagctaacacacttgcagcctaagacagaatgtcttgaagagaagaaaacctaatagaacctacaatataattaggccgatttgggaggagtataggaggaggctgatttcctgttatctgggaagtggcaatctgaacttttaaacagacaattttgaacttttttggtttgaggcggagatcaagttcaaggcagctaccttttcgttaaaagaaactgatgaggtttcattataagcctagagtaatgtttgaaagggtagaagagatgataaagaagtagttctatctaaagttattgaaaattttcaatgctacagagattcatttttattactttgaaagacagattataaagatccaggagggtattaagtaaaatgggataaattaataaaaattataattccctattaacctaggttttatattagtttttcgttaaaactgttgcattccactttgctgttttctattttattttattattgttttaaaattgagacagggtcttgttctgttgccaaggctggagtgcagctgtgaacatggctcattgcagcctcaacttcctgtgcccaagtgatcctcccatctcagcctcccaagtaggtgggaaccacaggtgcatgccaccatgcctggctaatttaaaaaacaaaattatgtgcagacaaggtcccaccatgttgcctaggctggtctcaaactcctggactcaagtgatcctcctaccttggcctcccaaagtgctgggatttataggtgtgagacaccatgcccggccatctattttaaaatatttaaactcaaggcaaactctagacaaaacagaactaaatctggaaggagctattataccagaaacaagaaaatgttaccaaaaatatcaaattgatattctcagaatttaagaaaacaataggtttgtaaaatgagaagaagctattacagaggggaccaattaggggataagagaaagtccttggacattagaaatgttactgcaaaactaaaaactggacacaggtcagacagtgcagagttcactgggttgcacatggaacatagtactcattctcctccctgcccacttccactgaaaaggaatgcatccctccccagataatggacccaaatacccacttccggccctttccgccattagccatccgccttcagccagctactactaccacagctcccgcctgcctgctcaccacatcccaaggtgcctgccatggccaccaccccagtgttgcaggtgcgtcagaactaccaccccaactgcgaggccgctgtcaacaaccacgtcaacctggagttgcatgcttcctacgtgtacctgtccatggccttctacttcgaccgggacaatgcggccctggagcactttagccgctacttcctgcgccagttgcacaagaagagggagcacgtccaggagctgatgaggctgcagaaccagcacagtggctgcatctgctttcacgacatcaggaagccagagcgtcaagactgggagagcaggctcgaggccatggagtgcgccttccacctggagaagagtgtcaaccagagcctcctggagctacaccagctggccatggagaaaggtgacccccagctatgcgacttcctggagagccacttcctgaaccagcaggtcaaggccatcaaaaagctgggtgactacctgagcaacctgtgcaagacgtgagccccagaagcaggcctggcagagtacctgtttgacaagctcaccctgggcggcagcgaggaagacacctgagccaagatgggccccacagccacggtgtgccttccctgggtcaggccaccaggcgggggcgtgcatgttgccctttcagaacgttctcttcaatttttttcctttcagtgttaccattattggcaataaagttatctgttctcaaagcaataaaggtgtccagttgatgcgtgcctacaacactctcaccttttaggaatcagggcacatccccatgcaggcttaaagtaggtatccagcagtctctccacccagtcctgtcccatctgcatgcagctcaggatctgtgggggtggaggggaaaggtattctatgggcccctggaaaacacattagtcttccccttataaactctgagggcatgtgggatagggtggggtgaggtggggtagggtggggtgagatgggtggggtggatggcgtcaggtggggtgtgcagtcttgggccatggtatatgtgggtgcatgtacatggtacagtgtaaaacaatggtatggaattcatcctagtggctgcctctggggaagaagtgaagggagtgggattgggcagggattaaaataaagggggtcttcaacttttcatgaacacttttttttaaaataagcaaatgataacttttcttgtttctagacagcaagatgggggctctggatgacagcaaggcagagtacctctttggcaagctcacccagagtgacagtgataatgggactgagccttaggttggcttccccacaaatatgggggtgatttcctgcatattgcccttacaaatcctctactcctgtttttattctttcaattgtgccatttcttccaataaactaatatggaaaaaatatacctcagtagaaggactgaaaaatataaggtcaaagttggaggtcaaatttgtgatatgaatagaaagtagattaaatacccccaactgttaagccagtgactggctgctttgaagaatgtagaggggttggggagagttgaaggtgcagaacaggtagagccattgtagctgatccagatgagagcctagtgtggcttgaactgtggtagtggctgaggaaatgaagatagattcactagttccagatggattttggacaaggtgacaagttttgctcatggacagaaggtgaggactgggagatggggacaataagttctggtgtttgatcttgagcacctgggttgatggtgctattcttaacctcaggacatttgcagtggggacacctagggtagagggctggggaatacatgtcatgtgaaatcttagatccttattaggtatccaaatggaaacgtgaatcaagtagatggaaaaatgaatgtcagctttggaaatatacgtaagggagacattatagatggtattgaagtcatgtgattggatgagctcaccagaaaaagtgtaagagagagtttgacaaatctatccccaagctcagggcagctaacatttagggtatagttgagatgtttgaacacccagagagtttctgttcccacctgaccattaccttattccagaccatggcccccagtgtccactcctagtgtattttcaaatcagcttgtcctgatgtaagtgtgacctctggtttctcctttctagatgtggagaagagttcttttgtcttgtcttatggctatggatagaatgaaattatttcctagtaagaaaaagattccttagagaaatggtagtgatgtaagcctacgtttttctcctctctcctttcacaactttgccatatcttttggcctattctctacctaaacagatgaaattagtatgtaaaccttagattatgcatgtttctgaaaaactactcaaaacattttgttccttcagtgctacatgtagattattatataaaagataaaaattacaggttttgtatacagtattcaaagttacatgtgtagctcgagtctttttaaagctaactggtttgaacagtagtaaaatatgaacaagtttagctatgcaatcattaccttatttcataactgtaacactttcttaaaaatgaggattatggtcatataagtttccagaaggtattcttgcccctttactcttctaacttggtcctctcactatttctttatctgcctgatttgaggatctctcccctctctgactttgtctcagatcatatatattttttctctcctagatatgaggaagaacaaagcgagcatctttttgtgagtgtttacatttttaaaaccatcaggtcactgcggattcttcttactttcatactttggagagagtttgctacagtggtttcttaacttcagattgcctgggttcaaatcccagcttagccattcgtgttgacttgcacaagtcattaaatttttttgtgcctcagtttcttcatatataaaatagagatcacaaaagcatcaacctcattgggttgctgagattaaataagttaatatatgtaaatcacttacagcagtgcctggcatggtgtaagtacattatgtggtagctatgagttatcaccataatcaccctcatcaccctccactcaattctaagatcctttgtattatttacgctttgggggaaagacttcacttgtatacattagcactgtatttctacccatcatgtcaccctgcatacagagatgggaaaacccttagaagctggtttggttgtcaggtgccaccagaactcaggagggtacatggctgtttttgctgtcccacacacaggctcaagactagagacaggttttgttgtgatagctttctgtgtaatcccccccaattctatctcaaccagctttcccttgaattcacccctagaacactgtgcttgttcttcccaaacccaggttgcctgagcctcctatttccacccttaacttcctcccactcctcagagatggacaagagcaacaggatgaaatcctaacccagatccccaccttcatctggatgtttggagctgaaaaggagaggaatggctaggcggcgcttgacaggagaatgagaaaaagggaacacattagagccactgataacataactaaaatcgatacatcatcatgagctttggcaaagaggctctcaagctttgctgcacattcaaatcacctgcagaggttttaaaaaatttcaatgcctagatcaaatacataagcttctgaggcaggacctaggcatcccagacattaaaaaccagtgttagcatcttactgctcaaagttggtctggaccaaagtatcagtctaaactgagagctcattagcaatgcaaaatctcaagctccaccccagagctacagtattagaatctgcattttaacaggctcccaggtgatgagtgtgcacactgaagtttgtgaagcactgctttagcatcctggttctctacctagctgtaccttgggataacctgggatactgaaaaataatactgatgcttgaacttaaacaacttactcgatcatgcccccatgcacatactgcaccaaacaccaaaaacttactgtaacttcaacaacgattattgaattgacaaatatccggaaagacttggaaactttttctcatttctgtttatgttccacacatatataacatgtgcacacttttaatcattgttttataaatcatttggcaacctatttgttttttcacaagcatgggttggaaacaatatggcctaaaagcatatggcctagaagccaaatatagcccaccatctgttcttgtaaataaagtttaattagaacagatgcatggccgttgatttacgtattgcctgttgctggattcatgctgcaaaggtagagttagtatgtaagactaagactgtatgtcctacaaagtctaaaatatttactatctagttcttaacaaaaaaatgtttaccaatcccattgtatagtaacttatcacaggccctgaatttacctaaagccaccaaatatttttaaatgtgcaattgtctttgtacctccaatatggtcattgcagtttggtgcgtaatttccctatcaaacacaatgtgtagcagaaatgaaagcaatatactgtattaatttaacctaagatgataatgatttaatatagcacctccatgtaagaggagtatagaagatacttttggttacttagccaacagccattttactccttcatccttattaaggcaatactgaattttttggggggttggtgagtaacaatgtgtcctattcctagtaataaattgaaattagtctacacaggttcctaaactttgtctggatctttaactggctgctatctcaacctgtaattcatagccaggattctagaatgggttacctgtacctgttgacttcccagaaataatgcatttctttaagtgttagaagaagtaatacatccgtaatgttcagaagtaaaatatataaaatgatatgtgatgaacttcctcatgtccctgactgcaggctctcaagtgtctttcataccagccccactgaaagattaccttccttaggagttttccatatatcctttctgtcttcccgttttgtgtgttactataacagaatccctgagactaatttatagagaggagatttatttagctgacagttctgcaggctgggaagttcaaggggcatggggctagtatctgctcagattctggtgggggcttttgtgctctgtcatgacacagcagagaaggtcaaagcggaagtaggcacatgtgaagagggaccagacctgaggaggaacctccctttataacaatccactctctcggaaactaatccatacctgtgagaactagtccagtctctccaaagcaagaattcactgactgcagcgagaaggacaccaagacattcatgtgccaccccagactcaaacacctcccactacagcccatctcccaacactgccacgctggtaatttaacttccaacatgagttttatttttttttcagtgaacataaaataattgtattaaatataacaaaacataacaaaagtatcacatacaatgttatagtaccatttaaatataacacagaaaaatactacaaagtaagaaatacaaaaacaaaaactaggtaagattttatttacaataatggtgtgcttgccttgttcataaattcattccagtctggaacacaggaagataatgctacccgcatagctggtgcaccattcagcccatttctttcctttgtttttaacagggttaagatagaaaaccctagttcacacaaactagatgtgaatggtagtaatagcaggacactctttctacttaacaatggaaagtcttcctttaccttaatcaaaatgctgataaacttaaggtctcataatcattcttcaatgtatatgaagaactaagctgcaataattcattctcttcttcaggcaccaagtttagctcaattattgattcagagtttcaaaaagcaaatggatcttttacccaactgttttcccttaatgtttcaaatttttcttctggaaagaaatggttaaaagtttgagatagagaagtgagatgcaacaatatctctaattttatttctttcaaaatgttttcattaatattctcttcaatatgttgcaaaaatcttggaaatatgtagtagctaggatgattacttttaaatcttgcttgccataacaataatgtcttttgaaatccctggatacattcaacaccaacatgagttttagcaagaagaaaccacatccataccatagcacttacaaacttttgttttatggagaagtatgcatgccatggatatataccaaatagtaacataattcacagtatcctgcagcttacgtttctctccttaatgatataaaagaatgaggttttagcagtcaatttacatactggtcactagtgacattctgggacttgggatttctccttttgctcattacatcaggacaggtaccaatcctcccacttctttggttctgttaccagtgtagggtcttgacgagtcatccaggttcttgatgtgttgagcaaagaattggacaaaacacacaaacaaagcaacaaaagaacgaagcaacgaaagcatagatttattgaagcaaaagtacgctccacacagcaggagctgaagaaacaggcggctaaagagccccagttgcaaaatcttctggggtttaagtaccctttagaggtttcctattggttacaccctgtgtaaatgaacacctgacctgtgagcagtcagaggctgaagtgaagttataccctatgcaaatgaagacttgtcctgcaaccaattgaaggctgaagtggagttacaccctatgcaaatgaagacttggcctgtgaccaatcacaggctgaagtgaaagctccctatctccagaccctattctcctgcttcagttctattcaagtgtcctgaatccaaaccataaccatttgcaaataattccatctaaattactagaatttcctttatgtaacctgtgtgccaccttacaaaatatagtgcccataattaattgaaacagcatgccaccaacctttggtcttcatcccccagccatatcatcttcaactggtagtaaattgaattgatgcttatcatgcccagcataatattgtttcccagtaacttgtccatcttctactgacagttttcaagataataccttactttttgacaaaagaatacaaaacgtatcttttaagatactttttaaagagctagagtctccctatgtttcccaggtttgtctctaactcctgggctcaagggaccctcacacctcagcctctgaagtagctgagggtacaggtttgtgctaccacacctccacattatgtatcagtttaaaaatgatctgtttctactttttcatagcttagatatacatgttactaccttagagacaaagaaattgacccaaagatgttcagtgacttgcaagtccagccattttccctagagtatcacttttgataaggagtcttaaaaagttggactacacttgcttggattttccaacttgggggtatttctgccttctactctcaacaaggcagcttttggagttaggattggtttttagtcccccgtctcctaaggtccttcctcccctttaatgtcattctctttcaaggatagggagaagctgtaggagagctgtatataaatgctgctaggccctcctcatcaatacatactcaatgggaaaatcatccacttcccaacttttttatgtaggttctgacctgattgatcagattgcaaaacatgccccactctactgtctttgcaattatgaaagccttgaggtcaggccttgagtcactcaaattgtgttcgtaaatggcagtgagaacattcaaaacagaaaaagcacacattttataaaagggaaacaaatattctttgtaagaatcttgcacccagtgcattttgttctagcactcagctcacaggatgaaacgtctacctcttggggctcttccctctgaaatggttgtcggacctctctggcagctccagattgtgtttatcacttctttaattttatcttaggctaaaaccatagagttcctttaatgactcttttcttcattcactcttttacatcatgcttaagattgctataaaagtatgattcaattatgatagtaattcttgtttaggcacatacatttgtgccacattattgccagccactaatgttaaatccttctaaagcactgctctaccaagttttgaaatcatttgcttattctaagtatctttttgctgatttcaaaagaaaaagaactgtataaatagcttacagaaacataatttgaaattacttgtttgaatgataattattagagctgatttcacatgaattttcttctgaccctctggcctaaaggacatatcagtctcttttccaaataaatctgtcattgtgtttttattcagatcattgttaccttaattgaaagtatttaatctgtaaaatcaggcagcttgcttttgactacacattgaaaatgatggaagattgaattttaggaaaatagccaaactggttctgaattacttatacatcaaggcagattgcttgttggtttgctctggtgccagatgtcttggattgaaatcccagctccgatgttcagatgttaaatgaccttgactttatcattatgtaacctctctgagcctccctttcctcatctgcaaagtgaggatgataacagagcctacagtattttatgtgttaaagattaagttactacctgtaaaattaaaatctggtttactaattcagtttttgcctaagctttgtttttatccattcaaaataaatgcccaattatttctctgtaattttttccaaaggggaaagaattagactaaaaattttttatttcccagaatgccaaaaaacagagaaattgaattatgcaagcaagcgtgcaaaaaacattcatgtagattaatctttgggtattccaaagtaatgtagacaatataaaagagctacattttattgtgtttttctaaggttagcatcatgtaattatttaaatcacatatatttattggtatttttggataaattgaaatagagtaaaaggaagtggtgacctgagagactgggaagagagagattaaagtctcacctgcagataaaggaaaatttactatagatcagatacttgataagtttactttattctacttggtgcggtttgattccaaatttgtaaaagagtctgttattttttaggagtgcaactgtgattggcaagtgtacaggagaaagagatgtaaagcaattttttaaatgatgtaaaccaaaatgttagtactgcttacatcttatgatggaactacaagtgattcgttttcatttttgctgtttttgttttgttttgttttgttttgttttgttttgttttgttgagacagagttttgctcttgttgcccaggctggaatgcaatgacgcaatctcggctcacccgcaacctccgcctcccagtttcaagcagttctcctgcctcagcctcctgagtagctgggactacaggcatgcgccaccacgcccggctaattttgtatttttagtacagacagggtttctccatgttggtcaggccggtctcgaactctccacctcaggtgatcgcctgcctcagcctcccaaagtgctgggattacaggcatgagccaccgcacccagccccatttttgctgtttttacaggagtgaaattttatataattcacttttttcaatcctaaaagtgatagttatataaaaagttaatgatgtgtaattttaggagcaaatttattgtgtaaaaagtcttcatacatctatatttaatagtttttacctgtgaatatatatccatattagtgaagccaatgagtactttgacaatttcagcttttcgatattatcctgagatgaatgctgtatctagactctactttttcttctttgggcttttttaaatatcgaatcttgcatattttcatctggatttttaggtgaaattcattgtgaacctgtacagcctttagtaaatcatacaatgtttcttataacatgtccagttcctcttagaattatagaatgttggagtaataatgtaccttagagacctcattcaggagtcatttttatgaccacagggttctttaaaaagctatataactaagtgaagtaaaatatattactataaaacaagcagctttagtggccatagtattagtttggaccaaatttggtgttttatctaaattccatgccctcatgggacatctgagttcagaattccaggtgtaatccaactccctctatttgtccatttgtttagtgagctaactcctctccccagctcttctttttccaatttgcattccaagggctccctcccttgatgccagataattaaataatatgaaatggcagacatttcgaatcttatcagtgacccataatacctgcaaataaacatgattgtaagaaaagcactttgataaatgcagtgaatagcattgcaattgagggtgatctttgtatcaaagtaagggataggtaatcagtcattttgaagcagagatttgattataatatataaaattaattataatcactaatatgtattgagtatttatatgccagggacttaattagacatgttataaatgttatctcacttaatgcacaggcagcctgtaaggtaggtttgtattataccattttacaagtgaggaaactgaggcctaaaggagtaacttgaccaggtttcataactagtaattgggtcaagtttcctttttatcttttaaatacttctcctacatacgttaaagtcttgaactactggactacttttcatttgggattaaggtccaggtttagaagtaacctaatgtagcttcttcaccagcctgaggtctctcctaggaacaatatataattttgaccttcagtcaacatctgtgtactaaactttggggttggagagggagctgaggaggaatgtctggtggcaaggaaccccaaacagaaccattagaaaacaaggtgtttctggagtgtttgagtactgaaagactacaactgcctaaacttgtacatactattaatgatgatagggatcatgtgatgagaatcttgtagttggatatggagagtgatgatatttaacatattttaacagtaaattatttggtatagttagtaaaggggaaaaccctcattacttatttttccctctaaagtatcatagctgaaaatataaataactccaagtctttaaaaacactcttggattctgactgaccattttagggaggatccagaaggagcacagttatgtatttgtaatttcttgtcacatggaaaatatagacttgtaggtcctttgattcagcaaatttggttttgggtttttgttcattatgttcattgaacccagacatttattcatctggtattttccatcttttattcatactgattttctatttattttgtattgtattttcagaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctgggatatgtagttgggcgctcagattccgtctctactcgcctgtccaattgtgatcccccgccaacctatgaggaagccactggccaagtgaacctgcagaggagtgaaacagaacctcatttagacccacccccagagtatgaggacatagtcaactccaactcagccagtgccattcctatggtgcctgtggtcaccaccatcaaatgaagctgcaaacttctttttactctaatcatttttaaaatactaatggaagaactttctagcactttaccactacataaatgttcattgacttattttattggactcttaccgcataccacttcacacttgttttattttctttagttttgtttcttgttatagaatcattatccatgctcatttttgctaggggaaatatatgaagagggaaaacatactaatgggggtctttctgtgatgtgatgagacatacatgtaagtgtatatatgtgtgtataggcatatatacgtgtgtatgcatcaacacagtatatgtaaaactgtcttaaaaatccattaacttctacctaaatcacctggaaggagagcattactcaccaaaattgcaaaacaagggtatcaagaatttgtgtaatagccagtgacatgctgtagatttttgcaaactggatgtacttagcatgttttctaattctgactggcttttgttaacttgataattcttcatctaccttaaaaagaaaaaaattacacatagtcattcttgatgttataaatagagaaaaagtgtgtgtgagcaataatgcataagctactgataacttgcttacagcagatagcaataaggtatttggtggcattcggcttgttttgtaatagggattttttttttggttgaccactcccccacacttccaaaattaaacagtgttttcttagcatcttgaatatctcctgcggtgtatattaacatcttgatgagacagatttccaggcaacaaaataatttctaaaatggatatatgtgtggattaatgacaggcagtaaatacccattactcctttactcatagctggtaaaattattcccactgttttattgccttttactgtacgttctacactctgtcctactcccacagaattttcaagcccttaagagtttagttaaaataaaatttttgaaattattgtcttaatatttttatataggctgatgtctttgcctcaagattgttaggaggtaattttccattgaattatcaactgtgatttttatattgccctccaagtggtagaagaagattgcaaagtccatgttatgctaggtgcacaataaatctagtaatagccccacacagatctcatcattgttgctacttccttttgtattttcatcaggtatttttttaactgtagggtttttacttttttcttggagcagagagaacaggctgtaaatgggttgccaacataagctggctgagaaataaaagaaaacaagacagttgttcataaagtttcattttgtatgcactgatggcaaattcattaggtcagttaagggaaatatttgtaccacttccaaacttttcagcgttggataaaatgattgatgaggcaggcagaaggaatgtaggtttcaggtgtgtcatttcctgctgcttccagctccatccctacagactcctccccgagtcctgccctggaaccaaaggaaggaggaacactgaggggaatcctgaagtaggagtcagatgacctgaactcagatctccctctatcacatgcttgccaccactgtaccttgagcaagaatcatatctgaccctcaacctcctcaactctaaaatggggataacatcatttgtcctgcacttctctaagggctttacaaggatcaaataagatggtgtgtatgtaagaaatttgtaaaatgtgaagagctatctacactaagttcgtaatgttattattattgtgcttcatggagaattttcccctctgttttcctaaattgtatgagagctttcacacagtgagaaatagagcaggctgccccataaatgggtaacatattcctaatctgagtgtgtgggctgttagagaacccctgccatgctctggtctgttctgaaactgtgccaactgaaagatgatagtccacacagcacaaacaggtttaagcaaatgatagaaagggaagtaaggcgtgtgtgctagttaataggtttagtagcttttatggactaaaaatgattgattgtatcttgaccctggtctcagaaatgacatttttacttttgccatgagtacacatcagatatctttggcttctatttaaagctaaaggtagaagtgtttgatccagtgaactgtgtatgtatgtgtggggtttttttctttatttttaaatgaaaattaagacaccttttgtgtggacatgtttttgtctttaatgtcaggctttagattagaccagcagttttcaaagtatggccaatggacccctgggttccttgagagcctttcaggggggactatgagatcaaaatatttttattataatgtgaagacattgtcttttcactctatctcaaaaaaagtgttgcaaatgtaaaacattgccatcttctcacaaatctctttttttgtttttgaaaatatggccatttttcataaaatgttatttgtgttagcatgtaatgggtttactatgtttaaataagttaatactttaaaaattttcaggtttttttagtatggtgaatattgatagatataaacctcatgaacaaaagtactttggcatccagattctcaataaatgttaagagcgtaagtgtaagggggtccagagaccaaaagttttagagctacaggattagacataggagcaggatattctgttagtgtgatttcttgcaactttattttacattttaaactgctgatattggatataatgctgctttttagagacacctaaattgcagtatcagaatgaatgttgatgtttgaagccaaaaagccaaatgcttaaactgatcaatgactgtagctttttagactgttggtcaaagaacattctacttcacagtaatagctctatcagccacagatctcatggtggctgttgcatgataatgataggataaacaaaataccactgtcttcaagaaacattatcttaggtttgtttgtttggtttgagtttgatttggcttttatattttttaaaatcccttttgctaccccatctggttttataaactgagtttcttagcattcgttaaaattaaggggtttgtttggaataatatatattttttatgcttttgtctttcttacctgattgatattacattcacctttgattgttttttaaaagtttatttttacagaatatatttagtacctttcttaaggagtaactgaattgaatcaaccagtttgcatttaaataaaagaacaggctcagtggtcttcctgtagaatggtttacatgcctgcatgtgcagtagttgtgtctggaatcctagaattggcactttctgcctccttgctctaaatgtcacaaaaaattatacttccttaaagtaaatgtaatgatttcttcttttcctattgaccagtacagatagatatgttgtgtttgcttcatttttaatgatgacttcaagattgatgatgtgatccaataactgtggaggtagctttaacttggttctgtgtaaatagtatgtattttattataatatttctcattttaagatgcttggtttacattaaattatggtatttaactatttttatgtttatactaggtagggtctttcttatgtttctgtgtttttggtatgctaaataaagctatttttaaacccaagaga

SEQ ID NO: 1447 - DNA, 107966 bp, Homo sapiens; identical to SEQ ID NO: 1446

SEQ ID NO: 1448 - DNA, 4112 bp, Homo sapiens
taccattatagctaattattttattacaatgttttcagaattagatctaggtgacataaaatacacaaaagcataaagccatctgaatagtacagtcaacaagcaacaaccagtacaatcagcaataatagagaacttttaactttgtatgtcacagagaatgtatatacctttttaataaaaagcctgaataaaccaataactattaaagaaatcacaaagctgattaaaaatctactattaaaagtgtcatcaggattagattgttttacactttgtcctagctaacttttaacaaacaaataattctaatgctatttaaattattccagaccacaggaaaaaaattgaaaactcacatattcatatttttttaaagctagcacaacttcaataacaaaacttgataaagatagcatcagaaggacaaaatacaattttactttggaatgaaaatgcaataattctaaattaaatactggtaaataaaatccactcatgtagcaaatcattatttcacaatgaccaagtagtatttgttccagaaatacaagtttggttccacatcaaatgcctaccattctaattcattacatcaacaaattaaagagaaaaaaaatcatacaattttatcaatagatgctgaaaaggcattttataaaattcaggaaccacttctagcaataacactataaaacaggaatagcggaaactcttaaacatgttaatgactacctactaataaccaaaagtaaatgtcatactaatagggaatactattccctattaatattttgcattcttacttccatgaaaattaagaacaagacagtcacgtctgtcatcactcttcaacattgttttgaaaaatccagctaatgtaacagtaatcagtataaacattaagaggaaataaaatgatctatatgttcaggtgaaataatttcatatctagaaaacccaaaatattatattcttaaaaatctactgtaatttcaatgattaaataagctcattagacagaagataaaaatacaaaaatctataggttgtctatattgtcaaaaatagctaattacaaatgagaagaaaaaaaccaattcacaatgtcaaaatatgaaataaaactgtaaaaatacttagaaataaattcagttagctatgatatacttacgtgaagaatattccaataacaagaccaaaagatttcaatgatgtacgaagactcttgagtgctaagatttaatattattaaagagccctctaaacaaaaatgcaggattttaattgtgatgtcagccatcataattagaattttattaaaattctgcatttcattttttcacatgaaaaaatgaatgtctaggacatattatataaagaaaaaaaaaactaatgaagtgggacttgctttatcggattctaaaacttacgatgaagccactataattaaatcatgatattggctcagaaatttgaaaatgggtaacattttaaataaatgtcacaatcaggtatccaatgtgaacaaaatgttatagctggatccccatcttacaccatatacaaaaataaatttcagatggatcaaacatttaaacattaaaaataataaagttattagaagaaaatgtaggtgaatatttgtatgactttgggtgggggcatccatgtgataaaaaaaggaaaccaaaatctataaaagagataagggtctacctaaaaagtttaaaaattttaaaggaaaatatatcatcaataaagtcaagatgaaaacgtcataacacattagagctacaaatgattaatatgcactatgtagtaagaatttctacaaatttataatgaaaaacatcaatagatacatgagcaaagggtaagaacaggcaaatcagagaaaaatccaaacagaaacaaggacagcaacaacaacaaacctctttgaactcagacaaaaggcaattaaactaacaagcaatacaatgcaatttttagcctttcatattttcaagcattaaagagtgctggagaggacgctggaacgggcgctttcattttggatagtaatcttgtaatatttctgaaacatatgcctacatagtatttctgggaatccaacctatataaataaaagcaccagtatgtattacagcagtgttattttgaaaaaaaataaaaaaaggaaataaaagacgatcaataacgaaatggttgaatgcctttttggtacatcaacaagtactgtgtattcagctgttagagtaagggagggagggggagagcaagagtgcaagagagtaagagtgagggccagagagagccagagagagcaagaaagactgaagctactgataagaagagatatcatctacatgtcaagtgagaaaagcatgtggcttgccatttttacagaaactactagaacatactttctgcatgaagatggggaaaataggtggaaggatgtacttcgcatcctcaacacttgttttctgggaagaaacaaggtaaggaaaggaaggggtaaggacggggtgtgggtttacaccattaatttttcttaatctatttttgcattgttccaatggttgcaaacactttttaattttctattagcacccaatttaactgttaagttacagaacaaggcaatatcaaaagtagcaaagtacacttgaggcaaaattgtgaaactagtcaaggtaagatttgttggcacaataaaatttatccactttcctgaatttctgacacctaaactcttctctgcgttcacaactacgagaacacaaaataattcacatctaacagatccacaacttctctaaagagcacaaagaatttaaggagttttcaccaaaccatagacataaatgtgaatatcatcatcaaacttaatgaagtaaacagatggcttcgccaccacttgatgtataaaaatgccagttctcttggacccgtcatctttggcatgctccacctgcttgcccacgagactgtcgaccacctctccaggctcctgttctgctgtagggaaatagtagttggaatctggaataatgcgtaagtcaccatctttgtagtcatcaagcagcgtgtacatatagagaacaggatctttctcgtaggtgatgtaaaaccaagtatccatcacaggagctcgcgccaggaccatacccttccattcatccttggtaccatgttcaccttcaaacacatgctccactgccttgccaatcagggaatctgccagtcgtgaatcgatacgaggagttggcactctctcaggaaggatctctagcgctaaaactctcttatcgcggtgcagttctagtccatacacactatctttgccatcatatttaatgatgtaaagagtgggcttcacggaaacctgctcgagcacagtacccttccactgctccactggctcgttgccttccttccagccgtgttgaatgcggcagcccacgatgttcctacgagtgaggaaagtgggcttgcgccgttgcttcctgtgggtgtgccttttcttcatcaggtatgcggacacgccatctacccccatcggaggcacggttggaggagacatagctcagggattaagagggcttggggaaagctgctgccctggtcgattaaactgacaaaaagtcaacactatgcaatatgatatatatattttttgcgatctcaaagacctggtctgtgctcccttctccaagtgcaaggctctcaccaaggttttggcagaaacgctcgaactctaaccgtgagcactgggacagcgtgtgcctctccacagtgctttcctctctcgccctagaagggttactgcagcagtggcggctgacgtagagatggcgggctcgcgagtgctgttcgtgccttgcgtccgccccaaccccgaccccaagtccccgaatcggccacttagctgttgtcgatgctggtgcggctgcggcacggcggcagaggagacgacggggacgaaaggcaaggagtaagagggatggctgcagcggcaaaggcgcaggcggcggcaagtctctggggagtccgcgcggcctgggcttcgcagcgctagctggcttggcttcactctggcgacc

SEQ ID NO: 1449 - DNA, 95287 bp, Homo sapiens
tgttttctgcattctctcccagcggatctgattcctgttctgaagaattgaagttgagcatcgttagttaaattcagctgctgcctgactgtataccacagcaaaggctttggaaacatttttcagttaaaacaataatgactttcttggagtgtaatcccagtggaggctgttctacgtatagcctgaaagaatacttaactaccatacgcaattctgcagagaccttgtaaaaatcacactttacaccaaacaactgagtgattctgaattggttgggggaatcttagttgtagatatcaattcaccttcttgaagattcaaccactgctactcagagctgctgctgaaataccatgtctaagaactcagagttcatcaatctgtcatttttattagatcatgagaaggaaatgatcctgggcgtcctaaagagagatgaatatttgaaaaaagtggaggacaagagaataaggtagtattctttttattttttcagtcctccttgactgctttctgtttgtttgaagcaatttagatcagaaatgggccaagtgcaaccacaatggggacagatgtcagttaggaacttcatgagttctcatcagtagcccaaatatcggaaaactttggcatttcaccatttagccagacatgaaaatggaatttagctaataaagtggtattgatgagaacacttaatttgctaataaagtcataatttttagttaagaggaaggactacctaagtttgagtaccagctctggcaagtattagtcgtgtgactttgagcaagctactcaacttccctatgccttggtttcctcatcggtaaaacaaagataataacagtatccaccttatagggttgttgtaaagattaaggaagtttatacatatgtagtgcctgtcacctaagtgttcaataaatgttagctattatttatttgtaatgccattgtcagatcagtcttactggggatttgcctccagcacagctgcgagaagaaagggacctggagagtaaaaatttcccatcataccccagaaaccacttgaatttttaaaaataagtttcttgtgaagaaagttgaacgatgtgggcacagttgaatttcatatccactgtaggcagagctcatatttagctggtttccccggcatgacttcacctaatatttcagccagcatcaattctgattggttgcgtcgcctgctctaattggtcacatcattgttctgatcatttgcaaaatccactgtgattggctgctgcctgtaccgtctttgttttaaaatatatttggtcattacaccttaccccagaaaaaaaggagcagaaatagtgttccttcctcagtcactgccaactatgcaatgtgtaggttttgtgtcttgtatggctccccaagctacaatcagaagcttatgtttattttacctgaggagaaaacttatcatgtgattatattcacatgttgaaaaaatctttaatgtgcccaaagccactaggatctttagaaatggaaataatttaagtattcttgattgatgtttatttcacagttaagagcccagaagcttcatttccacttttccaagatattcaactaatcttgaagaaacaaaagtttcgatgaaaattattgcactttttctatgcatagaattcaggtggcaacaaaatgtagttaataatttcaaagaaatcatgaataatatttttgacattagtagtcaagtcatgaaaagtaaactaatttgtgtaatgccctgccaaaaaaaattatgttgtttatagggggtgacatattaactaggaattgatgacattccaaggggaatttaaaatcatttctgtcctggctaacacggtgaaaccccatctctactaaaaatacaaaaaattagccgggcgtggtggcgggtgcctgtagtcccagctactcaggaggctgaggcgggagaatggcatgaacccgggaggcggagcttgcagtgagccgagattgcgccactgcactccagcctgggcggcagagccagactccgtctcaaaaaaaaaaaaaaaatcatttctggccgggcgtggtggctcacgcctgtaatcccagcactttgggaggcagaggtgggcggatcaggaggtggggagattgagaccatcctagccaacatgatgaaaccccgtctctactaaaaatacaaaaattagcagggcgtggtggtgcacgcctgtagtcccagctactcgggaggctgaggcaggagaatcacttgaaccccagaggtggaggttgcagtaagccaagatcacgccactgcactcaagcctggtgacagagtgagactctgtctcaaaaaaaattatttctataggaataaacaatttaataaccagatgcccagagacaatgaagtacaatgaataggactttgttctgaatatttgtttctgtcattatcaataacttgtattaataattgttggctgggcgcagtggctcacgtctgtaatcccagcactttgggaggctgaggagggtggaccacctgaggtcaggagtttgagaccagcctggccaacatggcgaaaccccgtctctactaaaaatacaaaaattagcgggtcacagtggtgtgcgcctgtaatcccagctactcgggaggctgaggcaggagaatcgcttgaacccaggaggcggagcttgcagtgagccaagatcgtgccattgcactccagcctgggtgacagagccagactccatctcaaaaaataataataataacaattattattattatactctttcttcctttttctcattccatttttcttccctagtcttctttccttattccctataagtaaattcggttaaattgggtgtaatatacaacagagtatcaagaataaagtcattggtttcctggctcttcaaacttttttgagaatagcataagaaaggctgtttataaatccaagagatacttttacagaaaagagattttctaaagctacgtcttgtctccttgttccatctgcattaactgcattagatgtgttgtctcattttgttctgagttcttgtaatatgactcaggcttcaccactcttaacagcttggtgtattcagaagtcattccaaagtgggtggcatgatgttgagggtgtatgctgttgaatcacacagccagagttcaaatcttactttcggcatgaaatatctgtatcattttagacaagatgtttccatggataaatctagtttccccatttgacaacagaaataatatcagtgacatcataagattgttctaaggattaaataagctaatattacaaacagcttagagcaatgccagcatacagtaagcactcaaaaattgttggttataatcattagccctatagttggtttgtggtgcccttgatttgctagttgcagtagacactatcagtgctctactcagatcccctggagtccctctcacctcctagttttcatgcactttattctaaggacttgaagtacaaaattaccttcgggtgactggagtttcccataggattaaagagacacaagtgccaggtaaacttgagtgttaactgggtagcccaaagccaatggttgacgggtacagaaatccattgcctcaaggcagaacagactctgcaatgcaacttaagctccagagcttcccgtgggatgatgctgaggctggacttcacctaaaaatcacacccttgcttagcccctctccctgccttctcctgcctcccttactcccttatagatttctcttgagagcactacataagtcgcttgcacacaaatctacatagcagaattcgcttctagaaaacccagtctgagacactatgaagtttgtattaccaaagctattactatttagtaaagttcgtttcaggggaaatataataagtctgcaaggtgagcattaaaataaagaattttggttcatttgatttacaagctatgatcttcccaacaatttttatcacagtcattgtggtttacatactggtaaagaaaaaagtccaagctaaagaaagaagcccaagattaagcatcttggtcagataatataactttctgttggcttttctccctttatctcctctgaatagccattttattatgaatttaagtacaacctaaatcagttcagggtaccttaactttagcgcagtgggtctgcatggcaattaaattctgcaaacatttttctgatagatagatagatagatagatagatagatagatagatagatagataaaaatatttattataaagaattggctcatatgattatggaggctgagaagttcagacctaggagagatgatggtataatttgaatctgagtccaaaggctgagaaccgggagagctgatgcaataagttccaatccatgtctggcagtcagtagcaagggaaaactgatgtcccagcctgaagacagggagagaaaattcattcttactcagctttttactctattcagaccttcagcgggttagacgaggtacatccatattggggagggcaacctactttactcagtctactaattcaaatattaatctcatacagaaacaccctcacagaaacatccagaaataatgtttaacaaaatatctgggctcccagtggtccagttaagttgatacaaataattaactgtctcaggaatttatataaagctggctatagcccccgttcccacacttttgtgaattgtatagctcatcctgactctgtacccccgcttctgttgaactctcctctctccttgcatctcaccacttatggctattccttactcttttctttgccaggccagagaacttagtcctttttccttgatatcctccaaaaccatcaatacaagaaatttagatgggtaacagattttattacaacagtaaactttggtgctagctattacaatagttttcatcatgctatagaggtacaaatggatattttggggggagtctaaaggaagaagtaattaattacaagtaagatagaaactgaagcaatggtttcacagaaaaggtgaacgtttgtgcttgcctttgaaatgtgaaaaggacttttcacattggcaaatataggtcaactatgttttggctgtttaccatgagccacaaagccaccttcagactgtactaatcagtttcagaaggaaatggaaaccaaaattttttttagactgaaaaagattacaaagaataaacttatctgaaaagttagtaaagtggagtttgggaggcagtggatttattgttcgtttgtgtgtttatttgtttgaatagcttgtcctttgagataaaaatgtagaagacggagaaagcgtaaaaattgtactgaatcaatattttaggcctgacacccaaatgtgcttcacagtccacatacccactaaagtgtggcattgattaaggtgggactggtctttggggactcgtaaaggtgctccatacccagaaggcacatggcaagcctgataattacctccaggcataaatcatcagctggggaataggcatctgtctactaccattgcattttaagttcattcaagaggctgaaatatatttgtatacattcttctccttcagactaagcaggaaggagtggtaggagatagcgagacacaggttttcactgttagagggtaagaatatttttaaggttctctatggagagcaagtcactcaaatttattgacggctttactgcaatgaagaaaaagcagaaatgttgcaaataaaattgagctatcaacaattattgcaaatggataaaaatactgacagtttcgaagcacaaaatggaaatcattgttgattattttgattttgtaccttagattgcttttcatttacttcaaaagaactcagactaacatgtacgtgggtcataatatctactccaaaaaaatctcattaacaaatttttactctacttgatctctcacacctaaaaacaaatactgttaaatatctactttgtggtattgacttgtacttaaaaatcctcaacttattagtgaatattcatttcagcagtatattgtgagctttattctcactaagggtacatcatttccatttgaccaccatacatgaaaacatatctgcacatgttttctttggcacctaatcttgggcttgcctcagtggtaaactctattggttgccttacaacataacatttctcctttctttctatccaaatcaaagttttattcagctctagcagtgaattttttaaacaaattttttctcaaaaaaaattttttttattttttaaaaaatgttttaggccaggcgtggtggctcacgcctgtaatcccagcactttgggagaccaaggcgggcagatcatgaggtcaggagatcgagaccatcctggctaacacggtaaaaccccatccctactaaaaatacaaaaaattacccgggcgtggtggcatgcgcctgtagtcccagctactgggaggctgaggcaggagaatcgcttgaacctgggaggtggaggttgcagtgagccgaggtcgcaccactgcactccaacctgggcgacagagcgagactccatctcaaaaaaaaaaaaaagttttaaatatttgtgggtacatagtaggtgtatatatttatgggatacatgagatgttttgatacaggcatgccatgtgaaacaaacacatcatggagaatggggtatccatctcctcaagtgtttatcccttgagttacaaataatccaaataaattctttactttaaaatatattattaagttattattgactatagtcaccacactgtgctatcaaatagtaggtcttattcatactttctatttttttaactcattaaccatcccccccccgacccgagccccacactaccctttccagcctctggcaaccatccttctactatctatgtccaggagttcaattgatttgatttttaaatcccacaaataagtgagaacatgcgaagtttgtctttctgtaccaggcttatttcacttaacatagtgatctccagaccatccatgttgttgcaaatgactggattacactcttttttatggctgaatagtacaccattgtgtatatgtaccacgttttgtttatccattcatctgttgatggctgcttccaaatcttggctattgtgaacagtgctgcaacaagcataggagtgcagatatctcttcaatatactggcttcctttttttgggtatatacctaggagtgggattgctggatcatatggtagatcaatttgtagtttcttgaggaactgccaaactgttctctatagtggttgtactaatttacattttcaccaacagtgtatgaaagttccttttcctctgcatcctcgccagcaaatgtattttggtttcttgtgtaaagctggctcagttgaaatgcgccactaaataagccagaacttaatatctccaagagaccacagaccccagcctagtaactcccattcaccttatggttttctcttaatgtgactgattttgtcatttcagtgctaggagaagagaaggaaggagaaacaggaggggagcgtgcattcaaattgcttatttggaatcctgcagataagttcaatatttggttcaaatggatttgaagtgatttcaagaattatacattcagcctggaagtcagggagtctaagcgccaagcaataatacccttttaatacactataaatgtttgatcatttgtttgtttttccaaatcttatcactctaccactaagagcaaaattagtttgaccttctcaaaagcctaaagactcattgtccccataaaacaccaggagaactgttggactggacttctagtttggtaaacactttggtttaatcctaatagaattgccacaaagcttcttaacggattaacagaaactcccagcatgaacatactggctccctaatggaactcaaatgcttaatgagtcacagaaaaatgaacaaaaatattcagatctgccttaaaccttggacgttttcctagcaaagaccttaccaatttcaatatataattacatttagggaaactaactttaattttgattctagagcatttttctccgaggaagcgttacttgtaaggtgcaccataggcacagggccacaaatacctgatattcagagacatgttaaacattggattgtccaaataaataaacttgccagatcatttttaatatttttttacattttattttattgacacatagtagatgtacatattttcagggtacatgttataatttcatacatttatataatttgtaaagatcaaatcagtgtagttgtgatatccatcaccttaagtatttatcttttccttatgctagaaacattctaattattctcttctagctatttcagaccattttcttgggggtttgaaataatagatcaccatagtcataagtaagattgttacctgagactatatctattatctgtatctacatatgtctctatatagagatctatattatttcaaattattaacgtgtttatattatattcatataagatatatattatttcaaatacctagactatatatagaaatatatatagagataggttttctctctacatatataagtggagagagtctatataaagagagactcagtataggctggggattggtttcagggcccgggtgtataccaaaagccacacatactcaaggctaaagttggccttgtggaacttgtgtatagggagagttggcccactgtaaatgtgggtttcatattccacaaatactgtgttttcaatcttcatttggttgcaaatgcagaactcaaggttatggagatccaactttgtttattttttaaaaatccacatatagatgaacctgggcagttcaaacccatgttgttcaaggatcctctgtatattttttactcttccccatattcccattttactaccctttcccttccttgtgtattgtctctagccagaattggtatagaggtcatgtctctaggcagcaggggttagttggcactcacatcccaagaaactaccattccctttcaatgcaaattgcagaaacagaacaataaagcccatgtaatccagaacctggctgaatgttggggctggaagggggagtaaagaagacccatcccctcaaaggtaagtcagctcataagggaatatctaatatcaactatatccttggagaaataggtattttattcctaagaaaatgatataagtgaaaacttcactaataaaaatgtcaccactaatattttagatttcaggcaagtgaccattttatatcaacagtaatcttataagaatgttcctatgttaatagaagttatggtttaaccaatttaaatttataataagattaggctaacatgcatttcataatttttataattgttcttttattgcagagtaattaagcataatgaaaatatttaatgcaaagaaattaataaaattcttacacagcaagcaattttttaaagtttttaatctcagtattgtgctaggatctataaagggcatcaatgtctgcaacttttaaaataccataaacctcaatccacttaaacatttaatatcttctgatacatattttcattatagaatcaatgggcttattacagaaaattacataaccatataatatgaacattaaagtctcacatagaattccactttccagaggtgaatagtctccatttgtgttgaatttccttcctgtcacttttatgtgtatatatatacacatatatatatgcaattttcatatagttggaaattgcatgaaatttacatatacatactgtataaaatatcataaacctcaatctgcttaaacatttaatattgtctggtacatattttcattaatagaatcaatgggcttattatagaaaattagataaccatataatatgaacattaaagtctcacatagaattccacttcccagaggtaaatagtctccatttgtgttgaatttccctcctgtaacttttatgtatgtatgtatgtatatatatatatatatatatatatatatacatatatatatacatattttcatatagctggaaattgcatgaaatttacatatacatactatatatgtaaattttattctttatttttgctttgcattatttcatgaacatttttcatgtcattaaaaattatttgtaaacatttttattggctggataagatttcataacataagatttttccatataacatgaatgtgcaacgtgtttcttaactatttattcttatttccatgaacattctcattcttaaatcctcttatattgtgattcatattttgaataatatttccttaattttaaaaaccggcaatctgagaaaattgattcaattaagaccatgcatcttgtgaatcagattgtttattgtttatcacaaatctcaccttcctttcgtagaatctgaaagtttgtaattaactgccagtgatggttttcagtgaagcatttaaggaaagaacaacacataaaggaaacatttatattcatattcaacaaatttcaaagaaatggtgacaacatttcttgtatcatgtactgatactgacaactagggaaactgctcgaaatgtgttttgcaataacctttatctgtgaaaatgtgaatccccataagtatcacctaaaaaggtaaaatgggaaaaagtaagtactgataactgcctttgctgaacatataaccccttccccaccacatttaaaataatttagtttgcacaaattcaatttagagtcattctagaaataaacttcagttatacatttataaaaactaaaatggaaaccctctagtatgtgtccatattcagcagcagaattggttttaaagaatttttcatgagcaacatgttctctctaaagtatcagtttttttgtatgaatgcccaattttcttccatcaagtcaattctatcattgcattgtgataccaaatattttaagaagcccagcattttatcttggttgttttttaaagaaatgcagctttcctacttcttgctgtactgattctatctccatctctgtttttttctgagtaatttatcatattgataacaagactttctgatgtttttaatactcgagcaaggtattctttgggtttcagattagcaaaacacattcttgtttcttaatgggccaggaaattgagacaatagttattttaagatagttccatgtgggagacttggtttgctaattacgtatgagataaatttctgctatgataagactatagtgaataaacagcaaggtatcaaattgcagtgattcctaactcctttagagttgtaacgagctgtttttgtcatattatttataagatccctgtcttaggttggattcccccagaggtagaccttgaactcatgatttgtgtgcaagtgatttattaaagagaaaccataaactactagtagggaaagcaacacaggaaaggagaagaatctaagcaagggtgagaagtcaggcaaaatttggcagaggtcaccatcatcatgactttacagagacagataatgtttgctgttttgtctccattgtcctttttaaaaagaattcagaatgaatgcttgagtcattgtccctttgcatatatgagcacatttaatgtttctggaaaatctgtaataagtcattgattctcttaggttataagggattggttaagttcttcctcgtatttctgtggttttaattattttccctaaaactgttacttttcagcattattgctccgttgttttcagtattttttggatttgggttttttgttttgttttgttttgttttttgtcaattgcctgtcagttgacatggttttgtgagattttccggtatattcctatgagccaagctttttaatatcaggaagtttcttctgcagatatgaagacttcacaatgccctctttccttgagactatttgtaaacatgaaattggcacaagtcacaagacttctttatctaaacaagtgttcttttactccttcttcttgttactttctcttaagcagctttttatccaggcataactttttcccagttctcagagagttgtgattctttttaatagcctttgatttgaaaactaatcaaaagttatacaaaatgtattaagatagagtcatgcttgttgaagaatgactctcttggggaatatttgtcatgagagactttgtgataagatccagtttgggcagatgccatatgttgaaagaagctgggcgggcggaagaaaccctccatgtttactgaggcttaactttgagtgtgctcagcatggctttgcacagctaggaaagaaacaacagtcatgaataaatacggagtcctttctgagcaaaaatattttaatatattgagagccagtgggaggatactggtgtgtgggaagagtgcagattttggaatgtaaaattcagggtctgaatcctgacctccttatttaatagccctgtgacccacaagttacctctcggagattccactttcctgtctataaaatgggaatcataatgtatttttcatgggttgttgtcaaagcaatggtatgacatgtgtattagttcgttttcatgctgctgataaagacatacccaagactgggcaatttacaaaagaaaaaggtttaatggactcacagttccacatggctggggaggcctcacaatcaaggcagaaggtgagaggcacgtctcacatggtggcagacaggagaagagaacttgtgcagggaaaattccctttataaaagcatcagatctcatgagacttattcactatcatgagaatagcatgggaaagacccacccaaatgattcaattatttcccaccaggtccctcccacaacacatgggaattatgggaactacaattcaagatgaaacttgggtggggacagagccaaaccatatcattctgcctcttgcccttcccaaatctcatgtcctcacatttcaaaaccaatcatgccttcccaacagtctcccaaagtcttaactcatttcagcattaactcaaaagtctgcagtccaaagtctcatctgagacaaggcaagtccctcccatctatgagcctgtaaaatcaaaagcaagttagttacttcctagatacaatggggtacaggcattaggtaaatacagccattccaaatgggagagattggccaaaatgaaggggttataagccccatgcaagtctgaaatccaggggggcagtcaaatcttaaagctccaaaatgatctcctttcactccatgtctcacatccaggtcacgcacgctgatgcaagaggtgggttcccatggtcttgggcagctccacccttgtagttttgcagggtacagcctccctcctggctgctttcacgggctgatgttgagtgtctgtggctttcctaggcacacagtgtaagctgtcagtagatctactgttctgcggtctggaggacagtggccctcttctcacagcttcactaggtggtgccccagtagggactctgtgtggggctccatccccacatttcccttccatactgccctagttgaggttctccatgagggccctgcccctccagcaaacttttgcctaggcatccaggcatttcagtacatcctctgaaatctatgcaaaggttcccaaaccccaattcttgacttctgtgcacttgcaggttcaataccacatagaagctgcaaaggcttggggcttgcaccctctgaagccgtggtctgagctctacattgccccctttcagccacagctggagcagctgagatgcagggcaccaagtccctaggctgcacacagcatggagaccctgggccctgcccatgaaacctttttttgttccaggcctgtgataagaggggttgccgcaaaggtctctgacatgccttggagacatttcctgcattgccttggtgattacatttggctcctcattacttatgcaaatttatgcagccggcatgaatttctcctcagaaaatgggattttcttttctatcgcatcgtcaggcttttatgctttgtttcccttttaaaactgaatgcttttaacagcacccaagtcacctcttgaatgctttgctgcttagaaatttcttcccccagatactgtaaatcatctctctcaagttcaaaattccacacatctctagggcaggggaaaaatgccaccagtctctttgctaaaacataacaagaggccaggcacggtggctcatgcctgtaatcccagcattttgggaggctgaggcttgcagatcacaaggtcaggagatcgagaccatcctggctaacatggtgaaaccccctctctactaaaaatacaaaaaattagccaggcgtggtggtgggcacctgtagtcccagctacttgggaggctgaggcaggagaatggcatgaacccgggaggtggagcttgcagtgagctgagatcacgccactgcactccagcctgggcgacagagtgcaactccatctcaaaaacaaaaaaaaaataacaagagtcacctttgctccagttcccaacaagttcctcatctccatccgaggccacctcagcttggatttcattgttcatatcattatcattttggtcaaggccattcaacaggtctctagggagttccaaactttcccacattttcctgtcttcttctgagccctccaaactcttccgacctctgcctgttccccagtttcaaagttgcttccacatttttgggtatcttttcagcagtgtcctattctactggcaccactttactttattagtctgttttcatgctgctgataaagacatacccgagactgggcaatttacaaaaaaaaaaaaaaaagaggtttagtggactcacagttcctcttggatggggaggcctcacagtcatggcggaaggtgaaaggcacatgtcacatggtagcagagaacagaagagaaattgtgcagggaaattcccctttataaaaccatcagatctcataagatctcactatcatgagaatggcacaggaaagacccaccaaatgattatctcccaccaggtctctcccacaacacctgggaattatgggagctacaattcaagatgagatttgggtggggatgcagccaaaccatatcaacatgtaaagtaaagtgcctgttattatgtggctaagtgttgtgaaatttaggttttaatgataggcactgcatgtggaagctacagcacaaatgaaagcataattttttttatattcagagtacagaaagaaggtctggtcagccttgaattttcctcaggcaaatatgaaataccacagtgttgatggcattgtctctgaatcttacaaaagatgggagtgcaaggagctgtgcaggcatcagaatcaggctgctgtgacattattctgcccgcatatattattttagtgatttttgtgtcattgttgacaatagactttgtcagtcactgtggccttgctctcttaatggaatatgaaacactagttctagagaagtacttagcttgcaggcattacatcagaggctgaagcaaaacctgacagcaacatctctgcaagtggaagaaagaataaaaactaatatttcctgagttcttattgtatttttttgggaaataggtttggctgcgggtgacagagacacattataatcatgacttaaaatgggaacatattcctgtctaacgtaaaagtctgggttgactggtggcttttgtggtattgttatgggggctgcattaaagcaggggtctggactccctatcttttgttgctccaccatgttgagagtttagctcttgatccaggatggttcattcctatgttctcatcccagcttcaggaaaaagagaagaggtcaagggaagaggattctccctcttccattaaaggcatgacctaaaggtatatcgtttctgattacactccattggccagcatttagtatcatgacaaaacctaactgcaagaaatactgagaaatctagtttttattctgagtggccatgagtatagctagatgttccactaataaagaagaaagggagaacagatattgggaaacacataccagaattgtctattccataattattatgtgtcaagctgtgctaaacacttacaaacattgtcttacttaatgctcataacaacactgtaatgctgtttttacagaagtattttgagacacaaagaggttaagtctccttaagtcttgagacagagagacgttaaataattgtcttaaggtctcagaggaaataagtggcatagccagaacttgaacccaggcactctgactttagaaccctgtgctctgggccactgtgtaatccttgcttgctcattatctcccttaggccttgatgtgctctactagatgagattgtttaaaagcatcaaggaattaaagatactttataaactgtttattcatggcttcctcttcaaggcagctaattgcttccattctaaaattcctatcttatttggtgtaaaatggtgttcagtacaatttggtccagacaagataacacaagaaaaataatgccacacaaatgtgacaagaattttaatgaaagcaattcctgatttgaaagaaatgtgtctatgtgatgataaagcaaaaagtctttttaatacatggaacatttttgatgatgggatggaaaaaaacattcaatatatcactagaatacagaaatgaaaagattgtatcattcaacaaccatcaagatagttaatcttttcagtctttacaatttcaactacatataggtcagcaatttatatgttaatataaatgtatctatagagcaacaaggaaaattaaagaatgtgaagctgttgtagatttggtggtcagagaaaaccttccctgggcaagcagcagtaaaactaaaattaaaaaaaaaataagcgggagccagccagattaagaattaagttgtatgtttatcagtcaatataggttaagtgatgctgcagtaacagctccaaactcttagtggcttaaaacaacaaagatttctcactcatgccacatgttcataacaggatgtctggggactctacttcatggcattttcagaccaggatccagacttgcagagcagacactatttggaacattgtcattctctatggaaagaaaagggtgtgtggtgaaccctgcccttgattttaaagcttttagctgggattacttaccacgtttcattggccagtgtgagtcacatgatgacatctaatgccaacagggcagaaaggtgcaatcccaacttgctttcagaagtaaggagaatgggaagtatttagtgaacagataaatgactactgttttgggtgatggaatgtggagggaaggcattcccagctgaagaaatagcatgttcaaaggccctgaagtgggaaagaacttggtatatttatgaaactttaagaagaattatgttgctgaatcctatctcctatctgtagacaggagatgaccagagggaagagggagcagattaggcagatctttacaggctatgggaaagaggtataaatttcattaaaaatataaaggaaaactactggttggttttaagcagaggaaccacatgatgtaagaaatattttaaaagagtattgactaatgatattgattattccatggagagtagattggaagggaattgaaagtagggacacctaataggcaccttttcaaaattctaagtgagattgcatggtggttccagtttaatgcagtcttatttgaggcaaatattccatctattttagacattttttaaattattaattattatccatttcaatctccttcccatatgcctcaaattcatacagcacttcaagccactgcagtgagccacagggaaggaataaaggttttcttttcctcttcttttacttctttttctcttttctcttcccctactaaggatctgtgcctgcttatgttgaaggaaaggaaagagaaaagttatgcttcattgcttgaaatatttggtgatgggacaaagaggtctcctttctgtcgtcattaccatttctccatatgaaactgataacagaaggctgtgatatcttctcactctgtttaatccacatgaatgttcaaagagctgatattctgcctccaggatgtttgtagggtaggagacgcacaatcccaagcagggttccttctgttctggctccaaggggaagtgaggctgagaggagaaatgatggataatgagaaagtgatgtactcattagaactgaataatggtttcaacagtgtttaaattcatgattttggatataatataatttctagagataacaacttccagggtttcttcatgagagtgaatggtgcacatggacaggaaggtcaaagaagatgaccaggtcaaagaactgaaagcccagggagttggatgtgttatgcccaggaatgatgtactctgtaagaaatgaagccaagtcaagggtatatccatttcctgtggctgctgtaacaaattaccacaaacttggtggggacttaaaagtgcttagtatggctgcctgttgcaacacatgagtcatggtgtgtcatttgtctccttaactaacataaagggtaatggtaattcttagtagatgttttgtttagactcatttttttcctcaataccagaatgcctagcacagtgtaggcgtactataagtgcttgttggatgaatgagtgagacatgaagtcaaagattttaaaaactttgctctacagtttgaaaattctctttttatgaatctatcatcaggctgagaaataaatgacctggttcctgattccatctgtactgcttattatttttaacatgagtcttacaatacctcacaagctagtttgaaagatcaaaagaaataataaatagctttaaatattcaactgctttattacctagcatgaaattggatcctgagcagtatatacaataaactaaggcctttgttcctgcctttgggaagatgctagtctagatgggcatgacaaagtttaacaccacaaatgtaaaaagatatggtataaaatgtgtgggatgattctcaatttttttttcctagaacatagacattctgtgttgaagaagagattggctcagtagcaccaagcaatgacatgtctgtgaagcatttaagtgagaaggaacctgtcttctggagcagtgttttacaaatttggcaatatattggaataaacagtgaagcttttaaaaatcccgttacctaggccacatccaaagctaattatgttagaatctgtggaagtgagatttgcgaatcagtatttttaaaatctttccaaagtgattccaatatatagccaaatttgagactgaatctccaaagctgtgcttctccaactcaaatcacctgaaaattttgttaaaatgtaggttctgatccaacagggtctaaggcagtgcctgagattctgcattcctaaaacgttcccaggtgatgctgatactgctggaacaaggaccacacttggaacagcaattttctaaaggataaatatatcacatgtcaggtagtaaaagaagggacatggaacctatgtaccaagcagcatgctgggaactttacatttatcatctcatttaatctttaaaacaatcatgaaggaatattattactctcattttagaaatgaagagactggggttgagtgggtaaatcattgcctgaggctggacagcttattcatgatggaacctggatttaaacataggcatgtctaacagcaaagcccataggctaatagaaattgttggaaactttcaaatgctaagcagaagcttttcgatgtgaaatggtaggcagtctacagccataccactctgaaagcacctgatctcatctgaaatggtaggcaatgtctttattacttttcttaagtgcatggagattgtgcctacaatgatgctgagtttgatttcacactcctgcctcaagtagtatatataggcaggtaaagaaccaggtactgtgtatgcctgtaacctggggccatgctctctagtgttatggtatcaaagatatcctagagaagttacagtagaatgagaataaatactaatagcaaaataatagtgctggaagagaatgtcaaaattcaaaagtaaaacacaaacattttatttttcagttactgatatcaaaggattgttgcctctggagggagaaattgtatttcctgaaaatatttggttctaactccttgattcaaatgtccttccaaatgaaaatatctcttgattaaagagatgggaattgaaactagcgacaccaaataggcaccttttcaaaattctaagtgagattgcatggtggtccccagtttaaagcagccttatttgaggcaaatattctatctattttagacattgttttagacattgtagatatctctgctcctgtttgtttttttaagtgattttttttcccctcttctttcaggaagctgaaaaatgaactcttagaagcaaaacgtagaagtgggaaaactcaacaagaggccagcagagtttgtgttcactgtcacagaaacctgggcctaatctttgaccggggagacccttgtcaggcttgctcactgagggtatgcagggagtgtcgagttgcaggccccaatggcagctggaagtgcactgtctgtgacaaaatcgcgtgagtttcttgatttttcatggaaagtggagattgatgactgaagggattggagtggggaaggcaaaagagaaaaagagtattttaagtttaaggatagagagtgcaggtgaaattacagcccaatcacaggcttagcaatgccttggcagggctctggggtgtgtgtgtgtgtgtgtgtgtgtatgtgagagagagagagagagagagagagagagagagatacagaaagaatatttttttaaaaattgcaaagcattgtaaaattggaagcctcactgaaccatatctctttctttttaatcattattaatattattattttagggacagggtctcactctcaccctggctggagtgtagtggctgttatcatggctcactgaagcctcgacctcctgggctcaagtgatccactcatctcagcctccagaatagctgagactacaggcatgcaccactacacacagctaattgaatggcagggtcttgctgtgttgtccaggctggtcttgcactcctggactcaagggatcctccagccttggcctcccaaagtgctaggattacaggcatgagccactgcacccggccactctttctgtatttcaaaacttcccctgagcatccttgtctcagggcccctcttggcttcacgtggctcctcagagggcatagataatttccctgagacattcttagacatttgaggtgactggcaatatggttctcacatgttcagcctgctctgcacatcagctgacaagcaaagctggagtacttcccgaatttcctccaaaccgaatttcctccaaattctttctcattccttgagaaagaatgaagggagagaaccttcccatttgcctctctgtttagcctgtgggagtgcagtaagcacaaatttcactttgccaacttgggtgaaagccaagagtcattgttttctcagttcagttaaaccagtcttagtctgattcagtctctactgctcccctccttttgagaaatttcccctgaatccactggtatgttttctccctcccagtgtctgtctcctctgctctgggaggtgcctcataatctcatctcaaggcagctgagtgttcatctacctttcctgtgaatccaattcattggtttttgttttgttttttgcctagttaactcatcctgttacagtagtttaggggctgtcttgggaggaaaagtaaatagtgagatagtagaagtgatctttcattttcatcttctctaaatgaggactaccgttctgttgaagacgcctatattcagtgcttacatttttagccaatgttatgttccctgtactgtttcacaaaagtgatcctgaatagagcaattcaaactatgttttaatactggattgagataagtagggttatttttgtgaatacatagcaggtatatatatttatggggtacatgagatattttgatacaggcttgcaatatgtaataattacatcagggtaaatggagtatctattacctcaagaatttatcctttgtgttacaaacaatccacctatactcttttagttatttttaaatgtaaaattaaattattattgactatagtcacccagttatgctatcaagtactagatcttatttattctgtctaactatttttatacctgttagccatctccacttcccttgacccccactacccttcccagcctctggtaaccatccttccactctctatgtccatgagttaaattgttttaatttttagctcccacaaataagtaagaacatgtaaagtttgtctttctgtgcctagcttatttcacttaatataatggcctctattttcatccacgttgttgcaaatgagtggatctcattcctttttatagctgaatagtactccactgtgtatatgtaccacattttcttcatccatttatctgttgatgagcacttaggttgcttccaaatcttggctattgtgaatagtgctgcagtaaacatgggagtgcagatatctcttcaatatactgatttcttttcttttgggtatatacctaggagtgggattgttagatcatatggtagctccatttttagtagtttaaggaacctccaaaccgttctcctagttgtactaatttacattttcaccaacagtgtgtgagagttccttttcctccacattctcaccagcatttgttattgcctgtcttttggataaaagccattctaactggagtgagataatagctcattgtagttttgtcatgcatttatctgatgatcaatgttgttgaacaccttttcatatgcgtgtttgccatttgtatgtcttcttttgagaaatgtctgttcagttcatttgcccattttaatcagatgattagatttcttcctaatcagattattagattttttgtagagttgttcaagctccttatatattctgattattaatcccttgtcagatgggtactttgcaaatattttctcccattctgcaagttgtctcttcactttgttgactgtatcctttgctgtgcagaagctttttaacttgatatgatcctatttgttcatgtttgctttgattgcctgtgcttgtggggtatttctcaaaaagtgcttgcccagaccaatgtcctagagatttttctgcgaagttttcttatagtagtttcatagtttgaggtcttagatttaagtatttaatccactctgatttgatttttgtatgtggtgagagatatgggtctagtttcattctatgcatgtggatatccagttttcccagcaccacttgttgaagagactctcctttccccaatgtatgattctggcacctttgtggaaaatgagctcactgtagatgtatgtatatgtttcttcattttttattcggttccatcggtctttgaatctgtttttatactagtaccatgctgatttgtgtatgctatacagcataaaaacatagaaattatagttctgtggtataatttgaaatcaggtaacgtgattcctctagttttgtttttgctcaggacagctttggctattctgggtcttttgtggttccatgtaaattttaagattgttttttgcagttctgtgaaaaatgtaattggtatcttaacagagaatgcattgaatctgtatattgctttagataaacagttttaaagaaacgaatcttttaagttcttttattacttactttggatacgttattttgatttacttaagcaattattctcaattctttatctcacataaataaatttttcttagtcctttctgtcatcagcaaacttccttctccagatctgggaggatgaacagtgatgaaataaacaatatatggatttcaacataatcttttactgatttgaaggagctctttatatattctacgtacaagctatgttggttacctatattgcagatatcctctctcacctcctgacttggctttccattgtcttaatggtatcattttatgaacagaaatctctactttttagtagttccatttgttaattttttcctggattactagagggatttttttctgaatcctgttgaagaaaactttccctaacaccaaaatcatgaaaatattctcctatgtgatgttttataattgttattgtcttaccttttatctttaaacttataatccacctgaaacttattttgtgtgcatactgtgaattagaaactgatttttatattttaatgtgggaattatgcagtggctgatttgagtatcctagataactctattcaatgatgtttgttaattgcattgtccaagtcttccatatacttagtgatttttaatctgcatatccaatcagatatcgagaaaggtatgctaaactctctcaataataattgtggatttcttatttatccttttagttttgattatatttgctttatatatttagatttactacagagttaccctttccactgctctttattctttgctatatctctatgcttccatcagaataatttttcttcttcctaaagggtaccctttagtatttcctttagtgtggctttgctggtggtgaatactctcaatttttttcttagcatggctttatttcactcttaattttcaaatgtgtttgcactgcttattgaatcctaggttggatgttattaactttcagtaatttgaagatcctattggcttctgatttccagtgtttttattaggaaatcagctatcagtatattattgttcctttgaaggtaatatttttaaaacgtttttaatattttcccctttttgtcgtgttttcaacagttactataacaaacctatgtctgattttctttgtatttatctattttgatgttcctagaacatcttgaacctgtacattaatatcttttgtcatatttgaaaacttctcagggaatatctctttagatatttcttttcccccattatctgtctcctctatgccaggtagtcaagatatgcatcttagtaatattcagcatcttttagatatctttatgctcccttctgtatttgttatccatttacatctctaaactcagtttgtatattttgtctgacctatatttcagttcatgaatcctgcctttgtgtctaatttgctattaaacacatccatttaattcttaacttcagttactgtgtttttcaggtttagaattttcattttgcctctgttatgttttctaaccgtctgctgacctactcatttttttcttgtaatttcttgaagtaattatttggaattatgttaaaatgtataaattatagatctgttatctgagtcccctacgggactacttctattgtttattgtttcttgtggttttggtcatgtctttcttcccgtaaacctagtggttttttattgatggccaaaatatatgaagaaatggtaggacttaatgagactctgtataatatgcctctattgagaatgtacatttttcttctgaaagggaattaggataaggctcttgcatatttaagattaccttaatcaagtcaaggattgaactaatttcaaaattgggaccttggtccccatgagggctgatctgtttctggatcacataaactcatagggaatactccttcagagactcataacatgcctattagataagagaggcaattggttttatattttatggatagtgtaaacaagaacgctaagagttagatgtgtgttagtagagttgggatgagtttaaaagttttggggttttttgtttgtttgtttgtttgcttgttttttcacacagctcttttcccaccagattctgccaagatgagattttccattttagagcaatgaagaagaaaattgaattttaactaatgactgatttgctagtcctcaactatggagtctgaggatttatgggggaatttctcaataactatttctctaaatttataaaatactatttgatcgttagtatttatttttgtcatttatattccatgtttgttcaccctcttctttacacccaaggccctcactcacttagacaacagtaaccagggactgtgactcaaaaactcttcaatcaattataagtcatcttaagcttctgtaccgggagaagaattttatctttaacttctaaatatcactatctaaatatatctatctaaatatcattacaaggtaattactgaggtatacttttcaatacaagatccaaggagattgtgtattcacacattttgccatcaactaatctgctagttagtacggatgataactagaggcctaagtcactcataccgctctcctacattttatcagattaactttaggttattttaatgagaaattaacttttaatataagtcagtggaattcggagattgttttagaagctagcctacccaaattaatataaccctttcctgtggtttttcccttaatacttacatgctctatattttacttatttatcttattatttttctttctccactagaatgtaagggcaggagtttttatctgtactgttcactgatgtagttctagtgcctaaaataatgtctatagtaggtactcaatgaatacttgttaaatgaacagatagatgaatggataaacaaacaaatgaacaattgaatggatgaataaatggttggcctctacttaaagtatatcaggcttaagcaagtggaacaaatgtagaacaattgtggttttcttctgtcaggagcatgggattaaaaagaaatgagccatgccaaatgcatttgccctctgaacaaagtaaattcctaactgtcacgtaaagatgtaacataagttgttgtcagagggtataagaataaataataacaaatcaaaacttccgtgtcttccttgggacatgttaatgcattgatacagaacttctgaatcaattgcactaattttattggtgtaacaataatttaatagacccaaatatccacctatataattaatccattcattaacccatccatctatctttcccacacatttattgataacctgttaagtatactagggactaaggatacaaagttgaataaaaaatggtctatcttcaatggttacacagtataaggaggaagatgagtttattattttattcataaatttctgtcttgatgcgttaaaatgtcttaaggaagaaacagctctttcaatgtgtgattctaacccttctatgacaacaacttgtcttttagttatatccttctgtgacagctagaaatttacatgatgagtatttaatttgatatatcaaaattacttctcatttttaaagctgaaaatcagagtacattacttctccaacattgcaactgttagtctgtgtgatattagagacttaaactatatctcagtattggaagtatcttgtttgctattcatggagtggttttcaaaacggaagcataaataatattttattggcagcaaacactctttgtttattgtgagagaatattgcagccccactgagctgtctctatatttaatagaccataaaattgaaattcccaccctgacctctaagagatgagatgagtcagaaggtgactcactctctaatcagttggaagtaaatgacctttattgtcatttactttggattgggtaaaagtaaagagcttttattgctttagcactgaaacgattacagcaaggactgacagaggaaggttacctgttataatgggctgagcaggccctgacattttctccaatcccttctgattccaacaagttggctattgtaagcctagtttttaaactctataaaaaacatgataaaagggaccttgacacagccagttaattcatttttctatcttaataatacctacaaaattccacattgttatgttagctgaggcagttgcagtccaacacaaagacagtcataatgatcattttttctaattagtacccaattgaattcagaaggccccaaagataaaagcaacatgagttggaacaaaacatgaaatattttttctttttttcttttttttttgagatggagtcttgctctgtcacccaagccggagtgcagtggcgcaatctcgactcactacagcctctgcctcccaggttcaagtgattctcctgcctcagtttcccaagtggctgggactacaggcatgtgccaccacacccggctaattttgttgtatttttagtagagatggggtttcactgagttggccaggctggtctcaaattcctgacctcaagtgatccacccacctcagtcttccaaagtgctggtattataggtgtgagccactgtgtcccgccaaaacatgaaatacttctaatatggcattgatgggcagatcttatattcatgctatgttgcaacatattaccgtgctatatgtccttgtgagaatctttgtctttttaaattaggaagatcctgatgatatttttatttttgattgattggtaatgattactgcaatggataaaatataactgaaatagatgaaaaatactgagtgtttatcagtaaaatagatttcaaaaaagataatactgatggatggaacatacacagagtgcagaagacgatgtatacacctttgttataagaaagagaaatacagcccctgacatctggaaactgggctcacactgacaaacctagtcccttgatgttaagagctggtcttgcacttacaggtaggccatactgttatcctgttggacatcaagcagtctcagggtaccagaatcccacaagatcattctacaacaataataaagtaaacaaaacaagaacactttgtaatcttatctaagcatagatgaaaacaaggtgactgttgaaaccgcaaattaccgaacatccccatttcttgactaatgtgaataacctcctactttcttaccaattagagctttagcctagcattagtctgccatccttctaaataaaatttatcaagataccaatgttagaattgtccccattctctgacatcgcttaatccagagaaaatccctgctccatctaactctcccgaaaattactaacataaacccaaatcctatagtaaatcctttcaagtgccctcttactgagactctccatgattcctcatggtatgtggagttttttttttcattattatgggcaaaaatctcaacatgtttgtccataggtgggacgagcatctggtcatctttggcctgatgagtgagtattggtaattgccacataggtcatttcaaaatcacttctaatttagcaaattttcatagtgcagctacaagggaaagattcatattggagtagtcctacatttacccaaagatttcttgaatggcaagaagctatttttagtcccttgacatgctattttgcatcaactatcaattatatacaagtgcctccacgcttgtatagaatgaggtgttcactatgagtatggtaccttaatagctatataaactagaaagatttttaaatctaaaaatatagtacatatccaaggtactctataatacatatagtttaaacaataataaaaatagcccctgtgtattcattacccagtctaagaattagaacatcttgttttgtatttttcattcccttgctttactttatggttttactgcatttggatgtgtctctaagtaacatgttttctagttttgtatttttgaatattatggaaatggaaatcatactacctgtattcttttgtgatgtttttatctcaacaacatgtttgtgaaatacatccatgttcgtgtgaataacattacattcatctacactgttgttacattcccttaatgcatctattttctggtcaacagacatttagattgtttcagtttataattttaccaaaaaatgctgccatgacattcttatacatatggcctgacaaacatgtatgagtgtgtacactcaatggtgggattcttaaatctgtggatcatgacctattggtaggtagtaactagcattaaaaacaagtggtgggatttttaatctgtggatcatgacccattggtgggtagtaactaacattaaaaaaaagtggagtaaaaagtgtcagtatagatatacatatatatatgtgtgtgtgtgtgtgtgtgtatgtgtatacttatacatgtgtgtatttattttctgagttgtgacataaaatgtatttcttattgtgacctctgccaaaaatgcttgagaagactacggcagattgtgcatctgggaatgaaattgcacaccaaacggtatgagcattttcagcttgacaagataatgttaaattcttttttatagtggttgtaacaatcaaaaccccactagcattgtataagtgtttcctttacttcatgatcttaccaacacttggcttcatgaacattttttattttttccaaaccgatagatataaaggaatatctccctatagtttcaatttgcattttactgcttaagtatgaggttgagcagcttttcatatatttattagctttttgtggttctttttctgtgatatgagtatttatgtgtattgcacaattttattttaggtgctggtcttttccttattaatttggaggtactctttatgcttcccttcatctctaaatatgtttttgctttgaaggctattttttctgttattaatacaattacatcaaatttcttttggttaatagctgcatacatgtttttccaacatttgactttaaacctttctgtgtccatatgtttaaggtgagtctcttttatgtggcatatgtattattttaaaatatagtatatgttatatgtattttaatacttgttatacttatatgctacatacattacatatgtgctgtatatacatatacctgatatatatactatatgtaatttttaacatttaatctcataatattgtttcttaaattatagagtttagtctgtactcactgattactgcaatatttacatttatttctattatcattgtgattcctgaaatatttgcatttatttattttatctgtagattcattaaagtgtatttttctcatcccatgttatcctttctactggtattcgtattatatgcttttttcattttcagtggttaccctggaaattataacatttatatttaactttgcaaatcaatagctaaaagaaacttggtattcttgaactctaaatattattttcctggctgatacataatttttgtcctttgttttagacatttcttattgtataatccaacaatttatgtcatctcatttttctttataaatcaatgtttgtttagatttttatatattttatcaatttcattgttcaccatttctttttatacctcagacctattttacctctcctgaagtatagtctttaaaagttcctttagtgagaatctatttggtgataaattatctgttttcattatgttgaaaatttctttatttcatcctcattcgtgaacagtgatttctgtggatatgcaattctagattgatagtattttctcccagcactttgaagatgtgtcattggtttctggatttcatcattgctattaaaaatcaactgtcatgctaattgtggttcttttgtaggtttccttttgccttcctggctacttttaagatgttccctttgtctgtagtgctctatagtttcaccataatgtgtctaggggtttcttttcacttttcctgcttggaaaggaagaaaggaataaatgtacaccagcatcttcatatggccaaggtccttgtttgtcttcttcacctctgtattcttagccttagcccggggcatgacacatagtagaaatgcaataaatatttgctgtgtaggccgggcgtggtggctcacacctgtaatcccaacactttgggaggcagaggtgggcggatcacttgaggtcaggagtttgagatcagcctggccaacatggtgaaaacccatctctattaaaaatacaaaaattagccgggtgtgatggggcatgcctgtagtcccagctactcgggaggctgaggcgggagaatcgcttgaacctagaaggtggaggttgcaatgagctgagagcatgccactgcactccagcctgggtgacagagtgagattctgtctcaaaaaaaaatgctgtgtaattaataaatgtataaaaaaattgaattagtttccttatgaataatagaaaggaactaatatcttatctcagagtatctaataagcatatcttgttgcagatgtctccagcagttaatagaaaataaaggagcaaaatgaatcttttggtcattattcttttttaagataagattacctattttcccctgtaaaactatagataatttaatttgactttacattcatataagcttccaagtgaaggcttgaaaagtcccagaggtttagtgttaaagaaaaccaggacaaaacaaaccctgaactgtcagtaatcattattcacaaataagtatagcccactgtgattttaatcaggcccattcttcagagtatgacttacagtgcataaagtctatgtcaagtcttgtgtttttcaaatactagattgacatgacagagagggatataaattttatagtgggtgggatttttattttcttttgtcttttaccccttctgtattcttaccactccaccctcaacacacaaacatgcacacgcacacacacaccccacaatcacagccaatcatatgcaatgctatgtttgttattccttggactctacaggttttcacccttcctcaaagccctgttatagttgacaagtatgagttctcttcagacaatttttccaagtataaagcatgtgggatttcaatacaaatcctgtctctgacataatacctttataactttgggcaaattgtttaacctatgtgagctttagtttccttgtctgtaaattggtaatggtaatagatacttcattgcttatagtgagaattagagataccgtatataaagtgactagcctattacttggtgactgacatgcactcactaagtattagtttcctgttctaccaagccttctgtctgcctcctgacaagacgtgacacctgagagggtgacaaaggcataatctcaacaatctgttctggtattttctctgaaatgacaaatgactcaagtgcattatctgagttgaacaaatacaagacttatagttattattctccaagggtagcaagaggtaatgactaacaattctgggaagatcttatttgtgttaggtgttggcagctctaagcatgcatggtaaaagtgatatggaggcccatttcctggagaatgtagactggatgtgtccactttcttctgtcacacatgaaactgctgtcagtatgctatctactccatctcacatccaaagaacatatcaaaaaaaaaaaaaagatctaaggccttggcatgccactatttagcaatttttagtcactgaactatagtattcccccttgttcttatttctttttgtgtactctttgcctcctgcaaaagttaaaaactcttcttttttgtaataaaacaccagagagcaaatattttaggctttgagagctatgtggtctaccgctgcaaccacttagctttgtagttgtagcacaaaagcagccaaagacaacacataaacaattgagcatggatatctttcaataaaactttatttatatgatcaatgaataaaggactccctatttaataaatggtgctggaataactggctagccacatgcagaagaatgaaactagacccctatttttcactatatacaaaaattaactcaagattgattaaatatttaagtgtaagacctcaagctatacaaattctagaagaaaaccaaggaagtatcattttgaatatcagccttggcaaataatttattactaattcctcaaaagtaattacaataaaaacaaaaattgacaaatgagacctaattaatctaaaaaattttacacagcaaaagaaactaacagagcaaacagacaacccacagaatgggagaaactatttggaaactatgcatccaacaaatgtttaatatccataatctgtaataaagttaacaagcaaagaagcaaataatcccatttaaaagtgggcaaaggacatgaacagacccatctcaaaagaagatatacaaggagctaacaagcatatgaaaaaaatattcatcactaatcatcagagaaatgcaaatcagaagcacaatgaaataccatctcacaccagtcagatggttattattaaaaagtcaaaaaattacagatgctggtgagtcgtggagaaaaggaaatgcttatacattgttggtgggaatgtaaatttgttcagccactgtggaaaacagtttggagatttctcaaagaactaaaaacaaaactattataccattcaacccagcaatcccattactgggtatatacccaaaggagaaaaaagtcattgtacaaaagcacatatacttatatattcacagctacactattcacaaaagcaaagatattgacttaacctaggtgcccatcaacagtagattggatcaagaaattgtggtacatatacaacatggaatactatgcagtcataaaaataatgaaatcatatcttttgcagcaacattgatgcagctggaggccattatcctaagcgaattaatgcaggaatagaaaaccaaatactgcatgtcctaacttataagtaggagctaaacattgggtacatatggagataaagatggcaacaatagatactgtggactcctgggggtgggggcaagggttgaaaaactacctattggatactatgttcagtacctaggcaacgggatcgtttataccccaaccctcagcctcacacaatatacccacgtaacaaacctgtacatgtaccctattaatctaaaataaaagttgaaattattttttagaagaccctatttatagaccctgaaatttgaatttcatatacttttcacatgtcattaagtatttttattttgatttttttcaaccatttaaaaatgtaacaatcatttctagcttgcaggctgtacaaaatagatgatggggtgaatttgacccatgggccatagtgtgcctaccttttcccttttgtttctgaattttccttattcatcttcttacaacctatgcaatttcctgagttgaatattagaacaaatatatttctatgttaacttatcatagtagttttctattgccaccttaactattactacagcttagcagtttaaaacaatgcaaatgtattatttcacagttttggagctcaaacgagtttgactcgtttctctactccaggttctgtaaggctgaaatcaaggtgttggctagttgagttcttttttctataaagagattctgggaagaatccacttccaagttcattcttgtggacagaatccagttccttgtggctgtcagaatgaggtgctcatttccttgttgactgttcacggaaagccattcttagctcatagaggtctcactttccagtcattgcctgtggacctctacacctcagagctttctcagcacataaaatctttctcatatttgcaatctgactttccattctgcattgtctttactgacttcctcttcttcctttgtgtttaagggcttatgtgattgctttgggcccatgtggataatctaggataatctcactattttaaggtcagctaattagtaacctaattccatctgtaatgtctgatcacatcagcacctggattagtgtttgactgaatagccaagaaacaggagacatctttcgaatttagaataccacaattgtcacctggatttccaacactgtgatacataagtctatagatcacttgaaatgtatccagaaataacttaacccattcaagcttttggttttggtaggttatatcttagatttgaccgtattccataagcgtattttatatagttactgttatggagcttatccaatagtctgggcttctcaataggtaatataaccacttgggagtaaatctatggtagacaaactatggtcttacctttcaatgaatacttttctccaaggttaacattttcactttttgccagtagtggaatggtgtttcatatataatttacctttgcctcagattccgaagcagatttcaggataattgctgaacaagcagatttcaggataattggggaagaaggttgacatatttttcaagagtgacttttctatttgagatccagctattgattttcaagtccaataagttgctgaatcaaatggatataatattctggggcttgaaatgcctatttgactctcagttgcttttcctcagccaccatatcagacatgtcaccaattcttactgattctcattctcagtgggccaagtgtatgtgtctttccctttactcctcacctccatgataccctgatttgcatcttcatcattttctatcctctttattgtttaactttctaatttgcctgcctacctctggtttctctcttcttcatatatttagccagagattatgtgattcaatctgaactttagaaaaactgctagaatgacattccacctctttacctcagcattcaaatatttgaccccaaatcctaccttttaactccagttttcaatagaattctccacaaatcctttaccgtagttacatagtcctatttactattttcagaacatgcccatagaggttttgggacaatagtgctcacctaatcagctaaagccatttcttaatttttaattagaaatatatttagtctaccgaatgacttctacagctgttaaaatccttgtgatatgccagaaaaggacttttatagcagcataactactataggttgaattccaggtattctaattcattccacaaatatttcctgagtgccagttactgctcctggaaatggtgaacaacacagccaaggtccctgccctcatttcactgatgataataagaactatgagaatatgaaaagaagggtaatgtgttaaaattatgagagagtagtcattcatttgaaaaacattaattgagatcgtggtctgtgaaagactttcttgtaggtactatggaaaacaaaagatgaagcagacagaaatcagttctcagagcatttacaacccagtcgaaatgagagggtagaaataatactgaaggacgctataagtaatgggagaagtacagacaaagaagaggattataagcatttcaggagggaagatgggggtgatttcatgtagccattgcaggtagggtttaaaagatgggtgtgactattcaaggatccttctttcccatctttaacattgaacttattaccaaatccaggcaagcacttccaccacctatgatctgaatttattactcctcttttagtcttaccattgccctagcatgggtgccatcatctgtctcctggactattacaatggccaacctgtctctttatcctattctctcatcagtctaacccactgtacatgttatatcaaagaatcttttcatcacagagatctgatcataagtctgatcacagagtctgatcatgacctctttttcattccaaacctttacttgatccctattgcttgcattgaagatcacttatccactaatgcagtggttaagaacttgagccccaggtcagacttattgggatgggatcctggctctgctacttaccagctgtgtgatatgaggcacattattttattgctctaagtcccaatttcctcatctataacattaggataatagtgtttacataaggttgctatgtggataaaaatatatgaagtatgaaccgtaattagcaagtacctagcagatagtaaacattcaattaatactggctattattatcaccataaaatactccagagattgagataaactttataaataatttgctgttttcagtttattagggatttttgagagttaattatgtggctaaataattgaatttcaatgctcttcccttttcccttgagtaggcagctaaggattataactggtgagtggttttttgaagaaaaggcaaaacgtttcaagcaagtcaatgttctcggcactgatgttgtccgacagtccattttaagaagaagtccaggtaattaaagcaattatgtggtttcacaactgttttcatctccatttggctaactaaataacttctctatgttatgtagttaatcagcataaatgagtttcttgaatcccttagggcatttcacaacttggtagcatgaaatctagatacgtaattcatacaagacaagaagaagtcagtagaaaacaaaattcacaatgattttccatatatctcacccactaagattttcaaagaaaccatttgtctccatcatagacagttctctttctgaatgcatccaatattttactaaacacttaaagtaacataaaacagatgaattaaatgattcacattgtgaaagcaatccttgatttttcaacaatatttatttccgatttcctttcaatgttactttttaaatccagtggttctcaatcaaagattgataatatgtaccttgtctccctccctcaaaatgggagcatttggaaaggcaaggggggcatttctggttgtcacagtgactggtgagtcaatggcatttggtgggaaggagccagagatgctaaatggcttgaaatgcatagtcttactgaatgaatactggcaccaaatgaaaataacactttaccttgacagtgccttttggtgcattcaaattacaatttagttaattaaagatggagtaaaccttgtgattgggagcatgtttctcgtatatggtgtagtaaaagcggaagaaacatctttcagcctgtttctaggcttatctcatctttcatccagaggagacaagtgcccttgtatttaagtctggcacatatggcgagaaggcttggaactgattccagtggtacttctgggtgtggcactagcaaggaaaggcttttccacataggtcacacagatccgatactacagagagatggtgtggagtacagttagaattaggcaatcagccatggcctcttcttccactcaaaccccagtaccttccagaatgtaggcagttcctcaagtcacaatatatttgcacagatgcccaccctcccaggaagtgtggcttatatgcccagaaattaggacatcatttctacaacctcatgctagaactcagtctccagggatttggagatcttaggagaccatgttcccctgctctaaaaatatcaacagaaggctgatgcagtcatccctaggaaggttatctcagtaaacctcccacagatgagttcaggatctttgtcttcagttaactctagaacactcaacaaattagaactaactgtgtgacagaaaaacttgggatgggaatggcattgccaattattatagacttccttgccctgagctaatctgggaaagtgaaagcagaatataaatttgctctcatttctggccattttgtatgtaaatttctcttctgattgtttgttaatgaggagctgaagaagtacagagccaagagcaaacccgccaggatgcagaaaagtcagacacttcacctgttgctgggaagaaggccagccatgatgggcccaagagaaaggggtaagacatggtctttctgagggaatttttgatctttattccagacacctctgaaatgaagactccttaatttttcaagtttgatgtcacttcaatgacccagaggaggtcagagactcaaacaaagtaacactttcttatcattctcctcaggaaatgcagttttaataattttcaataagtaaataaaagtcctgtctgacctaagcacagaagagttttcctttcatttgacatatccagtcttgcactatatggttcccattacttataagtagaaagtttcatgccaggatcagtctataaagaggtgacaacaatttctgttgtacaatgtcaatactcctcccctccaacctgtgtgctgatatataattttatccaaaataaagatttattaattgagcttaaagcaccatattccctatttaaaattcaggcttccttaagaaaaaaagtcacatttggccaccacagtaacttagttcagtaaatgaatacagaatatggatgccaagtactgagaataggaatgggaggtacataagggagcaagaagtttctttcaagggagaaaagtggatcccaaaatataggctataaggaccaaaaggaaactgcatttttcagtttttgtttctcatgcagctattggccagtttttgtgactgaagtagtgagagttctaatgtgcaccaagtcattttatggtcctttctgtttttttattattattgagatggggtctcattatgttgcctgagctggccttgaactcctgggctcaagcaatcctcttgccttggcctcccaagtagctggtactacaagttgtatgccaccatgcctgcctaactttatggtccttttcagacagcattgcttcattctctcagtagaatgcaaagtgagagggcattagtgttagaagatttatctggctgtacaaaatgtctagggttcttttagaatcttgggctgtcagtaggaatacaatctaaatgtcatctaactcaagcactcatgacaaaccatgttttcattgatgagcagagatgagttggaaagatagcctagagtatcctgtatatcctatcctatgtattgatccttcctaccatcttgagttcatttatcactctttgggtcacccacaatgctttgtgcctttgcaccaccaatcatattgcactctgacaccccctcaacacacacacacacacacacacacacacatgcacacacttaattgtaagcttctttagtggtagaccagtggtttctttgcttctgtgttgcagtatctagcatggcacctgactcatcaaaaacaatcagtggcttgattgaataagtaactcagagcccacaaatgcctctaggagttgtcatttgcagaccccagctcaggcatcatagagtaggttacagaatagtggacttggagataggagacagtaactaactcaccatcacaatcaattatgcaaattctgaatcattgaaaccattgtagcactgggctgagccttagattctgattgttctcagtcatcaaggaatataacatctatttggggagaaaaggtacacacctgaaaagttactaagtataaaagaattgcaggaaaatttaagatggcaatgtgagcttcctaaaagcctttctaaaacagaggagggtgttcaccacaagagatatcctaaggttataaattactgagtacatataaataagcaggtggacaataagtgccagttgagtataggagtcatccagaaagacatcaaattgtacatgagatttgaggaggagataaatggggttcaggatcacaaaacggaggaagagtgactccaggcagaggagataccttaagtagaggacatgcatgaggtggttctcagagcagcataccttgacattatattaagtgctattctcaccaaagaaaaaatgtaattttccagtagattaaagcttcagatgctttgacaatgacactattccaggagtctttgaaacagagacaacatggcagattctattaagattgtgccagtacctttggaatccatgttttcctctagaaaactgtagaatgtaaatgaagtgtatctcccaatgccattacaaaaaggaatatagctttgattttcttattcaagtacatttggaaacacccatgttttgggcacatggtatcctggatcaggactttaagttcctaaaaggctgtttctgcttaaaccccaaataatttagtgaaattggaaggtaatcagattttatccaacatgaggcacaagaataaatgtcatggaagataataaagatgagtttagtcattcgttccacaagagttggttggattccagtataagccaggcatcattctaggctctggaaatctgtcaaggaacaagaaaggcagagtcactgctctcatggagctgcagtctaataagcagctacctcagtttgtccaagaggatcatcctggcttccctctctgagcaaagggagttcaaactctctattctcactattcctgcaaacaggcccaactcagggaatgcatcttctttctcaggtgacagtgctgagttctcagaataggcagtcttttgcttagtagtgacctaccagcaagtggtacggtcttgagagaacggcgtaaccttccccattatcacccttgatactgtattgcagaggcactgggaactctccagaacctctcagccctaaggctgctttattgaagaatcctttattattaaaagtactagaaattgtattcttgaaatgatatttttaaatgctttctttcttatctaattttaaatacatatatataatttcagatttcttcttagcaagttcagatcggcaaccagaggagaaatcataactcccaaaactgacactgggcggagctatagcttggacttagacggtcaacattttcggagtttaaaatcacctcctggttcagacaggtaagagtcatacagattgagcaatgatgtagcctgaggttaaggttgatatattcccattcatagggggattttaggtatctgtgaaatattaccacttggagaactcctaacacataatgtgaaaattcaggaagatattttttagttgatatggaaagcacgtaccctacttctagaattacagctattggaattgcctatgtcacctgcagggatgaaactttatattctggcacttggggctgcagttcaaatggaaatgtacagggcaagtaaatgtttttcattgacttcttgagctttttctatttaagctcctgaaaaaaagaaacctctgagtgtcaaatacattccttgcagcttttaaaaaattattaataattttaaatttgaatttcctcagagactttttcataaatttcacttcctttctagttccacctcttctaactggaggagattatcagtggagccaattgagaatgtcctatccacagatctatcacttgtcaagaaaaataatgagaaacacaaaggatagcccagagcatagtcattttatatcaggcgtgattttctgtatcctattggagcatagtcaagacttattttcatgattagtgtattatcaaagctagcaatgagaaaaaaatatccaccttcatatttcactggtttgtccaattgttaactccctttcgtttgcttgtgtctggggtaattttgcaagccagatagtacaagtagcagattttcttttctccttaggttaggaagaatgcaagcagaattgcattcttccctgtaatccattttagaatgcagaccaaaaaatttccttagaggggacactattttgactattgggttattttttcatggtgactctccatagctgtttcttttgtccctataacagtcctgcatgcaagcgttactttatgtaaaaccatacagaaaaaaaaaattacaaggaagcgtaaagtcatttatcacccattatcaaaatattaatactgtattcagtatttcccaaactttcaagaatgctgatatattcccttttatgattacaaactgttaagctatggttgcctttatccttgaaatagtttcatttgtcttccattgaggtagcttcatgctgtgtcccacaaaactttctataaacatctcattttggctgggcacagtggctcacatctataatcccaatgctttagaaggctaaggcaggaagattgcttgagcccaggaatttgaggttacagtgagctatgatcatgccactgcactccagcatgggtgactgagcaagaccttgtctcaaaaaaaaatgaataaataaatctcatttttgtttttcatagttggactcctgactctgagatagtagtggtcaaaattatttagagacagtaagcaactaatttggtgttctttttgctcagcctcctgggactccatggatgagccaccttggctaacacttaaggctagcatttaagaaaggcaatatatacaaaaagaggaaagacaatgttccttgttttttgtttttgttttttttttttgagatggagtctcgctctgtctcccgggctggagtgcagtggtgcaatctcggctcactgcaacctcagcctcctgggttcacaccattctcctgcctcagcctcccgagtagctggaactacaggtgcccaccaccacgcccagctaattttttgtatttttagtagagacggagtttcaccgtgttagccaggacagtcttgatctcctgacctcatgatccacccgcctcggcctcccaaagtgctgggattacaggcgtgagccaccgcacccggccaatgttccttgttaaagaaaaaaaaaaggctgccagcctaacaaaattagattgtgctattttaagttatatgtcttacagttactcaacaagaataatagggagcatggtctccagtatcagtgcttataccgtaatggactctatctgcctcagtttactctttgtgtattatctactactaggcataaataaccaaaactataaagccatatggacatgcatcaccaagtactggtatattgacccaggagcttcttgttctttttgtaagctgaaagaaagtccctaagtagactttatcttaaattgtaaatacctgaaatggcttacacatagtcagaagtagccaggagtgctttggcttaagcatgttaagaacaatattttgccactaagaaagtgagtaaagatgctcaggagatcaatagagcaaaatgtcctttcccttgaacgtgcatttatcacagtgatgactcattaatggactgccacagtgagatgagttccattatttcaaaatgagtccttagaaaattgaggcaggaggtagcccatcttttcttaacttccatcatctgaagagactgtaagatcccagtctctttggtctattgcctgacccagcttactaatatttcccctttttcccttacaatgcatattttttcatggatcattggtattttcatggagcagctgggcttcggcattcctttttaaggctcacatcatataagagtgtaaatgatgttttatcagatgtgcagttggctttcttttcagtagtttcaaagcaagggaaagtatgaatagattaaagaagccctagcagcctctcagaagagcttgtcaaatggatgttcaccggttgctagggacttgacacatgagacaaagaatatttttaggaaaataaatgtaagctgtagttaataaacaatattattcaaggtagtgatttctaatccctacaaagttgtgatgagctgtcactgtggtatgatttacaagatctctaacttaagtcatgctctcccagaaacagacccctagacaaggatttataagcaagtgatttattattaatcaagtgattccaagagaaaccaggaagggagtaggagagacagaatagagaagaggaagaagctaaacaatggtgctagctccagtgtggtctgaggactcagcctgatcctgtaggagactctagagcataaactatatccctgagctttttccacattgaggagctggaccattgcactcctataccagtcagtcattgaccatggcctcccttgaatagagtctctagacttagcaagtgaagatacaggatgcccaggtatgtatagttgagactaacaactgttttttagtataagtatgtttcatgcaatatttgggacatccttatacttaaaattaatttttttatctgaaattcaagtttaactgcgagttctgtattttatctgacaactcttctataggggtgagggggagacaaactccagggcatttctaggcctccagctccagggctaaagggaaggtctctgaaggtggcaggtgacatccattagcagaaaagaactcaggatctagggaggagcatgcacagctggtaaaaggaatctgagggagatgccaacaatgttatctttaaaaacagagtaaaactagaactttgaacctaaaatgcattttgttcagtaaaaatggaggaagaatgatgctgtttctcagtagcgtttctatcatgtcattggagaatatggcaatatctacatggaatgtgaacagacggtgggaccttgtttggtctcgtaaccaactaggttctcatctttctgccctcccactcctccactccacgcacaccagtttcatccagttattcctaattgctctccagtggatctgggactgatggtcacagtctctgtgaagcttcacaagctgctttgctttggctgtgatccaccaaaagcagagaccacaccattcaaaccagcccttagctagttcttgtcctcatttcaagcactgcccctctctttttctctctctgtccaggaaatatggcactttggatattatcatgaatttaaagaatcatccattcctcatatctattattttagtaaagtgagtttattaaacccattctatcactaaatgatgccttctttttcatcagaaataaaattattctcctgtcctgaatgtaattttcattgacatctttgcaattaaggtgccaattaggtggcagcctcttactagaaatttgaatatagcaaggtgggagtgtttaactctgagtcaggaccacatccacaaagtcaacaatggtctgttttgcgtattagataaaacattacatagctagttgctaatgctattagcaaactccattccttaccaggcttaaaaaaatgttcaaatgtatagcatatctctgaaagtatgtacatttattctataatgatcgttcggtgactcaacaggataaaggctgtgagcattgtcctccaaaggaaaattactttcacctctttcctgtgcctttccctcctttgtcactgctaattcctttttttccattttaatctcctttgggtaagctcagccctccttaggaggagcgaggggtgggcaatcaaagccacaagctgtagcaaatgctaacagcctaaagcaattcgcaaaaccatggtggcctgagaaaagtgaattttaattccagggagcaactgacacatgataaaacaggagaggaaacatgaattcaccagagtattttgttatgctgtgaccttatcagtgggagatacacagtctgaagttgcaaaaaaaaaagaactttagctagaaacttctatttagaactcaaagccatccttttctaaactcatcctttgcccaccatatgcacaaatatgcacttgatttgggctcctttggaagacaatcctgaaataaggattcaagagtaagtaatatgttcaggatgtggtctaaggaaacagagataggagagtggggaaatgagccagggaagggaaggcaggcaaaaaggatatgtcattaagccagttgttattgtgggcaactagagctcaatctcactggccaattctagaaaaccgtgctgaatgtacctcagagttatccagttaagagatagggaatctggggtatttttacagcagctctttgttcaaaatttattgagggctgcttctagggcactaactctctggcacttccgacttgccctgttcacaggggctccatgctcccatgagtcaaaaaactcctcaggcagggagttctgggtattcccagtaaccaagattctgtgggtagaggtaagtgctgaaggcaaatgggcagggacactgagagtctgctacaacctccctcccaaactgctctcagacctccttcaaagacgcagtttgtcagaccactgttcagcccctgatttctgtttactttatattatgtgtgactttcctcattataatgtcaataatgtgagaaggtatggaggctcagtaattcagccacacccatgcttcattcctgtgatcaaatgattgtaagcctgaagcctcctccttgctgttttgtctgtttctccaattgtttcccatggattcactgtcttggcatgctctatttctatgaactaaatctaacaccttcccctcctccaatttaataaattgctcttttactcactgctacctaaatatgtattatgtgacatgttaccactctcagggtagctaagatacaatagatagcctttcttcttctacagatcattgaagagcagagatatgtgacttggtcatctatgcattctattcatacaaatgaattcaacacacagctctgttaacattattgacctagtactatatatgccagatggtaaatgtggaagttcttagacagtaatactgttccacccttttatgagcttccaatttagcaggaaggctgggataactaaacaaataatttaaatacaatatagtaatacgattttaaaaagatgttctgcgtgctatgggaaaaccaaagataggcatttatcctttcaaaggattcaggtaagcttcattgaggtgatccctaagcagcttttaagaaatgaggaggacttggccaggtaaagaaagataggaagagcattctacacagaggaaataaaaagtacaaaggaaaatagacataaagtagactgtgtgctgaaaagaaactgttcagagtttctagagtataaaaattgaagtatggtgtacaagagatgaggagatggagaggtaagttggaccaggatgtagatggctttggatgccttaatacctatcttcttatatgcaatataacatcctactcagaacaagaggttggcaattctgaactactaagtatggagtaagtatttgttccatttagttgctgaaagttaagttctgttaaacactccccttttttgtgtgtctatgggggaaggtagttggctttcttcttgcccccgacttctaattgacccaaggcttttcatggctgctggcctctctcctcaaaacggcttctggtcattatttagaaataagacatttgatcagaattttaatgggatgctaaaaaacaaaaatattatcacgttgagagtaccacctgttcttaagatctacttcttcatacccagctggagtcccttcctcatggtaactgtctcctccattttagagggagtcttcttaaagggaacaaatccattaaggaaacactaaacattttaaaaccctcaaacaaagcagcttttgttttattaagtcaaattataaagctatttctatagttaacattaggattcatttggcacaatttcattgagtgcccactaccttatactactcttgtcctctttccaaaaaggaaaaggaagatatgtgcgagtaagccatagaaggccagtggcttcaggggacattgcagctacagaagctgcttgaggaatttccatgtctttctcatctctctgcttccctaattctgctttgaagtgatcctatgatggctcacttgggcctaagtttaacacacaaacacccaatacctgaaatttacttcttttgggtgtattagcttctccaaagagtttagtttttaaatagactcatgtgtgtgtgtgtgtgtgtgtgtgtgtgtgtgtgtttgtgcgcataggcactgtggtgttaatatatatatatatataggttttcatccatagttcctgcctcccaacttccatagtccttgttatactgttgggtcactttaggcctcagaaaacataaactctctctctgaccttctgctgtccttctttcacccgccaaagcaggactctaacctgattatggttcaaaagaccctcattccggaaaccctgcctcataacctagaggaaggaatgctacacagagaaaccaagaaaagtctgaacagacaagccttgctaggtttagatcatgcactttctgtccaatcacatttttacatggttgtcaatcatgcctatgtaatgaagcctccataaaaatccaagaggacagagttcagagaacttctggatagccacacatgtggaggtgccaggagggtggtacacacagggagggcatggaaactctgcagtcctatccccatacctcaccctacgcatctctttaactgtatcttttgtaatagcctttataataaactggttgatgtgtttccctgagttctgtgagccactccagctaattaaacacaaagagggggtcatgggaaccccaaattgaagacagttggtcagaagttctaaaagcccggacttgtgactggtgtctgggggaggacagtcttggggactgagtcctcaccctgtgggatctgacactctctttgaatagatagtgtcagaatttaattagaggacacccatctggtgtctgctgcttggtgtgtggggaaaaaccccacacctttgttcaccagagacttccgtgatgatcgatgattgttgtagtactgtgagagcagaggaaaaacatacttagagtttttccccaaactggcatacacacagagatcaaaaaccttttctgtaaaggtacagataatatttttgactttgtggtccatatgatctctgtctcaactactcaactttgctctcagaacatggaagcagtatagacagtacatgaatgaatgggctgcctgaattccagtcaaattttatttatgggcactgaaatttgaatttcatataatgttcatgtgtcacaaaatattattcttcttttgatttttttcaaccatttaaaaatgtaaaaactactctaagcacacgggtatatagaaacatttggtgggcccaaatatgtccacaagccatagtttgctgacttctagtgcaacacattcactcactaagacaaagtgtccttcagtgtatcacagtctgaaccacaagaacagcttagctcttttcatgtcagtactgttgaattaaaaaaaaaaatagtggtagaagcagagggagcaatgcaggtggagagatgtctgagatcaatgaacttttatccacagcttagcacagtggttttcagccttggcttcatattggaatcacctggggagttttaaaacatcctggcacctagatgccacacccagagagtcccatgtgactagcctcagtatagtctggacatgggagttttaatggctccccaggagtttctaatgtgcatctgaggatgagggccactcatctcacataagactattaataaagacacagcacttggggatcaccaaagactagaagattgagctacattcatttttagttatctctttcccatttagcaggcttatctcactttctaactgcaaccttccttggccatctttcctgcatattcattgtagatccaaaataactataagaagttaggaaagctcataaacctcagagagaatattttgcattgtctctgtgttgtactgcacattagtctcattgtcccagtgagttttaggatctctcaggttcgtgctgccttaggagagcacacatttaaccatatgggaacaggctcaacactatcagccactctgggaaggttggatcctgggaaattatttcctggctacaactcctaggagacctttatgtaaagcagaaaggcaattacattgtaatctctaccccctatccttggatcctctgtctagaaatggatgtatctgggaagctgttatcaagattttggagcaacatggtgctgtgctgaacccctattaacctcaatagggaaactgccaggttcaagagactcagagccagcaaacgagacatacaattttattagcatcttacacacaggggacagagtccagcagtggtgggctgggcaggaaaaccataaccgcttgcaaataacaatgcagtttatatagcattttcacttaaaaccttccccctaaacgacctccacctggaaaccttcatttaacccaaaactcagggcctcaatccccggtatggcccatgttccatgagaagggccaggggctcagatgtttttcataggtaagaaacaaacctcagggctggccactcctggattccctagcttggaacaaacattcagatgcatctgccacacagggtcattgtaagagtatactgaaatgattgctgtcagatgtgtttcccctacccatggaattagagataacaaaacagaaggcttttaaagtatatttcataaggtaaagtaaattaaactttttcctaatctggaaaatgtgtctttcagcaacccagaatatccaaactcccagacagtgacatatccccacatttgggccttttacagtgagataaatgtatctctttcttgccggtttttacttaaccacattttagcttgaaggtttgttggcactgatttatcatacttcttatttaaatctgagtaacattatagctggattaaaaaatagctttttcttagttgacctttacacttcacaactttaattttgacttgacatagcttttatcattttccaatttaagtggcaaagattcgtgtattttatgtcatattttacataccttctaaatgagttggcacacaaatatttatgataatatgccttattagactaaaccttttttgagtttaatcaactggaaaaaattttttgagaagctcacagtaaatgtcagggacaaatgtgaaattctatgtcatttttgagataatgctgctggcaatgataatttgcagtagctgacttacaatcacaagaattttttccttattacaggataacttcttgaatgtcatcaccacaattaatcaacttctgccagagcttctacataagtagcacttttggtttcagcaaggctaatccatgatggggcgtttctcaaaaccacctggctctgggaggaccttccgcacacacacaagcagaaacacccacatgagtccctttggttcataacttcttgggtcatttctgcaagattgacccctgccctttctttttaaaggatattttacctgaaacagtagggagacatatttctgtgttaacattgttctaaagaacctatggtcacagtacagcatcaatgggaaagtctctatgcctctcctaagtagaacctctgagatgagcagaatacttggaagggtacaaatatggctaactgttgtcaaatgtagaaatgtcatgcttcaggtagaagggttcaggaaaatcaccaaagaaattagaattccaaagtgtatcaatttacttaatcacaaaattttactctcttgtcagaatcaacaggcacagtcttagagatcttctcagctgagttcatagcactgtaatttacttagactgctatttctacaaagaggaagccagagatcctttctgcagagactgtttagtaaaaaagaaaagccaccctttagtaaccactctttagtaacatagaaaattttcataattctcttaatcaagtcccaagaaactaattcctagctctttgctcctttgattaacttctgtttgatagttcattctataaatgcaaaacctgcctggctggaatgatttgttcttagtgaaatgatgagtaagcagtatgagaaactagaatggtcacaggctttgggtagactgacaatactgtttttatgctgattttatcacatgctaactctatgatagcatagtggtatgtcggtgtgtgtatgcatgtgtgtttgtgtacatgcatacatgtatggaataattaacctctccaatactcaatttcttcatttaaaaatattaaataatattctaaaacatattttacaaggatattgggggatggaaaatggctaacacctagaagatactaagtaaatgccactgctattcatgattattgaaggtggtggtagctggtaatgtggtccaaaagaaatttggttttggtgacttctctggtgcacagctttgaaaaaacttaggagttgtggttgacagttctatccaatggtcattgcctattcttctgcctgatttatcttctagtaatgatatgtgcacatttaaacattcttttaaaaaatattcctttattctatttaacctttcctcttattggctcaactgtaagtcctcatcactattaaccactgctggtatgctttaccaataagatgtgtactattatatgtgcatttgtaactcattaagacagtaactgagagagtaaaactcataagggcttctattttaccacttagcatattttgtgcccactgagggaaaagaataaaatgggaacaaacacttctcttaaactccgacttgtcaaaatttatgttgacttatgaagctcatttaataagaaaattgtgaacacctcaagggcaggaaccactttttcatttattgttattggattgaattgaatagttttagcacacatgaaagtgattcaagcacatttaccaaatgtcattatttttgtaccacatttattaaatgtgcaccatgaattagacactaaaacaacacagagaaatgaaatataacttctaatctttgattaaatatgtactgagtggcttctttgtactaaggcactacaaagctgctggagatacatgacaattatggcatggactctgttcccaaggagttcatagtttaatgaaacacccaagctcacatatgtggatccattagggagccaaacaagacattttgcagtcaaatactaaatacagtagtctggcaaagaccgtaagtcaataggaattgagtggaacagaggttgacaaggcttatgcttgacaggaaaggcctaatggggaaggctggacttcatttgcccttgaagactgagaaagatgtgtatagacagagagtggttaagagggcataacaagtggagacaaggtaagcaaaggcctcaggaggtggaagtcaagatggtgagctgagaaaatggtaaggaacccagactggctgagagaatgctggtaagcagaaggaaacaaaatcagaaagatggggtgaagtttaattactgtggggcaaatggggacaaacctagtgatcccctcagggcctttgaggaggaaggtaacatgatagtttctaagcagttccagtgtgactcttgtgaactcagtgcggttcatatgttcttatcagtttcctcatcagctttactctgcctgtgtatttggttgctgctctgcttccatgttaaagtcagaatatgctttctcatttaggggaagcactggctcatcagatctcaatgaccaggaacctggtcctaggaccccgaagagcagtcggagcaatggtgtgaccccaggcactcagagttcaccagccccaagcacacgaactgtgacctcagtcatcagtagagtaagtacacaaacctgatgaacaccgtattagttcattctcacactgctataaagaactgccagagattgggtaatttataaacaaaagagatttaattgactcacagttctgcatggctgcagagacctcaggaaacttacaatcatggcagaaggagtctgtcaaacacttataaaaccatcaaatctcgtgagaactcaccatcatgagaacagcacaggggaagcctcccccatgactcactaatcatccgccaccaggtccctccctcaacacgtggagattgtggggattacagtttgagatgagatttgggtagggacatagagccaaaccatatcagacacccagtctctgaaattcaacctcaccactgcagcatggctaggtttcaactctgtttgtatcagagcatgttctttatgctgctgaaaggtagaagcttcatcaggactgaacctcctgcatcttagctcctggcaggaaacccaaaatgaaaaagggaagagaaagaccaggttcaaaggtagcacttgtatgatggagttttaaattgctatatggcttaaataaatataaaacattttagaaggctctgattttgatcctctctgttacttcttagagaaaatattcataggttgagtgcacaaatttttccaaactgatttaaatctggaaaagtagaacttttatctagtttttaaagtagaaatttttattttcttttctatacatctgttaacataggggtcaacacataatgaaggcttaaattgcattttatatttatatgtgatcaattatattttctactggttttctcttttaaaagagaatatgaaaaaagtatttggggaaaaatattctcttttattaaatattctgttggaagttatatttggaatgaattagcatttgtgagatttttttatttagcaggaagctccatccacattgctggcatctatatttgataaatctttatatgagcagtgagttcatacaatacaaacaattatttgactcaaccaacatttaatgagaacctactatatgacaggctctagtcaagcaaagacttgaaggaagtgaaagaattagcaatgtagttttctggggcaaggtgttccaccacgcagagacagcactgatattcagcaggtacatgcagggaaggctgctctacttccttgtagctggcctccatcttgattggtcagtgcccttgctcagccagtttctaaaatatttttaatgcctctagaagaacagccagtgtggagcccctgaggtgggagcacaccgggtatgttcaaggaagaggaaggaggccaatgcagctgtggtgaatgaatgaggcaaagtgaactaggaaatgaatccaaagaggtcatagggctggatagagccttgaagagtgctgtgtgcagtcagcattcactctgattaagatgggggaaactggaggttttagagcagaagagtaacacaatctgccttatctttaagcaggatttgggggctgtgctgagaagcagctgtaggagaacaagagtgaaagccagaaaagcaatcagtaagccattgtcataccccatgtgagagattgggttttgaaacaaagagatagtggaggtggcgagtagtcaaattccgttaaagcattcagacagactgaaaaacagtaatagatttatttaaacatctatagtctaaattgtagttgtgaagataaaaggcatatttaaaacttcataaatatttatgctaaggtcagcaagccatttctgttcaatagctagaaaggtgcatggatagttgacgaatacactcacctcttggaatctaaaaaggaatgatattcaaaccacttagtgaccagtctggcagggatgttgagaaatcacaacagacactggcacaaggctggggcagtatgcgggggcccttctatgtcatgcactaaacctgaattatggggaaacctgggcttatagatgagagggagcacagggaagtgggaggtggactgggagtagtgctgtttattaactgacacagaagtatttttaaaaatttaacatctagtacagttgtcccagtgggtagcagctgacaatcagtccaatgaccaataagttaatcaagtttattctcacaacaaggtttatctttctacgtacaatttgagattattaggggggaaatcacccttttcatgtgctaataccctcaaaactaacagcccctacttgtgtatttctttgttaaacagcacctagatctctgcaacagaaattccctgcaatttagtagagtatatatacatatacataggcagtgcctatgctgatctcattcttgcaatctagctggtctaagctggtcttttctaagagaaaaaaagaaacaaagagaagtactttctattgaataaaaataagacagcacagtagtttatgaagtacatttgctctttcattaaaagggaagtatatagcattagatggcaagtatatagcattagatgatgagcaaggtaacaactcagtttctcccatttcttagcatctctttgtttcaatgttcttttctgctctagcatgaaagaaaatatattagtcagggatctccacagggatagaactgataacatatatataagggagtttattagggagaatttgctcacacgattataagacaacatcccacgataggctgtctgcaagctgcggaaagagagaagacagtaggatggctcaatccaagtctgaatgcctcaaaaccagggaggccgacaatgcagccctagtctgaagctgaaagcccaagagcccctgggaggctgctggtgcaagtcacagagtctaaaggctgaagaacccggagtctgatgtccaaaggcaggaggaggggaagccaagtgtctggtgcagcttgggaagagaaagagtgagcagactcagcaaacaagccgcttttccctgttctttcgtgtgctttgttctagccacactggcagctgattggatgttgcccactccacactgagagtaggtcttcctctctcagtccactgactccaatgtcagtctcctccagcaacacccttacagacgcacccagaataatactttatcagccatctaggcatccctcaacccaatcaagtatacacctaatattaaccatcacagaaaacttttagagcatgaaagtctctaacctgtcctctactatgatgcaacctattaattttaggcttgacaccctgaacctccagggtatgtattgcttgttaatgacagtgcaatattaattggcctattagtgctcaatactaatgatactcacagatcacctgtgggaaaacttgccattaacataattgcctccaaggaacttggtcttgcttcattaaaggactccatgtgtgaacaactttttgaagaggtgttgaaaattgacctaaactaatttatcagtttgacctctgtcacactcctgataaacttttcttgtttatggcaattagaggaagttaggagctatatacctccagctacaggtattatgtgttggagaataataagatactaaaaacagtctaaattgaagctgaatcaattagcatattaagcaagtgaaagccacatttcactgtaatgagttcatcagagtgtccctgaatgtctaagagatgggcaacaaggagggaattattcctctaggatttcaaaaggcactttttgattgtttacagaagggagaattgaaaaatctgttttagatttgatcattatcataccatgatgtaatttgaatggacacttaacctcagcccagttctggaaaggtccaaaatttgttatagttgttgttttaacactcaagaaagcttcggatgaggcagcagtcaagccctgccttggtctatggcagggcaaaggtcacagacaaagttgggtctatggtcatgggcgaagtcgggacagaattttctttaccatatgttacaataaatgcaagtcccagactgaattctaccacatgtacaagcatttattaacaagcagacaccacacaaaaaaaataactattcctgtgagcttgggaagttttctctctttatttttttatgaacattggtaagtaccatgcatgaaagtcattccaaaatagatgtaaccacccatattctgaccagccagccttctagatggaaaaggtacatgacatcctgttaaatgggggtggaagaggtaagggatggttgaagagagggtatgttgaaagagggaacaaaataggaccaaacagagttctaagcttgagtgctactctgagagtgtgaatcttgacagattattatacatccctcatgtaagattgagggtacctgtataatcttccttattaatcatatattagaacactcattgatttggggaatgagaaattgtccggataccttttgcactaattaacaaacctcttggaatggattttggatagcaattattgatggtaaattttgaagttacatggactcctggtgagggtccttcaaatgtcaattagctcctcctaaataataatacatataaaggtgtttatactgaagtatatttatgtagatgaattttatagtaaattacagtcagtataatttttttctcatttttactttgtgggaaggagtatggttttgaaaattccatggatttggctgctattgaaggtacctctcaggagctcacaaagagtcaccgcagaaacacttctggcacaccttccatagcagtgtctggaacctctctctcctcaggtgggtatttacaatgtgcctactttgttgtttaaaatgactaaatcaaatggaattgactgctatgtgtggtattaagtggatgtttcatcctttaaaaaataagcattcccttctttgacctatggtggtaggccactccataagaactgcttgaagatagacccaggtaaagctttgggcaccttacattcatgaaaattccatttatttagtacatactcttgccaggtatcatcactgagtttcagtgctacatcagaatatcaatatttgaatgaaggaaatataaattattccaggatacatttgctataacagataagaatgcttgctcagagttcaaggaaatggtagttcaattgatatagtagtcagaagttccctacatatagacaaaagaaaatcattctgtggtttaaataagaagttatttgcaagcagcactaaagtattaataattacccctttcatttgcatggtacactcaaatatgtcattttacttcattatcacaacagtcctctgaagcagctattattcattttgaaatgttaatagctatgactaagaaaattcttcggagaaatttgtcataattttgaagcttatgtcccatacatggaataaaaatcatgatgcagtcttcaacattaaaaagctacctgtaacctaatgattatatatgcataaagcctaaggcaggattctgtttgctgaactgaggggtctcttctagccagccagctcccaaaggattttctaaatgtgtgtggttattgctacattttgctcaggagtaaaaaagctgttcacctgttaattaaatttttaaactagtttagaaaccaacatcatagggtctactactactacttctactcaacagctcctgttaattgagtacgtactctgtgtcaggcctatgctaagtacttctgcattatttttttcatcaattcaaacttaagtacttgattactctctccaatctttctcatttataagtaactatattgatctcagtagtgctttggtatagaactattttgtggaaataagctgtcctgacttggtaagctgtccaaagcattactaagaggtgcattgctctgtaacttatattttcaaaaagtgaaaacaaggtgttcttctgatgaaagactcttctggtccattaagaaatagaacttcctctcattgcatctatagcctctcatttttgtgtgaaaagaacttgctatatcacttcaaagtggcagtttagaataggttgcattgcattttatgtcaaatctgaaaacacagtgaattctctaaatattgcaagcaagaattgttaatgtttttttttctaaatttaagggcccattctaagagagttttttaaagtctaggagcaaagcagttgccttaaacagcttaaaacatagcattttacagtagaacatttaacctcctgtgatagaaggaaacatgaacacctaagtgtaattcggtccaaggcaattaccaaaatattattaaaaatagaagtatgttatcataaacagcatgaagttactgactccgactgttgctttcatggcactatttatgatctgtgcctaaaaagaattgaaataaaggtgaaacacttggaataaaaaatgaaatcttctcacaaaacaggctgactcacgtctttctttttcctttccaccttccagatcagagtcgatctgagttagatttgagtgagtcatttacagaagactcagaggatactgtaagcataagaagcaagtctgtccctggggctttagacaaggtaagttggatgtggaagaaaatataatgaagaggaggaaataagggcataatcttgctccaagtggtttcacttttaggtgatgatgagttgagagtaaagagaggatatacaatcatctcttcctgttagtcttcacagtcaacacataaaaaccgaaagaataacttagaaaatataatgggtaatcatgttaatgagtgaaggttatgtctaagaaaacacatgttggagatttcaatttctggctaaagtcttatcacttaatctaaacctgggaaatgagagatcctaacattttccttagccaaatattattagaaatatctgattacatatttatatcaacattgctatatctcaagttaccaccaataaattcacttctaaactgagacaaaattatgtgaaaattaatgtttcagtgaactcatttctagaatgagaaggttaaattagattattgtaaaggttatttcccagtctaatattctgatattcagatttctgtaattgctataataaaatacggactccttggaagaaatagaacacaaatgtaaaatggtattgatagtttttccaaagcacactaggaaacttagagttctaaaatgaaataatattttctatagtacaaaaaactgggaaaatactttaaaatctacctccaaaagagagatgggcagtgagattaaattatttcaaagtttactcatgttcaacctttaaagaattactaattccaacattattaaactattaaactattcgtgatcttagaaaaccattgaaatcttttcattcattgtatgcagccagtataatcttgacactcagacttgatttttaaaatagtttgaaaaataaaactacaagtcaaactagtttacgaatatacatgcaaaactttaaatataatatcaattaaaatctagcagtgaataaaaatagcaataagtaagttttatgctaagtatgggtggaagaatgagtctatataagaatatttgtcagcataatttatatcaatatactaaagaagaaaatgacatgattctgtatgtagaagatactaaaggatctacaaaaatatgactagaactgataaacaagttcagcaaggttgcaggagataagatcaatatacaaaaatcaactgtatttatatatactagcaatgatcaattggaaaatgaaattaagaatataattccattcataatagcatgaaaaatatttttcaaaagtaaggaataaattcatttttaaaagtgtaatacatgtgcattgaaattaacaaaaatatttctgaattaaaggagacataaataagtagaaacatattctgtgttaatggattagaagattcaatatttttaagatggaaattctctccaaataaatttgtagacaatgcaagcccaatcaaaatacaagcaggataattttgtagaaatagaaattattattctaccatttatatgaaaatatatgggacccagaataacaaaatcaattttaaagagcaaagttggaagacttatactactagatttaaaaacttactctacagttatagctatcagtacaacacagtattggcataagcattggcaatcagtggaatagaattgagattccagaaaaaaaaaaaaaactttatggccaattgatttttggtacttcagtggggaaagaataaccttttcaacaaatcatactgggacaacaggatatccaaataccacaaaacataaaagaactttgactcttaacatataccatgcagaaattaagcaacgcaaaatggattataaacctaaatgtaagaacagaaaccataaaattctaaaagaaaacctaggagaaaatctccatgactttcagttaggcaaagaattcttaaatatggcactgaaagcatgatgcatgtattcaagaaaaaaaactggtaaattaaatttcatcaaaatgaaaaatgtttacacttcaaaagacaccactacagatgtgaaaagtcaagccacagactggaaaagtattttcaaattatatatttgttaaaggacttgtatctagaatatatttcttaaaacccttacattcaatattaaaaagacaaataatcatattagataatgggaaaaagatttggatagacatttaatcaagaagatttacaaatgcctaatagctgcattaaaatatgttcagcaacattagttatcagagaaatgaaaattaaaatcacaatgagataccacttcacacccccttgaatgggtgtgattaaaaagacataataataagtgttgatgaggatgcggagaaattggaacccccctacattgctagtggtaatgaaaaatgctacctacagccattccgtaaaagagtttggcaatttctttaaaagttaaacataaatttactatatgacatagcaattttgatcctaggtatctacccaagagaaatgaaaacatatgtccacataaagacttacacgcgaatggttataatagccaaaaagtgaaaataataatatctggtgaatagatggaatacaatgatatattattcagaaataaaaagaaatgaagtactgacacatactacaacatgcatgaaccttgaaaatattatgctaaatgaaagaaaccaggcaaaactacatatcatataattacatttatatgaaatgtcaatgaaaggaaaattgatagagaaattaaagcagattaatggttgccagggagtgaagaagtagggactgactgcaaacaggcatgggggagcttattgggttgaaaatgtactaaaactggattatattgaagtttgctcaactataaatttgctaaaaatcacggaattacatgcatacaataggtaaattttatggtatgtaagtcatacctctataaagttgtgggagaaaaaattagcagcaaggaaaatagctggaaaagtgataattgttaaaactaggtaatcagttataagggttcattatgctatgctttctattttgtgaatgtttgaattttttaatatccacttttgaaaagaaagtaaagaaacatgaagactggtactttatgtgatgactactgggtaattgtataccaagaaagagcaaaacataaaaatatagaaaaggggcaatttgaaaaaataatagggataatagggatgcattttttcagaattaaagagcttattagtttcggcagctttttgctgaagtttttagagtgttctatatataaaatcatgtcatctgcaaacagacaattttacttcttcctttccaatttagatgccttttatttcttttacctgtttaattgctctggctaggacatccagcactatatggagtagaattggtaagagtgggcatactgtattgtttctgatcttagaggaaatggttttagcttttcaatgttgggtataatgttagctaagagcttctcatgtatggttttatgttgaggtaaattttttctttatctcatttgttgagtttttagtatgaaaagatgttgattttgtcaagtgccttttctgcatctattgagatgatcatatgggttttatccttcattctgctaatgcagtttatcacaactattgatttgtttatgttaaaccatccttgcattccaaggataaatcccacttaggttgaatgagcttcttcatgtgctgttgaattcagtttgctagcattttgatgaggacttttgcatctatggtttatcatggatattggcctgcaattttccctttttttggtagtatccttgtctgactttgctatcagagtaatgctggcttcataaaattagtttggaagtgttccctcctcttcaatttttggaagaatttgacaggaattggcattaattcttcctcagatgttcagaagaattcatccatgaagccagcactttcttacaagatgctattctacaagatattccagctcatcttgtgggctcatcagtgagaaaaaggcagctacaataagttctcatttaacatcatcaacagattcttggaaactgccactttcagcaaaatgacatataacaaaaccatttttttcctcatcaatgttttaatgaaatgacattatttgaggacctgctgcacatcctttcacttaaaattacagttttcaagaacctatggatgacgttaagtgacaacttaccataaaccaatataaaaataagcaaattttgaacaagtatttcacaaaacaggaaatccagttggctgattatcacaaaatggtattcaacttagtaataagagaaatgaaaattaaaatcatgaagactgtaaacatctactggattggcaaaaatgaaaaaaatatctaacaataccatctgtttgcaggcaaggaagtggagcaaagggaactctcatatactactggttagactgtaaattggtgtaactacttctgaaaatttgacattatctttaaaatgatatagataagcacgtggagatatgttcaccccttgacttgacaattcctctcactggtatatattcaagtgtgtgaacatatatactgtgttgtgtgtatactgtggtgtgtgtatatgcgccaggatacatattcacagaatatacatatcagtgttggtcacaatagaaaaaaatctgaaaataacccaaatattcagcaacaagagaatggataaagttttggatatcatacaatggaatattaaatgacaatataaatgaacaggctacaaaaatatgccacaattttgatgaattttaaggcaatattaagcaaaaaaagcaaaactcaaaggaatatatagcatttaattacatttacacaaagtacaaaaacaggcaaaacgaaatcattttgtttcagagtatacgcttatgcagttaaactataaataaaagcaagaatgtggttaaccataagagttaaaatattaattattcccgaggggagaaggggcttgtgatatggacaggatacacagggagcttctgcttcatcatttgattttgttattatactatatatctatgttttatgtactttttaatatgctgtatcttataataaagacttttttaaagcaagcccagaagtgtacatcataatcctgatttataaaactatagttaaaaaaattcccatgaatgtatacttatactcagatttgtgtatgtttttatatgatttttcacataaacaaggagaaagacatggaatgtaacatgtgcagcaggatgctaaatattaatttcacctggtgtgaaaggaggggaaggaggagaggagaagcaaaaaagaaaagtgcccataataaaaagcagtatgcatgatacaatctatctatgtgtatatatgtatgtgtgtgtgtgtatatatgtatgtgtgtgtgtatatatatatgtgatgatataatcaaaaatattgaaatttgatcattaatatgttaatgagagacctaagtttttagtttccatttatctatattgcttgaaataattttactaggaaaatacatcacttaaataactaggcaaaaaaaaaaaaagccattttatcatgaaggagaaaaagaaatgggaaaggaaaagtagaatctgggattggagatgagagtccagtatctagttcatcctagtggagagatttttgagatatgctttaccatcttggcagtgtgtgtgtgtgtgtttgcacacacacacaaattttttttaattttaaagtaacgtaagtacattgcccaacatgaatcaccttagaggtaggaattgaacccaggtctgtatgattccaaatttcatgttctttcaataaagtaagcaccattagaaaggagacctcactctccaccccctatccctgcccacttctccgatggtataattcagattgaccggagaggaaaagagaaaaacctaggaatggagtgatttctagaaattttttatctgattctcaaatatttatgaaagaaagtggtttctcaagtgaaaaaacattctagaaaaacaaatcaaccaacccactgatttttccctttcttttttaggactccttggaagagactgaagaaagcattgatgccttagtgtcctcgcagttatctacaaacactcaccgtctggcaagtggcctatcaactgtaagcagttcactaggacatgtggaaagtttcttttccctctttttgattttctgtgcatttccaaaggagatatgaatgttcttaggaaaatgtgtgataatgagttaaaagtcattgtaagatcctgcttgccctttgcccacagagtacatttcagtctaatttggtgtgggttttttctcaggctcctgatttcttccttcttccacagtcctcacccaggttttaaaatctcctcactccctagttcaggctcagtcagctcaagcctataaattatttttcaattatctgctgacacatttccctgacaccattctctaaacttcccagctgtcctccagactgctgccagtcatttatcctaaaacacatgcccaatcaggtctgtcttctactcaaaacccatccatagcttcccactgcctacaaaataaagtcctttcttactttagtgttcaaggccttttttgagaggaaggccctgtgtccttgtatctaactgtgtgtaagtctttttcttggcttctctgatttctgttgctctgatgctttttttcttttgatctttggatgacttctctaaagagttctcaagcaggttctgacaggaagtggacctacctaaatgtgcctgatgctgactcagacactgtgagttttcaacctttcctttttgttctttccaaccatacttcacaaatttcatggtctgggaactatgattaagcaatttgtcccacatttatctttttccgacttatatacaattaaccagaggttatcttctaaaagattgatgagatgatcagaaaccaagtattccaattcattaaacattggaatctgaacaccactcaaaagacacatgctctaaaatgattaactatcaacaaaacctttgaagtaaacaactattttaaatcacagccttagcttggttaagagcatatagtttagttagtagtaaaattgccataggtgtcttagtttctcacaagcctccgtatttgtgggttcctaaatttccttctatccgtaggggccctctgcttacagaggattttctttgaaaatgtggctacagagatctagtatagacacaaatcagtgatataaggaggtaatcaggtatggtggggtagtcctcagactagaaacttggagatcttgctttatttcttggccataccaacaatttttgtgagccagaattttctcatttgtaacatgagtaggttggggtttattcttgaaacctttgatactcaaagcattctctatggaccagcaacattgcatctctcggaacagataccccaaaactttctcagttcaaaaagcccctaatgtctcagtaattctttcctggcactcctacactaaaagtagcacctgactagtccattcattaagtagttagaaccaaataatgtaataagcagtgtatcctaacaacttactagccatttgtaaaaaaatgctacaagtgaaagaaattgaaagaaaaatagtatttttatttcatccttaaatagcacctattacttaccactaataggatatgtgtgcctattgagcactacacagttaccaaatcttggaatctgattggacatcactactttcatttcccatttcacattgatttttatgcaatacttgctttttgttgcagcaactgccaaaaactcagcttcagacaaataggagttcattgaaaagaataaagtgtggtttaaagttgacactgtgaattactagttagtggcttacatggtgtctgataggtgttgttgtgtttcccttgagaatttaaaatatttctgtgattcccctgtgagtttgctgtggtgctctgtggtacctcgatacacagtttcggaactgcaggcctaggagtttgttagaacagccaaatctcagacctcaccccagactgaggagataagcgttttcagtttaaaaaggtatctgggtgctgctcaaagccacctgctaaacatgaaaattctgttgctttgttttaggaataagaaagacagattaggtcactcactggctttctttaagctgtaatttccaaataattatggaattattggtctgctcttgcccgtgaagaagcttagaagacatgtgaccacatcacccacatcctgttctttggtcagtctctacttccagaaattggtggaacataatggcttttaccaaaagcaaattatgaaaaagaagacagtctaaggtccctgtgtatttaccatagtcttgacttcccagtggttcacagaaaagtggttttgaaactattgggtcatccacgaaagacctccaggtggtcttttgtgacagttactgagatacatagttttcatttctagtgccaaaggataattttattacatttacagtagtcacctttatccacagaggatacattccacctaccccagtggatgcctaaaacctcgcgtagtaccaaaccctagccaagaaacaccaaggtcacattttcacttaaagaaagcacttttggcttctctttgacatatgtaaattactaccatcattactcttacactgtggagtcattattaagtaaaataagaatgagttgaacacaagctctgtgatagcaggacagtcaatctgataactgagacagctaagtgactaatgggcaagtagcatctgcagtgtggctcctacagtgtgtccaactggacaaagggaggcttcacatccagggtgggatggagcagtatgatgtgagagttcatcatgctacttgtgaaccccaaaactctgaggcatgtctcagttaatttagaaagtttattttgccacggttgaggaccggcacccctgacacagcctcaggaagtcctgccaacgtgtgcccaaggtgctcagagcgcagttttgttttatacattttagggagacataagacatcaatcaacatatgtaagatgaacactggttgggtctggaaaggcgtgacaacacgaagtggggagggagcttccaggtcataggtagataagagacaaatggttgcattcttttgagtttctgagtagcctctccaaaggaggcagttagatatgcacttatctcagtgagcagggggatgactttgagtagtatgggaggcaggtttgctctaagaagttcccagcttgactttttcctttagctttctgattttgggtgcccaagatattttcctttcacatactcaaaacagcatacaatttaaaacttatgaattttttgtttctggagttttccatttaatatttttgaaccgcagttgaccatgggtagctgaaactacagaaagtgaaactgtggataagggggactactataaattaaaagctgtctcatgtcattagtgtcttgtcaaaagcctcattcattctggtagatttggacttttttaaaatttattttcctgattggttggtgtgtgattttattgtgtagtagtttattttgtgggctgctactttatacagatttacaaagccatggtcatatactactcatgtagccacacagctagctactcagttgagggaaatcatggaagctgtgggtatgtgatgttcttctgatatgtccttgttaaagctgtagttatggctccccggagactgatgggatgctccatgtaggtgtcaaagaaagcagtatgtggctcctgctagcacagaatatgagataagctaccctttgtcccaatcaatgtattctacaccttatagtagattgaacttgagtctaacagtgaaaatggagaaagctgcagagatagacgagaagtgagatttgaaatgcctcaattaccctgtattcattagtagaagtgagtaagcaaagggtattctctaacccaagaaggaaatgcttcccctctaagcaaattttctgccttttttcctgatggtactagatctgctgtcttttctccagctgggattttatacaacaccagccaaacaagtgactcttgttttctttcctcaccctagacttccatgctcattataaagaacaggaactataattgaatgaaatgagttgattctgtgaagagatcattagaatgacactagaagcctttttccatcttgtttattccagaccagccttaacagcatgatgagcgtttacagtgaaacgggagactatggcaacgtgaaagtcagtggtgaaatccttctccatatcagctactgctacaaaactggtgggctgtacatttttgtcaagaattgcagaaatctggccataggagatgaaaagaaacagaggacagatgcgtaagcacatagcatgttcctcagactatttcagtcactgccttttttgtctgtatgtgtgtttccttttcaaaagagtcttagcattcttcttgattcagtcttctcagagagttgattgtcatgttcctcctataccacacttttaaatattctctgaagcaaatgtatactggttgtgtctttgattaactgatttttaaaacataattcaggattgacatatttgcaatttacacagaggcagctctttgaagtagaatgctgacatgttggcacacccaggatgtacaaaagcatcttgtcgatttctgttctgggaaatcctccagagaaaattaccaaactgttacccaattaaacaactcaaaagggcaattatgaggctctcaggattctagagatcagcctgggagggcaggtatggaccatagcacactggagagaagctagatataaaggtgtgtcaggggttctcaagaccactgccaggttcagtgattcactaggaggacttaggactctgcacgcagttataatcagcaaagaggcacatggggcaaagtccaggagagatcaggctcaagctttgcaagggtcctttcccagtggagtcacataggatgcatttaattcctctggcgatgagttctgacaacatctgtgaaatgttgtctgccaaggaagcgtgttagaaactcagctggtcacataccaaatttccagtctctcaggagaaaaagaacccgttcagcataagccatattgtttgtacaaacaatttaggaacaacgagccacttttatcagttctgggaatggtgggaatcctgaaatccaagttgccagatgccacccaagggccaaatttgtaagcaggcatttagaagaatggtagtctcaggcccactatgttaactcttttctgcacaatagatgacctaagtccaataaataactcagtgaacctggttccaaatcccctaagatagacaaatgagtggattttgactacagattggtccacctgcctcctcagctacatttcagagggctacaggaccaatgtaattattttgactggcatggaaaggggtcttctaaaactcaacagatattctgtagaactttggtagcatcttatacatttcagctttgtacacatcttgtacatttctgagtctgctgtgataccctgcttcaagaggctcctgagatagctcaagctaaagtgttgggtagaattgctatcactacttcaggttgttattttttattttgcctttttcactgttttcttttactcacccattaccattgaccccactctctgacatcagaaggcaagactagtaatagagaagcatctaatcccagaaaaatttgtgagaccattaatattaatagtgtattacatgtattgagtagtacaatatggtagctccttggatgtgtcaactaatttaatcctcacaaggccatcagttagacagtgttattttcccagttttacagatgaagaaactgaggcacagagtggttatttagtaaattcttgaggtcaccaaatctctgaggcatggagtgattcaaaaccaggtggcttgacttcagaacccacactcttttatcattatactttaccacttctctcttacggaaggcccagtgttctattttaaggtatcctgttatatagacaaaattctctttggtatttccgctcatgctcactggccctttgccccttttattcacagcgaagtctttgaacatttcttgcaaatagatgtttcacaataattacatttatattttcttatctatagttatgtcaagtcatatcttcttcctgacaagtcccggaacaacaagcgtaagaccaaaatcagaacaggcaccaatccagaattcaatgaaacactaaaggtaaataaatacggtctcatagtaactcatgtggtactgttcacaacttcaatggtttagaagtaactacagagaatattttatttgtgtgtcaaggcttgtatatgttttagaaaattagaatttgaataaattaacataataaccttgacttttctaacatcttttgagaaaaagaaaacactcttactctatttaagtctacgctgctactgaatttgaaccttgagtagagaggatccagccaaactgcatcggtgctgatgcttcttgctaaaaaatcggttttacctttgggcaaacagtgctttttctgacttccgtaaaagaagcttgtcacagttttgacactacttaatgagtcactttgcacgcattcattgttctgctaacatagcataggtctatactgtttgttgttaggatttcagaatttgaccaaatgtaggtatgtggttaatgaatagtggaaatgcagagccagatttgagaaatctcagcaaaagtagcctagataaaatatggcccaatccaggtcaatgatccagaaaatagaaatctctttccaatgcgctttcacataattaaccccttctcttgctatggaacaatctggcctggtaagaaacacccagggaggatggaaagcagaagttattgccaattctatggaaatttatgggcttgtgccccagagtgatggtgtcagagtccactttaggaggaaattggtaaaggcagaaagccacaagcctgcatgtgtcagtgggagcgtgtgtggaagcaggaactaatattaagacagaacaaactgaaaaatgaataaatacaggtagagagtaaattcaatggccataacaggataggaaagatgagcccaaacacagtgagagggtaaatttaggaagcagggagccaaggttaattatgacagtaacagcaaagacaagaataggcactaatccaagatcaggaatcagtcagtgtgaagtgtgtcccagatggtggttgcatagaacaagcagaaggctggagggtgtgtgagcatgtggccctggatgatgttgttacaaaaaacaaaaaaaatgctagcccagcaatatcttctttctgtttaatatacatgtacaccttttcacctctgcacttaggctggactttataaaatttggtgtttgcgagtttctcattgtcaatccttttctggatttggggattctcattatgaataaaataagagagaaggtggagaatgtatatattaaaccttgagcttacaaagtaggtatgaaaaaataattaaggaaaatgaaaaaccaataaaactggaaagaggataagcttcatcacctaacactttttatgcagtatatggagtttatctctacctcagataatttgtttatatatctttcaatgcaaagtctggcacaaaatgagtttatggcatagaacttcaattgtagcagaaacaaagaaaaacaaagagttttctttgtgtttgttttgttcatattactgatgcatatgatctgaaagatgttggaagtaaatttcgacctctcctggaattggatagagccctccttgtggagtgtaatgttgtaaatctcattcgcagtacactatcagccatacccagctggaaacaagaactctgcagctctcagtctggcactatgatcgatttggacgtaatagcttcctcggggaagtagagattccttttgactcatggaactttgaaaatccaactgatgagtggtttgtgcttcaacccaaggtaggaaatgctctcagattagtcagttatgcaatgagacaagttatgagcgaaattgatgtcacagacctaaagaacttgaagactttcaaatttcaagtgataatctgcaaaaaattagtgcagcaaattttggaataatattataaaaatgttgtaaatccaccgttttggaaattctttgtcaatatagatcatctgtataatgaaagctacataatcatttttttgttaaaaatttttattatttgacagtctcattggataactgaaagcaacacattatatgatcttattagagagtcttcattttcacataggcgaaaccaaattcatacagcatgaacaatccccaaacattacctttatttctcattctccacaatttataccacaaacaggagtgatcttgcctttgcttatatgagggaataaccagtagctaaagtatctgattttcttactttcctacttttgggattcatgacccaggccttgagttacattcagaaaaaaaatcttagagctgataattaaatgccaatactgtatagcatgttctaatctagaccaacagtaccttggattcactttaagtgactggagtctctatgcatttacagtactttttaagccaaaatggaggtgagtaaaggtcacatttatgcagccaaagattattgtttatatacagaaaggcaaaagcacattatgatgaagacagtggactcaaatcaaacttacttggttctatcctggcttcatgactgcccatgtgaccttgggcaaattatttaactttttattccttagtgtcctcagttataatataatcgtgggatgtagcttataggtctgcggtgaagcttgaataaacattctacgcatggccgtcagcattttattgggaacattgtaagctctcaataagtgctagatagtatacgtgttacttgggagtccttgtactgcaacagacagaaactccagctaatactgctcaaaaaatagagggagattattggccagcagtgattaggcatagcttgatccagatgttcaaatcttatcaaagtcttggaatttcttggtctctcttcttatcttcattggcttcattttcaggttccatgcagtgttgccctccctgactagctccaagcatgcctctctaatgactacagtggctgcaagcctttcatctttgcaccacactgttcagaagaggagagttcctcctcctccaacagccaaatcagtgcattgggcctggttctcctaattataattctgtcatttgcctattctaagctattgactgtggccagggaggtgagatgcattagctggcttaagacaatcagaatataccctggttctgaagaagggaacaatagcatccttccagtaaatttcctggaaatagttgaaggactttgctggaatgatatctaagctcccctagacctctcctaggcatcctttgtgcttagaaatcaacattttccacagtaatcacttccacattgtcaatgagtggttcacagtctatcataagagggaagcatctctaagtctttctgagtctactgaaggtagaaaagttctgattgcattcactgtggaataccatgggtcctctgccagatacccttaggttcctaaccatgtcttttaggagatttgccacaacagcctccacctgagactctctttagaagacttccctcgggctactgtagctttttgcctatgtaagcagagagccagaagtcctgggaatttttatacccgctgccacaagacaacccttcatcaataactgataggtgggggagtatgaaggcccacttccttactgaaggtgggaaaaactccaaagtgttacatatactaccacatcaggtggaagctatcttccatggaattatgcccaagattagacttgtccctatagacttgcttcccatacctctttactggtctctctgagagaacttccttaataaatcacttcataagaatcttcaccttagagtctatttctgaagaacccaacagaagttagtgtctctaatctctgccatcttcctctgcccagcttcctctgttctatatagaagaaaagctgaagacacaaacgtgcttagatatcatgtcttccataaatggggaggacaggcataaaggcatgctctatcatgctctatatgctgccttgtgcttcattagtggctcatccccaggctgagctgggctctgtgtggttgattatcagccagctatgtgaagtggcacttcagtttcagtttcctgcctcggtcatttccatgcaattgtcactccagcagctgcagatgtagtatgagcagccttggagacttgacgtttctcatagattatgcagtcgagaaggtgaaacatgagttacacatactgatttccctagtaataggggatcagaattaataatccttaataatttagaaatactgacatacttctgcactaggagttccagaacggcatggtgccttattgcttattgactctattagtgaaggttcctcaatatttatctttgtatgggttagatcctacagtgctaagccagtgaggaggctggtgcagagaaagaactcaagatgccaaacatactgtagtttcacagtataacttccattttacttcatggcatgggattatttattagctgtaaagccttctgaaaggcatgtcaggtagttagacaaggttttatcagtatgaattgcctttcatgccttcccagagtgtactattataaaaacaaggacatctgaaaatcaacagcaagcttacgtggttttccaaggaaacgttctcttattctgccttcaggtagagagtaaatgtatgttcctttggaattatacctagattaaaggctctctctttttttggcagacttttgtctgtaattccttactctgtgttacacctgtaaatgcactgggagtctctttctcactccgatggaaagtggacctctctttttttcagaaagcaggaggtggtgggtgtcatctgcttatttcacatccatgctcagatagtctcagtggttccctactacttttggatatggtttgaataaatactaaccctcaccctggcactcagtgttctgttgaatggcccagcctactgtagcagccaaagatgttagttctctacccatccccgttttcttgcaaacagggctccccacttctttcactcccaccagccaacccctgccaatcattgtaggaggggagccttcgggctgctagagagggcttggtttgcaggccagaaaagccaacatagcctgggtatttaagtctcctgggggtgagcagagccttgatcaatgactggtggattaaggaacgtcaatactcccacgttcttgcctctgattggaacagctctgaagtgtgatctgtcacatctccagagtacccctatgggacttaacaacagttactctccatggaactttgcctgaaatcacatccttaagcctccttcacttttggtcccccttccccagtacccttcctaataaaatactataacttaaataagtgccttagcatcttctgggaaaccctgagttgacaccttattttcatcctccttgctactacctccctgtacacactcccctgatcacatttgacttcctgtcagtccctaaacatattctacacaacccccatcatattttactcatactgctttctcaacctggactaaccttcccaatccatcttcatctgtcatcatgtctcccatcctttaaggaccaggtaagagccacctctttatcccaatctggattaatctttctcttcccatagtagtttctttttacttgtgttggaataactgtcaccatttatcttacattgaactttctgtatagtagaaaccctcttgccccagaaattacaaccagtagtaggtcagttaatagacaaagtcacagaaatcacccacatacaaacacacacaatatatttcttttatttttaattattttgaattgacacataaaaattgtatatatttatcatgtaaaatatggtttctaaatatgtatatattatggaatggctacatcaatctagttaacatatatattacttcacataacatacttttttgtggtcagaacacataaaatttactctcagcaattttcaagaatacaaaacattgttattattaataactatggtcaccatgttataaaatagattcctcaaatttattcctcttatctagctgacattttattttgttaggccagcatctacccagttctccccacccccagcccctgataaccaccactctactctctgcttctattaattcaactattttagattccactattttagatttatatctattttagatataagtgaggtcatgcagtgttcatctttctgtgcctggcttattttaattaacataatatcctccagatttatccatgttgttgcaaatgcaaatgacaagattttattttttaaggctgaatagtattccattgtgtatatataccatattttctttatcacttcatccattgatggacaattaggttgtttctatatgttggctattgtgaatcacgctgcaatgagcatgggagtgtagagatctctttaagatacttatttcaggccgggcgcggtggctcacgcctgtaatcccagcactttgggaggccgaggcgggcggatcacgaggtcaggagatcgagaccatcctgggtaacacagtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaagatacttatttcaattcctttggctatatatcttgtagtgggattgctaggtcataaatatggtagttctataacacttactatatttagtctttttgatattagccattctaacaggtatgaggtaatagctcattgcaattttaatttgcatttccctggtgattagcgatgttgagcattttgtcacacacttttggccatttgtatgtcttcttttgagagatgtctgttaagatcctttccccattatttaattggattatttgttttcttactattgaattgcttgagttcctcatgtatcttcgatattaaatgatttaacttaaactatatcagatgtatgatttgcaactattttctctcattctgcagattgtctcttcactctgtcgattgttttctttgctctgcagaagttcagtttgaggcagtcctatttgcctatttttgcttttgtttcctgtgcttttagggtcatattcaaaaaaaaatttcccagacctatgttgtggagcttttcccctatgtttttcctagtcgttttacagtttcaggtctcatgcttaagtctttaatccactttgagttgatttttgtatatggtgtgagacaagggtccaatttcattcttctgcatgtggatattcagttgtcccaatactgtttattaaagagactgtcctttccccattgtgtatttttggcacttttgttgaaaatcaattgaccataaatttatttctggactctctattatgttccattggtgttatgtatctgttcttatgccagtaccatgctgttttgattactatagtttcccaatgcatttcttaaacatttatttttaacttaaaccaaataaatgtacgttcatttgcaagtcttctgatatagaggcaattaattttgtttgaatttcgttcagtaagtaaaattctgccatatattccttgcataaattctcctcctaatgcatcatcatcagaagattctaatttgagcttttctcaaatgaaacaagaacataagaatactttcaaagtaaacaaaatgcaaattcttctaaaaaatgtatgattttttctaacctttgatagattcaagcccacatataatccaatagcaactttgttttcaaatctttagttcttctattcaactgaattgttatagtagcagctgtctttttgcactcatcaatttatgtgactttaaactatataattaaaatcacaaatatgcctggcctaaagagcttaggggactaactaatgcagctgactctcagtgtgcatacaattgaactgatgggagcagatgcatgttctttgcagaaaggattctgctattcacgagggatgaagaacactaattaaactgatgagtcagcagttaactaagtgtgaattaatagatcctgctactgcaaatatgtctactagatagactgaaaactcattgaaagcagggtctgtcttttgtgtccccacagcacttagcaaaatgccttataaaaatgtaagcattccatatgtgttggtagagttgaattgaatatgattggattctgctaactttttctgagtaatagtgggttggataatgacaatggtggtatgccaggagagggtgttgcctaggaatttcctggcaaaatataagtatcaaaaataccctaagacattagacatgtgcaggctgcaatatgactcccctgctttaattttttatatgtgattataatgctacaagcttcatcattattgtgttttcctttcataagacttgaagtctatatttatacggggtctacagtatattttaagctaaaaaccaatggaacattggtaagtcccaataatgcatgtttttgatctctggtagcacactatatattagtatgtgattcctacacatataactttttcctactggcgtattttcatacccgaagatctcactcaaaaagcaaacacagcctgctctggttaactattgctgtatgccaaactaccttaaaccttcggggcttacagcaagaatttattctctctcatgattctgtgggtcgactagactcatctaggtagttctcacttagggtttctggcgccactgcagccagatggttgactgaggctgatgtcatctgaaagctcaactgcattgattgttcgagttggctcacttccatgtcttacacatgatgttgactgctggctagaaactcagctaggcctgccagctggagcacctacatgcggcttctctctgtggctttagcctctcttagtacgagttcccagaggaagcattcggaaatatccattccaagaaagaaaagtagaagctgtcaatcttaagacctggaccccaaaactggcacattgtcacttctgccatattctataatactagtcaaagcaatcacagagcccacacagacccaaagagaggtcacaaataccccatctctcattgatgacggtaccaaaaaagtggtaaccatctttaatctgtcataacatccattataattttctacttatgatagtcacctaaactaaaatttactgagattgtcaaaacaaaaagaagagtccagttacaaggaacctgatctaaaataatcagattaaatattagatggatagtctattttaccatataatctcatttttgccccgggtaagaaggttgaataaaatatttcaagcatttttcccacccttactagtaagttttactaccaccagcaggaaagaaaagggaaagtcaggcaaggattccttttctttgtaacagtctcagtatttttaatttttttttactgtttatttgcttatttatgccaagtcttgaacagtctctggcttggctatgaatgagctaggtttcgggactctcattctgccctctctgagagagcagttctctgcttttgactcagaagtcagatccctaaaggaaaagcctgacaaagtatactgcctttcctgctctacctgtgaaagaactcaaagttcagttgactcaatggcaagtgggagacctatagaatagaggttctgggtgcacgtgcacattgactttctttaatttaaactttatattttgagatgattataaatctacatgcagttacaagaaataatatgaagagatcctatgtacccaatacttgattttccccaatggtaacctatagcaaagatgtactataatatcaaaccaggttttgcttatttttttagaggcagggcctcactctgtcatccaggctggagtactgtggcacaatcatagctcattataatctcaaatttctgggctcaagctatcctcccacctcagcctcccaagtagctgggactacaggtgcatgccaccatgcccagctaatatatatatatatatatatgtacgcatatacatatatatatatatatatatgtacgcatatacatatatatgttgagagatagggtctcactgtgttgcccaggctggtctcaaactcctgggctcaagcaatcctcccacctaggcctcccaaaatgctgggattacaggcatgagccactacacccagccacaaccaagatattgccattgatatgattcaccaattttattcagaattcccagtttggtactcatttgtgtgtgtgtgtgtgcacatgtgtgtgtatatttcatcctatgcaattttatcacctttataggtttgtgtatctactaccacagtcaaggtacagaacagttctaataccacatgtccctcaggttgaccttttataaccacatctaactccctcccactactcacatccctaacttctagcaaccactaatctgttctccatctctataattttgtcatttcaagaatgttacataaatgaaatcataaagtatatgtcattttaagactggcttttttcactcagtataattctctagagattcaacttgttgcatttatcaatagtctattccatttttattaatggatagtattccatcgtatgaatgtaccacagtttgtttaaccattcacctgttgaaggaaatccatgtggtttccagtttttactattacaaataaagctgatacaaatattcctatacaagttttgtgtggatataatgttttcatttctctgggataaatgaccaagagtgcaatttctggttggatggtagttgcatgtttagtcttacaaacagtcttacaaactgttttccagagtgactccaccattctacattcccaccaacaatgtttgagtgaaccactttctccatgttgaattttgattatatgaattaccaacattgcttttaacagttgatggctggcagccccatgtgaatcaagcattattgcctacttttccattcttgatcacttgggaaagacttaaaagacatcaaagatgacagggagaagtaatttctggaggtattttcagtggcatttttattcctgcttcttcatatcccaaactatatatgtaaactcagtgataggtccagtcatcaatgcatcacaggtgctcaatatctattgactggccaaatataagttatatgtcttctttcaaatttcttttacttaaatgttaaaagttatatgcaaatgccttcatagagttttccagcctttgttttctcttacctcagtcatctcttaaaccagtgagagcgaacagagttgaaatgagaatggattgtcacatttatgccactaagtaaatattgcacattcaaatgtggactacaatactaagccaatcatccatactctttcaacttacttgtttctccttggccaggtggagtttgctcctgatattggccttcaatacaaaggagagctgacagttgttttacgttacattcccccagaagagaacctgatgcttccaccagaacaactccaaggtagagtaaaaatcaatgactttgatcaatgacattctgtttctagaagtgtggtagtgggactcagggattggttgcattatatttctttcatattacacaaacaaaacataaagggtttggtgtcactgtcttttggggagagttgagatgtgtataccgtatatatagaagaatgcaggactcttacaaggaatccttgtaagattcatacttagaaaccagccttggtggtcagttttgttttatgtcccaaagatataggatcttcccccagggttgggggaaggcaggctgctggaggcaagtataggaaactgctccatggatttatgacattcacagctattcagggagtcttgaggaagaagttgatctagaacacaggatttaaaggaaaaaatcagatggaatcaatttataaatctctcttcccctttgtattaagctgtttttgcattgctataagaaataccaagactaggtaatgtataaagaaaagaggtttaatttgctcatggttctgcaggctatgtaggaagcataaaacaggcatctgtgtctgaggaggcctcaggaagcttacaattatggcagaaggtgaaggtggagcaggtgtctcacatgacaggagcaggaacaagagaaagagagaaggtgccacatacttttaaacaaccagctctcacaggaattcactcactatcatgaggacagcaccaaggggacggtgcaaaaccactcatgagaaatccaccccatgatccaatcacctcgcaccaggccccacctccaatagtggggattacatttcaacatgggatttgggtgaggataacatccaaactatcttgcccttcttttaccatcaattcttgcaggcagcctcctctgtcctcccattcactattactcttttcagtgtgaccctgtgcaagtaactcactatcacctgacctcaatttcctcacttcaaagggctgttgtgaagaataaacaggttcatatatgtaaggtgcttaaaacaatactaaataaaggtgctggttgtgatactggtttatatcattcatgttgaatgtatttcataagaaaagaaaagtgaggtggaaaagagatttctctcaccctaaaacgtaactgtgtttgggctgtagcctctagagctggctctgactaaaactgactatttgtaagactaaaatatcaaagggagttattgaattttctctttttgagttttggtgcatgtatattgtcttcatcatagttatttctcactaagagcaggaatggtgctccgggaaactcttaggcattccatgcctttataccctgtgaaaagatatgctttgtaagggagtgtttaaagttttaaatttatttcttcatttgtttcaacaaatacaaatgaaagacctatctggaaggaatccaatgggggcaaaaatgtttaaatgaataaaaatatacaataatgtaaaggcccaaattagtcagcaaatgaaatatatgtttgtagatgatctttgtaaattttgaaatggaactcatgatttatctatttttttttctctttctccaccattccctcattttggtggctgacacaggaaataagacttttaaaaagggaaagaagaaggagtcacctgtaatctctggaggaatactagaagtgttcatcaaagaggcaaagaatttgacagcagtgaagtcaggaggcacttctgatagctttgtgaaggggtaactttgttttagctctttttggatgatacttaataggagatgaaaggatctgtgatccacaagccactggtggctgtgagccttccgtgttctgtttactagaagtgtatgggtgagaactacccttacatgctggctcttacatctaaaataacacaagtgttgagggaactgctgattctagctgtcactctgtttccaacatatttcaggaattcccatcactcttactctcaagacagtcaacttttttctgtaagattcatttatcgaaagtggacaaaagtatgatttcctatgtataatgtatttatattgttctttattatcattttgtcctggcaatatgcaacaatcaccaaaatatcagatccttgatatttttctctcttgggggaaattgtaaaaagtagagatgtcagagcatccttgctggacttattcactgtcgagtgctttggagaggctccaagaccacctgctaggcatttgtgcccaagttgtggagcaaagggcagcttcctgagggaatgcagccttaaaatggatacttttgcctaactctaggcaactcaaacatcaaatcccttttgattcctgactactggatatttttctcttggaaattgagaaactaagactgcaaggttatttttcagtcattcaaacaaacacaaaatgcacatgtgccaagcaccaggtgctatgctttcaaaaataaataacatattatccctgccctcatggaactccgtaaagcacataaggtaaaacaaattcccatgatgccagaccatgaggttcattctttgagtcggatggcaatattgttcctcttcacatgctgtattggaaaagagtattttttcctacaaggaaatgggttgagctcactctcacatgttatttgttgttgttgtttgtttttgtttttgttttgagacagagtttcactctgttgcccaggctggagtgcagtggtgccatctcggctcactgcaacctccgcttcccaggttcaagtgattctcatatctcagtctcctgagtagctgggattacaggtatttttatttttatttttatttttagtagagacagggtttcaccacattggccaggctggtcttgaactcctgacctcaagtgatctgcctgcctcggcctcccaaagtgctgggattacaggcatgagccaccgtgcctggccacatgttctaactttggtaaagctagtagtggggagaagcagttctggggcctccccattggtgagtgtgtatgcctgaatcctggcacatcttcccttcactcttccttgcagtagatttaagcatagaagaaatgctttctttggatactgcagttacaatttgtgtcattagccctaccatccagtttaagcttctgctgctggaatgaggagatgactcccaacccgtggccacattgtgaccttgcaacggtacttgacatcttctggagcagtattcactttatcttgtggaaaatgtataaagcagaaataataaaagacagtatttttgttctagaaagaaaaacaaaagccaataactttccggtaaattctgtctataataatacttaaatattaggctgattctaaaaagacatgagatttttttaaaagacagtgagggagcaagaatagaccctctgtaaagtttaataatataaaatatatccattaacattaggtcggtctgtgagccaaaagaacagtggcttaaacaagacaagttttttttctctcttacatgtaaacaaagactgaaggtaaggtccccagtgcaggtatggaagcatcatgattatcagggacccaggatttttccatctcgttatggtatccacctaatgggttaggatagctgctcctgtttcagctatcccacacaaattccagctgacaggacactttccagatgtaagaagtagttttatcagcactacttcttatatcccattggccagaactcagtcacatggctattccagctgcaagggaggttgggaaatgtagtctttattctgggcaacactgtgctcaaataaaaacacagttttttagaggaatataaggagagaatggatattaggagataataagcagtctttgcttggtacatgaaattaaatcttaagtgacttaatgtatcttctttattgtaaagtcatttgcttgtagcacttttcgtttttgttccatgtactaattccatatgtacatatgtcttcttttctaaagtatgctccctgaagggggaaaacagccatttttatcacatacctagagcctcatacagtgttttgaccatagtcgagaaaacctaggatacaggcgttttatttgaagacaaatttcaggaaacaccagtgaggaagtggagaaaatgaaacaaggaagaaagagaagttgattaaaacatatgttaatgggcaggttaccactgtgggcaactggagcatgattccactagggaagcagtgaggaactctgtggaatataccttaggattgtcactttgagggacagggaagatggggaaattatccaccaatttctcaaactcatcagttaaaagttgccccaggggtattaaattccaagtaatcccagagtttcctacacataagctgagccagctaacacaatatcagataaattccttaattagaggaatttattccttgtatcaagagacacaagcacttgaggtgggaagctgaaagtatatcaggaacttcccatcctggctgcaagtcagctccaaggaggccaaaaagatttgaagcaaggcattcaatagtgtctattacaggaggtattttcttttcaagatggaaggaaggacctaaataagattagaaaggagagtgagggcattttactaatgtcccactgggaagaaataataagtcagttcactatataaatccagatttaagcatatagaagcctgggaaggaaaatcaaatagacacatcacacttgtgtacacgctgacattttctgtctgctgtcttattgatgatttgattgttttttctcatgcagctacctgctccctgatgatagcaaagccaccaagcacaaaactctggtaataaaaaagagtgttaaccctcagtggaatcatacattcatgttcagtggcatccatccccaggatataaagaatgtttgcctagaacttactatctgggacaaggaggccttttccagcaacatctttctgggaggagttcgtttgaattctggaagtggtgagggatttggggacccacagggatggtctgtgactaggcccaggtgggggcgctattcttgcagatgtgatgtgcagtggatgtatatatatagtttcagctaaatcctgaaattaccacaaatacttcattcctttagctaaggatctattcattgttaaaatacaaatataactacagtaactttgtatccttaggctagaagattggaagatatcatatttatattcaatcctttcatagactagcatttacaccttagtctaagtgaattgtaagtactttcttgggccttgcttcatattttgctcaggggatgattaccaagacagcataggcttctgatgggaggagagcgactttcaagaccaacattacttcatcatcttctcagttctgtccagcacttgcagctattattcatactggttgaattgaaaggaaatcattttttcataaaaataacaccagtattgttaaaaacagatcaaggaaacccaccactggtgccacaagacgcaactgtaacagggtgaattggaagagggattacagtagtagagcacgtgcattcccctaactctcattatcccatagcctaagccagacatagatgagaccatcagcatacaccatggtaaacatttctgttgaggaaggtcctatcactatgataattacttatttatagattaaggggagccaaaaatatctataccactaaaaggaaaactccccaggtcagaaaagtgcccttgttagaaaaagagagccaaattcatcccattcttctgtcatgttagcacagtccagatgaaccagctctctgctaaagtagggaggaagtgagtcaccagggccaccccgatttgcctcatatggcctaggcattagagaatagtgcaggctgaaatgattgattgattcaattctaacaccactcactatatatactaagtgagaacaagccagtaaaaggtactctggtgaaaaggcctgctcagaagttgatagataccttgcaggagagcaaagcatttcatgtgtgacataaaattttcccgtttcgcctcttcaggtgtgagccatgggaagaacgtggattggatggactctcagggggaagagcagcgcctttggcagaagatggccaacaaccctggaactccctttgagggtgtactcatgcttcgttccagcatgggaaaatgtaggctctaaagggaccagttctccaagaatgaggccaccaggacctatctggctgtcttttcctaccattagcaaactgagacctgggattctgcttccctgccatttctcacctgacagtgttgggacatgaggggagagatgtcagtagtatgaacatttagggtcttgctgagtgcctaaaaaacatatatttccatccaatcaaggccttcttgattggatgatagaaagtgtactacttgtcctgtcaacaagcaaattgtgcaaaggcttatagggtttatgccataaaagaaatggcacaagcctccatttgctaattataagttactttagatttcctcaaatcctttgaagagaaagaggaccactgagaaggtagatcacttgaaaagtcagaagaaaggatactggccaacttttactcaccctaggaatccacatgatctcaagaaggcatggtggagatggttgcttgagcaaggggattgtcctgttattgcagcaaacttgtggattaaccaagtagtatttcaagatggattgacagggctttctatgattactatagaatttatcatctaaatcagtttactttttagaacaaagagagctaaataactacatcagaacgattgatgttgattagaattgacctgggaaaattgggatgtagggtcaccctactgatgacctaagagagctctgttttaaacatttattttataaaatgttctaagccattaactaaaaggaaatgagatataatggtcaattgatataccttttcacattgtgttcactgacgagactagtttaatgaaaaaggaggtactctacctgctattttacttctgttcctcttctgccctgttatgggagagaatcaaagactccatctgctctcttcccccttgttttctccttcactgagtttttcttatctccttttgcagtggttaactattgtcacaataatgctgaatgaaaaaacacaccaaatgtcagtggcttaaaatgaccatcctttttctcacagttatgaagattggctatggcacctctgcttcctgctataggcctgaggttctagggcttcttatgcctcatcctctttaagccaaagggatagccagagcatcttgatggcagaagtgcaataagatgagccccactgctcgggtacattttcagcccctggttgtgtcatgtctactgatatctcattggtcaaaggaagtcagagggccaagatgaagaggcagggaaatatgcactgcccacagtgaagccatgacaagagtgaggatgcaggaaggcatgaagaattggggccaacagttcaatctaccataccttctctcacctggaattccagatgcttgagctacgaaacttagatgcaaagaaagttaaagctagaaggaacctcaggcccagttgctcattttgcagattccaaatgtgaatttcagagagctgagataacttgcccaaggccatatagaggctgtgactaaatctggacttaaatccagactatcaatcttaggccagtgttcttttttcaatatagtccttggcataatgctatgcttattaggtagataaaagggcttatgtcaagaaatttggagcagagtctgattacttgagcatgaacatacccgaccaaggtatgttctggagtcatattctagcctctgagctcattttttcatgcgagttcatataaaatcctcgaaagtttagaaactaggttttagtagtaacggagctagaatcatcttcgggcttattcctgctagttgttccatatttctagatttcatcttgaattttgaaaactgatttaagaatatatttagtattattattagtaagggaatacgcaatccagtttcaattttattcagaagtaggtcacctaattctagaaaatggttattagtctagtgtcgcttagcaaggtacttaaaagaaaatctgcacatatccttgtgctgcccttcttaaaaacagaaaacaaaaagtgtaagatcatcattgcttcccacataggaaaaataaaatgtcttcagacttgatgtgactca

SEQ ID NO: 1450 - DNA, 122239 bp, Homo sapiens
cacaagggtcaagtagtccagcattctacagtttgtgtgtttgagagaaaaataagcccataaaaacattctaaccttcagattaaggtaagactaatgcgtttagggatctccagtgtgatatctgatttcttaatttctgtattttgtgtgtggtaggggagtagtgggatttgctggtcaggaagaaaacagctccttccaccatttgatattgtattttacagtaaaaaagggagaaatatgtacagaagggacattttggccattggtagctatgagtttaatggattgaggagagaaatataagtatctttttgttattaacacttgattctatctatgaagtgaagcattgcactaggttctactgaagagtgagtgcctccaggaacaaatatgcattctagtgacataaaaaaatcaaattcacagcagaagtgttgcatcattttgctataaatctctcacacctctctatataaacctctcacatctctatataacatagattgtccttttgctctgaatttctttcatttattagaaaatttagatgtttcatttggaattatttaattgtttttacattcagttccatttttgatatggacaaatatccagtatggatataaattcagtagaaggattaataaagtctgaaaaacctggaataatttcaacatgaatatgatactgtaacagcttacagaaatgcgatattaactgtgaacattaatatactctgaaaagatgcatcagggtttaaaaaatttctccttaatgtagattgttttaattaccaatactgtcttcctcatttaaatgaaaaacgtaattttacaactattaatatataacttctctttgctccaagtatatgtgtatgcctggagaaaagcatatgcctggagaaaacaggagttatatatttatagcattcaaaatagtataaaatattgtttacatgtaataatgcatttagaagtactacttcagtagtagcctccttaaaaagtattttaaacacaggaattaagtatataattttttcattttgtaataagttgtttatatgttatttggacaacagcttacacacaaaagtgttacaattcataccctaggtcttaaatgcatgaagccatttgtttggactctagtgaaatccttaaattggtccttgcatccctcagtatatatatgtacatacccacatatacatgcatatttacatgtgggcaactaataactgagaaaatgtcttactgctcttttagttgttgaatcatgctttttctatgtatttatgatttcctgaaattctttgctattttaagtttgggtattagctatgttatccttctatttattcagatttgttaaagtcttctgataggtttagtgaataaaattattgagcttctacctcttttcttttggaggcccatttagtatttttgttgaaattacttccttattattatttagtatgttaagggaaggaaaaggaaatgtagctttaatatgtaaaatgagcagttcgttttacttaagctctattatatgatgatgtatcttatgactattttgccatcctgcgtaagcacttagctaatcatctttaatacattctacttaaaatctacttgtaaatatgcttttgtacattcatatcttacttgtctgtggtctctcatcctctttctctctcacccctctatatacattcacacattttccatgatttcacaaaacttctctccaacctcgttccattcctggttatctctttctgtggggagtatcatcatttcctttgacctctgtttctctacatcttccatcttgcttagcccatggacttttgattttactgaagacagcaaaaaagcagatggtgcttctgttacttgcagagttagcaaccgctgtggttaccttaggttctgaaagattatctaaaatagggaggagctcctagaggaacaaaatataataaacatgtagtgtactgggataaaaaattcacttgatctggtctctctctccttttaacaaaaacatttctctaagaagtgattaataaaacataccctactgcctcactttctcttttaaaatctttctttcaaattcccctatgacataaaatcaatcttcatcactttattgacactgtacttccaagggtcacctgtagtgctgctaggaaattcaagtacattcatttatttatgtattcattcatccattcaataaatatttatttagtgacagctatgcatcaggcattgctgagcactgaagttacagtagggaacacttaagtctgcctttatatatctccagtctagttaggaagggtgttaactcacccaaataattcattacaagtgtgataagggctataaggaatacttttccaaattctcattttattcatccccttggctctatgtgacacacatgatcaattcctacttcttaaattttctctttccttcttgtccatgactctatactatttattcaactgcttttctaccacttcccttcttgtctatttttccttttctcttccttaagtttgggtttccctcaaaggtttagcatttatttagcctataacctattacgttttgcctttctctataacttcttatcaacccttagttttaaatatcacctctaagtggatacctccaagacttccatttccacatcttatcttttccatctgctatacattttcccacttgtatgtccaagggtcactcgacattcatcatgattgtagccaaactcacagcttttatgtcaaaccacttcccctttcatttcatttgtttctgtgaatggcattaatgatctcttggtttctcacatttgaaatcttggagtcaattttgcttctaacttttcctttgctctcaatatccaaaccactaccaagtccattcatttctttaattataatgtatctagaagccatcctctctcatctcccttttctgttatttttttcttttattctctattttctcatccttttttccctcagtctaagagctacctacaattcaaggttttggtcaggccccatctccatcagaaagtccacacctcatggatatcttctttttctaagccccagaatcattggggtagtgaaaagaacatagccaaagagccaggtttaagttttgattctaccattcactgccccctgtgcactctctgtgaaccacagtttcctcagactcattctatctcatatagtggccacaggaacaaatatagtcatggagaggaaatcattttgaactatgaagaactatatagatattaaagtaagatttgttgctggaagaataactcagtagcagagaccaaaaccccaggtcttaactattgaaatcatattgtgcaggggttgagagtgttgactctgcagtcagatgacctgagtttgaatctcagctctgctacttaccagctgcatgaaattgagaaaacttagttagctttcctgttgctgagtttcctcactgtcaattggggataacaatagtttctactgataagagtgttgtaggattagaacgtttagtaaatgtaaaatacttaaaatagtgcctagctcatagtaagtgctctgcaaatgtggaagaggtggtaggggcctatgaggctaagtgtggttacgaggtgaaagccaggtattagaactgagccaccagatggggattaggtacagcaaggatgcaagcacagagctacagactggacacatgtacctagatgaatccctcatgattcagataaaaaaaagaatgatcttgccatttggggcagaactgagcaaatgatggaggtatgaacgttctgagcgaccattcggggcacaaaaatggggataacagtctttcagacacattttctttttgttaaagaagaacaaatgttagattgcccttttgtgttgtgaaatatgtcagtatatcatggaatcaaaatgtcagtatccaaataaatgtccaaatgttgagaaagctgactcaactgtcctctatattctagaaatccgtctctttaacagtcatatgcttattgcatttcagaggacaagggcccttagaaatgtcattcctcacaatttataggattattgcccaaagtgtgtatttttactaatacacttggagattagtttgtttgattgtttcatgtcagaaagaaaaataataataatacttagaatattctaagggttgttctaagtgccttaaattttttaactcatttaatcttcacaagaacctcatgagatgaacatcatcatcatcaacatcatcgccactaccatttacataagaataaactgaggatcatagaggttaattggtaattggaccagatttcaaatccaagcagcccagcaccagaggcaattttctcaagcactgagtgctatcatatcagcaactctgtgttttagaatctggttaaaagggcatgctctggagtcctagactgctgttacatgttgcatctccagttttccttgacaagtggtaataaatgtttgatatttttcataattgataaaaattacttacataagatttatactaagtaatccaatgtccagtaatgctgtgcaagaagagtctggtttttctcatccattattctgtatttgagcatcaaacaaaggcctcaaatactgatgctctctgtttcctagagagtatgttatactgctggccgggcgcggtggctcacgcctgtaatcccagcactttgggaggccgaggcgggtggatcacgaggtcaggagatcgagaccatcctggctaacatggtgaaaccccgtctctactaaaaaaaatacaaaaaattagccgggcgcggtggctgccgcctatagtctcagctactcgggagactgaggcaggagaatggcgtgaacccaggaggcggagtttgcagtgagccaagatcgcgccactgcactccagcctgggcaaaagagcgagactccgtctcaaaaaaaaaaaaaagagagtatattatattgttttgccctgtacttaactgatgttgtacccgtgtacttaactgctgctgctgcccgtggggatattttctagggtatctgtgagtttccatctttgtctttgctaactatttcaaaagttcaggctcaatttttggagttgctatgtttgttttctatttcctattttaactacttcttgttcatttaaatgttctctcaccgtagtttagtgggattttttttttttacttttctctaagcgttagctacaaaaataacttaataggcttttagttcattttcttcttcactgaataagaatattaaaatcaaatttaccttcaccgaacacttaataacttttttcatttccaagaaggcccagtgccatttgtaactcttgttaaagtttaatttagcagtttccaatttttgtaacagtcgacttatccaggctaatttgatttaatatttctaacagaatgccaggaaacactctgttcctacaataagaacatgtctgattcatttaaatgaataagaacacgtctggttcatgtaaatagacttcagcggcatttttgttttggtgttgtgcagtcaaaaaatatttccgagagaatatcaggacttggaaagaaaccaagaaaatgaatacaaaacaactctaagatacatatcattctaaagcaagtaaaatcctcaagaccaaataatataatttaaacaaccatttaacattgataatgtttactaagaatggaagtggtagactttaccagaaaatatagttgagttggggtgggacgtgggggtgtgcaatagagaaaccaaacttggaaagaagccatcagataatgatgttccaggttcaaatataaactttaaatccaaatatacttttatctggattataaaaacgaaagttcagcaacagcccactttgtaaacacagaacaagagtgatcatatcaaacaggtttacttaatacaaatagcagagtatagacaaatccattaatatatccccctaagagctatttatgtacaacaatagtcttctctccctggtgtgaagttacattaaaatcagtatatgattaaaatttttgaaattgatttcattaaatcaagtgacattatatcaaagatcagttttcaaacaaagcagtaagagcctattgcaaaataggcatttttcccaactttcaacagataatggtatatccaaagatgtctgtggccacaaacaaatgtataatttttaagttgcatattttgactagaactagatatgtactaaaaaaccattttgtgatgaagaatcacttcccactaattgagagaccagcacagggagaatactattgatcttaaatacaaggaagtccagacattaatatggaaaaaatatagattgggatgtcctgtttgcattagccatgttcaagaaggaagaatttaatttgctttgaactactcacagctgccatctaattatttttgttgactgttacagagtttgagctccaaacacaggaaggttatttctaaatcagttatacacaacaaccaaacagctattgattttctttcaagtgaattcccatctgactcttattgttcttgtgaataatagtcatatgtatggctttatacttaagcacaataggatataactaaatattggctcaactcagacctaaagagtaggttcctgaacagtgagaatatcatctagtgataatctttcactgcttatactgggaaaaatgttgaacctgggtcagcaaacatgaaatgtaggttcagtactgctcctaatgataatgccaaaggctcacactttctgaggatttaccgtgactcaagaactattcaagtgttttctatgtaaccaaggcatacagaggttcagtcatgtttctcagaaattttagagccaagatttaaaccagagttcctgctttgtaccagagtcactttggtcagcttaagtaacttccaaaggcatcttcctggggtattttttcctgctgcaccaatttttacctttcttcctgattctcaggctcactcaatctatactggtatctgcgaacctgtcactgacctcaccccatctccagcatctcactgattggtttcctctccatgatcttttcttaaggggaccctgcattctttgggcccctcatcattactcaaggcccctagatctactggccccctcagtcctcctagtccctcaaccaccaccaactcctcctctcctagcttagctcccccattcctgctcacaggagccaggtagcatcaggacctccccaatctcattttcctctctaccctctccacactctgactactgtttcagcttttatttctttctttagtcagggcaatctgctctgatgtcatatcctacatcctctctacactgtcataataaaactcttttggtatgtacaagtgtgtaccctccaaagcaggagtgctgggcactggtataaatttgaccaatacaaaattaaacacacacacacacctgtgtgttatgttgtatattatgttatatataatattgttgtgtgtgtacatatatgttatatgtatgtatatttaattctacagtatattatagtggtcaagagcacagtcaatagagtcagaccccttagtcagaatccagcttcaccacttacaagctgtgtaacactggacaagttacttaacctccctctgccttggttttcctacctgtaatatgggaatagtgaaagtatctaaatcaaataattgatattgtaaaccaaaaggtatctgagacaggtctcaatcaatttacaaagtttattttgccaagattatggatgtgccagtgatacagcctcaggaggtcctgacgacatgtgcccaaggtgattgggacacagcttggttttatacattttagggagccgtgagacatcaatcagtataggtaagatgaacattggttcagtcaagaaaggcgggacaactctaagcagggagggggcttccaggtcacaggtagataggagacaaatggttgcattcttttgatattttgataagcacaatttacaggaatagtcacttatgccttagtctggcttagtgaaaaaacagggcaaaggaagcaatcagatacacatttgtcttctgtgacagagggatgactttgagttctccctgtcctttgtccacaagaaatttccctgtgagaaaaattgtgagggaggtatgtagcttttttatctttgtaggtatcttatttaggaatagaatgggaggcaggtttgcccaatgcagttcccagcttgacttttcccttcggcttagtgattttggggtccagagatttattttcctttcacaatgtaaagattgtactgttcatatatgtaaatcaagaattcataacagggcctgaaacttgtatataagtgctgagtgttcactatcattattaccatgactcataaggaaaaagcattaaggcaagtataataatggagcaggaaatatacatttaagtggaaaatatagtacaacatggataatatgacatgtgtgattaattacgacttgaataatgcgaagcatgtaattatttttggctttgcatttgatatctgaggaatcccaccatttcacatgaaaaagtgcatgtgacaaggaatcttccaggaattttgcattagaagttccttttgatcctcctcaaaaccctgtgaagttagtactattattatctccaccctgtatgaaaagaaaccaaggttcagagaggttaagtaacttagtttctgtaacatagtaattgccaaagctaggatttgaatgcagagcttcctgactccaaaacctgactctttgcaattctccacttgaggtgtccattggaaccccataggacgttaaaaaaaatccatggaacacaaactcaagagattctgtttttttgaaaagcagcttttgtgagatataatgtacatactgtacaattcacccatttgaagtgtacaattcaatgtttttttttttttagtctattcacagtgcgtttagccatcaccacaatctaatttcagaacactttcgctctgggcgggcatgtccacagaatccctggggtcttaatttcaaagccacagaccttgtaggagtcttgaatgaacttcaaatgatttgtgaactttttctaggatccacagctttcactatcttctctaaagtgataaaaatataagccaaaaatgtattaagaaactctagaccagaatggccttgaactttaaggtacaaatcactgggggaccttgttaaaatttagattcaaattcagtagctctggaatgcgctaggcctactatcattaattttaatgataggaatgctcactttaagttagatgttatgtgccctaaaattccattcttctctttagtagatctatgctatgaaataactgcactcaattattattgttatatttttaatgtcatcggtaaaatattggcagacatttattttcttgattgatgcatacttatccacaaaatagctatggttttggctcttggcgcaaaaagtctaaaatatttactaattgttccttaatagaaaaagtttgccaacctctaatatagaccatgggggaaagccacctttaaggagcagaaatgttgttcatcttactctccacagctccttgctacatgtggcagacatgacattatcaatcagacttataggaatcctaaccaagtatgaggggcagcaagctggctatatttatgtataactcctcctctagaggagaaatctgggcagatgagggtcaacttcacttttagtttaaaaatacatctccctagagcttcaagctgctctcctgggtgatagcatgggtgggtgtccacaaaagaccttcatgcattttcagttaggtcatgtctctatgatcttggaagcaagattccctaagagtagtctgcaatccatatagagagcttggttaattgggtttggatgatggttcaccaaacgtacaggtagaatattttatcttcttacactcaccttcaagctacttacattaaggtgtttgttcagaacattgaactttcaagagctgtctgaccatgcatttcatatgtatgaaggcatttctgcttattttccaacactaactcactttgaatgctgcaaaaatgatctatgctatgttaatgcctgaatatgcatgacttcaaaattctccaggcttcaggtggtctcctgcaccataagcctctactgcagagcatcctcttagacatccatcttgaactattttttccttatgtcttagtctatgactttagatctcctaactaatggttgatttttcagccaattttgttgttgttgttgttgttgttttttgatgcgagaggttgcccattctcaaaacccacttccttcttccaaccaatgcccattgctacaaggcccgcaactgtgttcagctttcagcatgctccaggggaacaagtacaaagtctgacctggatggaattagattatgcaccaaaataattccaggatttactaatttatatcattagaaacctagaatgttaggccaaggaagatgtaatataacactggattaggccaaatgtattgatatggtgcatttttcagagattctggatttagtgtgatacttcttgcagctggaggtgttgttaacagtttacttgattgtttagttgaaatgtgaacttagcaatgacctacatcattgactctgtgtgatatacttgactcccagttcattagacttaactaactgctcctcccattctgttgatcatccctcttcagtctctttcatcatctcatttattcctcttgtccctggaccaaaccgaagatcaggctgcttattctcatggcccgataacgagattcagataagctgggaaagaaggaagtttatttctgtaaccggctatggctgaaaaatatctccagaccaactcaaaattacaaagttttttgactttgtaattttgagttggtctggagatatttttgacaaagagcttatataccttctaagctatatgtctacatgtaagtgtgcattcatctaaagacataagtgatttacttcttctattctataactaagatctgactcctaaagaccttcctctggagcctcagtaaatttacttaatctaaatgggtccaggtgccggcggtgattacccttatcttgtctcctgctaaatcatggaggtctggggagttccttcagacccccaataaacttgtttgtggaggtctggggcgtttcttcagacccccagtaaagtttgttttatcctaaatgggtcctgttaagaattccttcattatcttgccatacttcaaggcccaggaaaggcctgggcaaaactcttggtgggcttttgttaccttccagcctttgtataagggcactggctctatcagcttttaatatttaacttcaccactcagtcagtgctgaaacagttgttatggaggcctgcgttagtgagacctggcctgccacactctgtccattctttaaatattgttgcttctcatgattctatcttttgcccctttcacttctcttcctggtaatctcacttgcttgcacagcatcaaccaccatccaccatcgaggcaccaatgattcccaattaaatacctctagtatagacatctgataagctataaacagtttatgggaagtttcctattctaaatgcctttctggacaggtctttgttgttgcatcataagtacctttgttgttgcaccataagtatccggacctcaacatatctaaattgcaattaattatttttttttctctttcaacgttttttgtcttgtactctccatcactgtgaacagtattatcatcaacatttctaggctttacccccgtgttactgaatcaggctctctggagatagacacccagaaatctatttttaacaatatacttaggtattcttatgcacactaaaatttaaaaacctttgcagttccccatgctggaaacctcagagtcattctcttttctcttccataccacccacatcgaagaggtcactggatcttattgagattattctaaaacgtcccaaaagtgactcttattttccttcccactacacagctttagttcctaatctctccctggcacttctgcaagagcctcctcattttgtctacctgacctttcccctgtctttcatccaatcactgagtgctggtctttcaaaaaacaaataaaaaattcaaatatgattgcgctgttccttggctttaaagcttcaacagcttgatggcatgagaacagttttcaggcttcttaaggtcatggaattctttcttcaaataaaatcctaccaggaaatctaacttatagaacagatgaaaacggagctgctctgtttgaagcagtcgtcggcgccacaggcttggccactcagcctctttcgctgtgtttcctaagaaaacattcctgaagatacagtttgaaaaacactggataaagtccatattctttgtttggatgccaaattcctcccactctgacatccccctttctcttagctttccaatattaacccagaccccagacctggagttagtcactatttcttctggactagttgtgtgttcttatgactttttcacatttgctgtctctacaacctagaatgaccacttttttcttcctaattgttttttcctttgtgttctcaaagccaaaattgggatttatgaaactgtgattttatgtttatgcttgtctccactagaaaataatagaaaatagagaagccccttgaaaacagaacctatgcattcttcatgaatgtatcccctagatccagcacagtttctttttttgttttttatttgtttgtttgtttgtttgagacaaagtctcactctgtcgcccaggctggagtgcagtggcgtgttcttggctcactgcaccctccacctcccacgtggagggtgcctcagcccgggtgcctcagcctcccaagtagctgggactacaggtgtgtgccaccatgcccaactaactttttatttatagcagagatgagagctcattatattgcccaggctggtttcgaactcctgagctcaggtgatccgcccgcttcggcctcccaaagagctgggattacagacctgagccacaatgcctggcccaacatagtttctgacacatgattctatacgtgtttactgcacgaacatttatatgctctataactcattctatctgttctttggttttatattttcttcagaccgaacatgtctttttgaattaaacatcactttaggaactagatgtattaacttcaaagctatatgacactcatactgttctttgcctgtgttgtagcctagcatgataattattgataatcagtggatatatgcattgtgcatcatgacatatgaagcagaggtaatatggctataagatatttttgacagaaatgccatttgctgtatttttttaactgattttatatgtaacatgtattcattgtaaaaacatataaagaaaattataaagaagatattaaaatacatttataactatccagaaatagacttaatattttggcttattttttctcattctttcttctataatacatatatgtgtgtgcatatatatatatatatatatatatatatatatatatatatatttcttttaatataattgggaccatactgcataagtaattttgtatcctgagtttttttcactgcctttgtattgtgagccttcaagcatgccatcacatataaaaagactattagtattattaataatggtattaattaaaaattatgatgtttctaaggaattgctaagatttataaattcttaatagaaagtctaggaagccagagacctctgggtattttgtgaatcaaagggaatggaggtttgtgttggactgatgcattttaatgacgtattgcttaacttcattgagaatagaaacgatggaggggtctaaattttctgagcatctgttatatgccaggcattgtgctagacactttttatacattaactcattttaatattcaaatgatatattcttcaaacccaggaagtagatattaatatgcccatttaacagatgaataaactgagatgcaaagacaaagtagcacatctatgttattatctcagggagtagaattttaattccattagtttccaaagcccataccctttcctctaccccacactttctccaacaccaactttgagagggtacacaaagtcagtcttttattctgaagatgttgtattagcagtgcttaccctgtggaccataagcccttgggtgaccacagtttataaacccctgaaattacctccctttgtcattagaatgtatatgtatatttttgaggtagagagcctatagttgtcactgattatctaagggatcaactgttcccaacaatgtttatgaatctctactgcaaataatgggatgtatacaagtattgcagaagccctttgaggagtctttagttttgcttgtcaggccctgtggtgaggggctatattccaattttcattttaggcatcacttctcaaatgtcttattttgcatttaattcataaatttattcatttggcaatattttcaaatacctactatggtgccaggagttgtgaggtgttaggaatacagggctgatcaagacaaaacgagatatcccacagagcttagacattagcagggaaaaccaatgcatgttggttaaaatcagcattttaaatcagcatgatgagtgcttggcatagtccttagcattgttcaccaaatatttacgatttcttcctcttgtaggcagatggcaggataccatttactggcccccttgtaattgggtagggctaagtgaccatcagttctgtttaaggagttgtaagtagaaataatgtttttcacttccaggccaggacatttaattcctactatgaaacctttcagaactcttttttccctctggtgtggcaattggcagtgttcaagatggtagctccctaaacagcctggattcttgagggatatatagcatggccaagaaatatgaaataaacctgtgctgttacaagctgttgcaatttgcgagttatttgtgtcacaacatagtctaccccagtactgctcaaaatgtctgtgatgaaggatcaggttgtttgttacttttattttcaacctggatagaatagtatttttgcaaaatacaatttaagtaaattagcagataaatgagacatgaaatacataaacattcaagtacaaattttcatcagattcaacagatttaaaattactctgtcaaattactataaaaatttctaaatgcttattcttaatttctttacttatataattgcaaaccagtaagtttacagacctgcactggtttgcaacccaaactttgaataaagctgtattagcctatcccaactgatacagtgttactgtaagagaagtatgaaaatgtattggatagatactatgagtttccaattgctgctgtagccaatcaccacaaacatattgtcttaaaacaatacaatgtattatcttacagttctgaaggttaaaagtccaaaatgagtcttgggagactaaaatcatggtgttagcagggttgcatttcttctggagcctgcaggagaatctgtttccttgtcttttccagcttctagaggccatctgcattccttggcttgtggctgttcctccaacttcaaagcccatcacctcagcctctgcttatgtcgtcacacctgcttttctgactttaactctactacctccctcttgtaaggatcattgtgattacattgggatcacccatctaatccaggctaatctctttatctcaagacctttcacgtaatcacatctgcaaagttttgccatctaaggtaacatattcacaggttctggggataaggatgtggacttctctgggagccattattcagtttatcatagatagctaagctaaactaggagtcagccatttaagtagatccctgtggatacttaggaattaggagatggagaaatgggggaagtatcccaggcagagtcttacaaataggaagatctggaggtgaggaagattatggcttttttagaggaatgaacttttgagtgtggttagaggatagatacgagagagagagatcagcaagggacaaatcatgaagggttttgtaaaccatattaaacaacttgaactcttaaagagcaaagggaagacatcaaagggtattcagtataaaagcaacaattatcaatttgtattttggaattgcatatagaagagccagattggaggcacaaaactatgatgctgatgaaccacggtggtgtcacctaattcacagcatgtctgaaacccaaatccattatttcccacaaaagccagcacattctccatcttccctattgttttcttctaggattcaattcttaacattatttttagcctctttctttctttggcttcttactctagtcagtcaccacaccttattggttcttgaaaattttttaaagacataatatatggttacatgaatacatccaaaataataaacaatatggaaataagtcccttttcatcccttctctgacccctaacaatccaactctcatcttcatatgcaacctgattcattatcaatatgtattatcctgtgccttttattatgcatttacatttattatgtacatgcatatatctactgcattgttttaaaagcatttgcattaaaaagcataattatcttgtctattttcagctcgcaatataacttagatattttccatgtcaatatatttattttaaatgcctcattttaaaattgaacatcggtattgctctcttttccagcttcgagagcttctaactctaatagattctaacagtttctaactttagactattacaaactttatcttataacttatttttcaaatctttctcttttgaaatttttattaaggctttctcttagccagcatttttaaaggtagaagtagtcttctctttaaaaatatcaaaatacacaatgccaagaaaataaacagtgatcttaaatattaggttggtgtaaaagtaattgcagtttttaccattaaaagtaatagcaaaaactgcaattacttttgcaccaacctaatacctttttccaaactgagagctctgtgaaaattcacagtggacattaaagactctgagaagttctgtagaaaaaaaaatatttaacttggtttaactctacatatccaaattttttgttgaactacatcacttgatatggtttggctgtgtccccaccctaatctcttgaattgtagctcccacaatccccacgtgttgtgggagggacctggtgggaggtaattgaatcatggaatcatggggacgggttttcccatactgttctggtgatagtgaataagtctcacgagatatgatggtttaataaagggcagttaccctgcactcgctcttttgcctgccaccatgtaagacgtgcctttgttcctcctttgccttccaccatgattgtgaggacccccaccccagccatatggaaatgtgagtccattaaagctctttttttttaaataaattacccagtttcaggtatttcttcatagcagtatgaaaatggactaatacagcactgttaacaattccatataatatctaataacatctcatgggatactgttgttccatgaagtcactgtgtggcctcaaatgtagtggttacaagcagggtccctgaaaccaaactattctgaattacttaccagttgaccttgggcaagttacttaacatctctgtgcctcagttttctcatctataaaataggaataatagcaatttgtttcattaggaagtcataaggattagttgaataagtgttagtggttattatttggagcattctgaggatactgctcttgaagtattggtatgaagttgatggcactgttagcctctctactgttatttgaagaatccatatcattgtgaaattaaaaaaaaaatcttgactatggcactcccatataatgtaccacacagaattgcccgtgtgagaagaaacagctctgttgcaaagaaattcctgtaattccatagcatctctctttgagtcattcagtttggggttcgttgtaaaagtactacttttttctctatccacagcatgacagttcttaccttttgacagtcttgtggactgctgtgcttgtggtaatccaatcacagctgctttgcaggatgactgctcctctatttgaaaggcatcctcaagggtattttgcgtatgtgatttagcttgtattctaagcatcctaaacatctctgtaagtgtgctgaaaattcatctaatttgtattgtcacatggtgacagtcaaacaggaaattaactttatttctattaatttcatcctaagagcactctcagaaacattctatatttaaagctgcatttcaagtacacagtaatgagatatattcagatataccctttcctttgattcaaatatcggcccctattatttttaggtgtgtgttactcaaaatagatgctttttaaacttatgtccctttgtgatgctatgagagtatttgactaccacatctttttgataatcagaagttaatgacttgtccaaagttatctatgctgaaaggcaatagaatgacatacaaagcatcttgccatctttctaaacagcttagcatagttcaacaaagttactggccacagagggaaaaatctacatctatatttaaagagagagatctgtttaagttaggaattgaacaataaaagaaaaatgaatttcaccctcctaatctgactagtgtttactagccccatttaactaaaagaatgaggatcaattactcatttttttctctacttgattaaaatgtgtaatgggtaagggattctccaggtgaggtatgaaatcgctgaaaagagacacacagtgatgatatatcctcaggtgaagtcattgcagtccagatgctggtcttcagtgcaaaggctgaaaaatttgatttggttagcacacagcaaacagatctgacatgggttcaaactaaaccaaatatggagaactccatagacaggaccagaacattcactcctgaagggagagctctatgggaagccaacttataatcaaaagtgtctggaaggaagtgagattgagcaagggtaattagctgtatgatttgagtgattcgtggcatgaaaatttctcagaatgaggctccatcacctagcatggaacatgcgctacagggaacaaacaactattttcattttcattccctttctctagttggagtctggatgggcactgacatcacctagctccttagatcttccttgtctatgccttggttcactgtctccttttcttcaccctgtatttctccggaaggactgcgttatcatcaactgcattctatcttactaaatttatagtcatagttcagtgctgccttctggagaaaacatcctgattttcttgatagagttttgcctacttctgatctccttagccaactgttactggaaaggggtcccgatccagatcccaagagtgggttcctggatctcacacaagaaggaattgggggtgagtccatagagtaaagtgaaaacaagtttattaagaaagtaaaggaataaaagaatggctactccataggccgagcagccccaagggctgttggttgtccatttttatgcttatttcttgattatatgctaaacaaggggtggattattcatgcctcccctttttagatcatacagggtaactttctaatgttgccatggcatctgtaaactgtcatggcactggtgggagtgtagcaatgaggatgaccagaggtcactcttgtcaccatcttggttttgcagcttcttcactgcagttttatcaacaaggtctttatgacctgtaccttgtgctgacctcctgtctcatcctgtgacttagaatacttaaccctctgggaatgcagcccagtaggtttcagcctcattttacccagctcctatttaagatggcattgctctggttcaaacacctctgacattttccccttcccttttacaagagaatccttaatcctaagggttgcagaggaatgaagatccatcttttgtaacttcttcatgctgaacaggggtgatgatattcctgcctaactattagggtctcttgtattcagagtagagaggagctcagttggaaagtgtcattacagtgagggccattcataactcttgagttctgacaaaaggtgatatctggaagattagtaagtgttcaatttaagaaaattttcagtaaacttattttgcattattacacaaagagtacaactgcaatatattccacaacagtaaagcaaaataagcaaaattatcccaagtaaactaaattagaaggctttccatgaactgggcaactgttggaaacaagctgatatggagtcactagccaattccaatatgtgcccagaattataatattgaaccatatttttacattacacagcccttttgtttcttttgagatgcagtcagacatcacgaattggttaacaggaataagcagggtcagtctaaattgcaggaaaaaaacgacaacaacaacaaaaaacaactgataagactagaatttaataacagaagtaccatacttctagaaacacaatttttctctgtctagttttccatttgtattaaagacaaatcatggtaagaccaatttgattgcaaaataatccttagtcttatatttaggctgattatttgtataaagtgcagcaagaataattatttttcacataggctttttaaattggctttgatggaattctgtcccataagaaatctcaaataagaccttttttttaaagccaagcccagccatgggtttatatcctcaaatacctatgaattaattcttcttcttttttttttttttttgagatggagtttcactcttgttgcccaagctggagtgcaatggcaaaatctcggctcactgcaacctctgcctcccaggttcaagtgattctcctgcctcagcttcctgagtagctggaattataggtgcctgcccccatgccttgctaattttttgtatttttagtagagatgggggtttcactatgttcgccaggctggtttcaaactcctgaccttgtgatctgcccacctcagcctcccaaagtgttgggattacaggcatgagccactgcgcccagccaattcttctcctcttgaggtcccaagataaccttcagctcctggacctattagaaagtgatattctttacttaccacaagtcagaaaccctgtacagggaatgtgtagacaagatataaggtcagttttcccaaggggcttttattggctctacaaatcaagtttgattccttaaaggaaaatgcatcattccagtcaaagccttggtaaaataatcagtttctccaattgtgtcctgttgcaaaagaaaacagattcttattgtgcttatgcaaataactatattgccataagttaagaatactcacaaataggttccaattctggagaagtcaggtagagagaaacaaatatgcctcaaattttgttcacaagagtacactttactcaactgttaaaagctataaatagctcaaaagaagagttttcttgtctctgaaaaacaaaacaaaggatcagcaacgttttaagcaaaaagtcaaaaagatcactttggtcttctattagctcaatccatgcagttaactcctgtcctgcttgatatttattaacatttcagcttttcatgagagtcctgaaagtttttttctttattctaatgtcataatccccaatgttatcagaaacctgcattcaagaacacctgttaaagtcctttagctgactataaaccaccttttaaataggattaaaataagacaacaactgttggtggatgacaaaatgtcttagggcagtcacagtcaaaagatatgattgacaaagcaatttgattacctcggtggcaatgttgacaatgtttcctgtatgatttttataccaaataagccaaacgtcatttttatattagtgtactactaatgttaaaccctatccttaataaaactttatagatacatctaaccaattttaatatttgaccataaggtaagattcttataccttttataactctttacaaatttatgttaaaaagtagattagtgctctaagaaaaacctgttgtgcttatattccaatgttcaattcatggaagaactgaataatacccctttaactttagccaatatgttcacacacagaatttcttttaaaagattagtttgtcacaagactttcccaactcactcaaaccttcaagcatatcctatctaacttcaaacaatcctttaaacttttaggcaaaaaaaagtccacattcctatgacttcttataatattttaccaaaaacgcatttcagtttctttacacaccttgcatgtaaaactgtttcttcagttgtctcaataacatattacaatgttagcttttagcaatttttacttttggtgaaaaacctggttagtaagcgattttaattatgtaccaggtgtggcacctaagacaacagataagatttgactttttccagcatagctagggggcatggctaacatcacatgtccccaggtcttatctagaatctaatgctctaaagtaggtaaattgaacaattttcaaaagtcaaacaagcagtttatgaccttaaagcatttagaaagcttaatatctgacctgtaaaatttagaccaaatgtctttattttatcaataatctttaaaactgtttttactttccaaagattacttaagtcgtgtactaaaaggcattacactttttacttttctgacaaaatatttgatttaagctcttatttttaaactaattaaagtttttaaaaatatctcacacacacacacaacacatataaatacacatacagaagaagattcagtagttgtaagacttttcatttgccagtttctaagtttgtctttaaggcatgcagtttctagggcttaacttgcaggcacagctggaaggcaaaacagatatacaaaattaaggatcccatttttatgccagatcctggatcccaaaaagagggaatcagcccatctccataggagtcttatctctcagcggtgggtggggacttttttttaaccttctaggttgccaacagcatacttctctgatctaaacatgcaaaaagccacatattcccccaataactgccattagccttccccaaaagtatatttcctacctagttattacacaacaaagttctctcataatactaagcaatttctgaccccccaaaagtgaaaaacgttggataatgcaatgcaaaacagaatagaaccttagatttttaaaggaatctatccatttccaattcctggagtttcatgaggaaaacaagtttttcccagaacccagtctgtggtgcctcctctgtttttcccaaggagtctcatgctgttagagcttgaatatccgctttaaataagctaaattttaaccatagcgctctttttaaaaagtccttttaaatctcttattaccgaaccaggccaaatggccaatattcctgtcttctgaactttaccaaaggtaatctcccaggtgctcaaagaaaggaaaaattccagaagggaagccggaagttgttcatcatgggtggggaagagaatctacaaatggcaaaagtcacacagatatcaaactagaaaagactcattccctaatcctggaattgaagctgggccaccgttgtaaaatggtgaagcctttgatgctgagctacagcattgggcagtttccattgcccttcccagaaggagcttagagcagccaattttgaacttgcaaaggcttttaacttctcaaggtaatttttagggctaaccatgaattccaaagttcctgctctccggaaggtggagaccaagagaaagtactgccacatagttataaggtcaagctctcaaggaaataaaataagatgagagggaaactttatccagttttttgtttttgttttttttagggacctgcagcaaagtttgtaactgaccagtttgctgggctggcttgaacagcgggcttacaggagtcctaagcctgtgttctatcttaaggtacccttctccattatagaacaacacagaaagacaaatttataacacaaagtacagattttactacagcttaagactagcctcacaattcctttttctgattaatcaaaacttgatagagttttggctacttctgatctccttagccacccatttacacaccagttacgataatattagtctgttggtccaggtacagatgaataaaaattcatttaggactaattttcttaattaaactctcacagggcaattttatttctcttatattctcacttgatctctcgtcttctctgtcaccttcatgtgctacccatggtgttacttccctcccttcatcctcctcacagggcagactcttggatttttagagagaagatttgtatttatagcccaaggcagggatagctataagcttcaggtcaagcatttttatagctaccaaccccttgaataatttctgaatatgattctataaaacattcacaaagtaaagtctaagtctgacatttcaaacacaaaatatgtcttcaatgaaccctgggtgtaatgataacatagtcattcactgagttttcaattttttttccatttcatcacaataccagatgagatacacaaggggttgaaaaaaacaactgtgttctttctctgcggagactgcagttgacagtgatgcaaaaaacaattaacctttctgaaaagccctgtttatcctaaccttattgtttcctgttcttttcaaacttggagcactctgggccttgttgcctctagagctttcaagatggagggaagacctggagtaaatccagagaatatgcactaacctgaacagcttcctaagagggggctggctctttgtctgtaggaagcagttcatttctgagtcatttcagcaaagttctggtttggtgtacactgtatagaacaaacacataggggtttgtggaagtcgaggaagctctggacaagatcctctcctttcagatctcctgagattttggggtcagcctgacctcatggttactgggaggccccaaagcagcctttaagtatgtatgtagttattcctgggagccttcctagaggcaagcataccaagtgtaacttgcaggtaaattgtagttcatagatcttggggaaagctaagggacagtatcatgggatgatgcccaatcacaaaaatcaggtagattacccaagaagtcatcattcttaagcagctttagagagagaatccaggtaacaaaccaatgaaagaatgtgctcaagagttaggatgagagtcagggcctggtgagcttcttatgttgacaaaggggtagttttaaaacatccattttacaatatacaatacatacctaaaataattcacaaacaaccatgtacatcatgagatataaacactcattttgagagcaaaacattacccaatgcattgaagccgctgtgttctcttctgtaattgaatacctgtgtccaccagaggtaatcatgatcttgaatttcctaatttgcctatatttatactatgaatgtaggcatttctaaattatatatatatttgcaagttatatacttcacatatatatgtatatatgtatatgctatcatttttcatgaattcttccgtaacgtaattttttttttaagagacagggtctcactcttttgcccaggctatagggcagtggtgaaatctcaaagctcactacagtcctaggctcaagtgattacctcctgccttagccttccaagtacctgggactacaggtatctgccaccatgcccagctaatttttaaattttttgtagagacatgggtctcactatgttgcccaggctagtctgaaactcctggcctcaagagatcctcccaccctggcctcccaaaatgttgggattacagatgtgagccaccacacccagcctgtaacttaattttttttattcagcagtgtttgtgagatctatttaggttgatgcatgtagcagaggttcgtatttgtctcaacagcagggctttttatgctgtgggcctagttttggaaaggaaggaagaaagaaggagggagccacttaaaggccctgatctgttatgggcagtccagattgtgcacttagtgtcccaaagtggtgacccaattcacccatcagtcagctgcaagagtggcgacgtgatgcagctggcggaggaagctaattataatggagaaaactgaatttgcatagagaaccaggaatcaactaaatccaaataacatttcctggttaaaaaaacactaaataaagatttaataaatgcatgtttactgttttaaaaaatagttttttgagttagatacaacaaaatttcaaaaattaggcagttttacaagtgctatgggaaaaatagcctaattaaatttttctctcctcttttttttctccaccgtcttagtgttttctgcattctctcccagcggatctgattcctgttctgaagaattgaagttgagcatcgttagttaaattcagctgctgcctgactgtataccacagcaaaggctttggaaacatttttcagttaaaacaataatgactttcttggagtgtaatcccagtggaggctgttctacgtatagcctgaaagaatacttaactaccatacgcaattctgcagagaccttgtaaaaatcacactttacaccaaacaactgagtgattctgaattggttgggggaatcttagttgtagatatcaattcaccttcttgaagattcaaccactgctactcagagctgctgctgaaataccatgtctaagaactcagagttcatcaatctgtcatttttattagatcatgagaaggaaatgatcctgggcgtcctaaagagagatgaatatttgaaaaaagtggaggacaagagaataaggtagtattctttttattttttcagtcctccttgactgctttctgtttgtttgaagcaatttagatcagaaatgggccaagtgcaaccacaatggggacagatgtcagttaggaacttcatgagttctcatcagtagcccaaatatcggaaaactttggcatttcaccatttagccagacatgaaaatggaatttagctaataaagtggtattgatgagaacacttaatttgctaataaagtcataatttttagttaagaggaaggactacctaagtttgagtaccagctctggcaagtattagtcgtgtgactttgagcaagctactcaacttccctatgccttggtttcctcatcggtaaaacaaagataataacagtatccaccttatagggttgttgtaaagattaaggaagtttatacatatgtagtgcctgtcacctaagtgttcaataaatgttagctattatttatttgtaatgccattgtcagatcagtcttactggggatttgcctccagcacagctgcgagaagaaagggacctggagagtaaaaatttcccatcataccccagaaaccacttgaatttttaaaaataagtttcttgtgaagaaagttgaacgatgtgggcacagttgaatttcatatccactgtaggcagagctcatatttagctggtttccccggcatgacttcacctaatatttcagccagcatcaattctgattggttgcgtcgcctgctctaattggtcacatcattgttctgatcatttgcaaaatccactgtgattggctgctgcctgtaccgtctttgttttaaaatatatttggtcattacaccttaccccagaaaaaaaggagcagaaatagtgttccttcctcagtcactgccaactatgcaatgtgtaggttttgtgtcttgtatggctccccaagctacaatcagaagcttatgtttattttacctgaggagaaaacttatcatgtgattatattcacatgttgaaaaaatctttaatgtgcccaaagccactaggatctttagaaatggaaataatttaagtattcttgattgatgtttatttcacagttaagagcccagaagcttcatttccacttttccaagatattcaactaatcttgaagaaacaaaagtttcgatgaaaattattgcactttttctatgcatagaattcaggtggcaacaaaatgtagttaataatttcaaagaaatcatgaataatatttttgacattagtagtcaagtcatgaaaagtaaactaatttgtgtaatgccctgccaaaaaaaattatgttgtttatagggggtgacatattaactaggaattgatgacattccaaggggaatttaaaatcatttctgtcctggctaacacggtgaaaccccatctctactaaaaatacaaaaaattagccgggcgtggtggcgggtgcctgtagtcccagctactcaggaggctgaggcgggagaatggcatgaacccgggaggcggagcttgcagtgagccgagattgcgccactgcactccagcctgggcggcagagccagactccgtctcaaaaaaaaaaaaaaaatcatttctggccgggcgtggtggctcacgcctgtaatcccagcactttgggaggcagaggtgggcggatcaggaggtggggagattgagaccatcctagccaacatgatgaaaccccgtctctactaaaaatacaaaaattagcagggcgtggtggtgcacgcctgtagtcccagctactcgggaggctgaggcaggagaatcacttgaaccccagaggtggaggttgcagtaagccaagatcacgccactgcactcaagcctggtgacagagtgagactctgtctcaaaaaaaattatttctataggaataaacaatttaataaccagatgcccagagacaatgaagtacaatgaataggactttgttctgaatatttgtttctgtcattatcaataacttgtattaataattgttggctgggcgcagtggctcacgtctgtaatcccagcactttgggaggctgaggagggtggaccacctgaggtcaggagtttgagaccagcctggccaacatggcgaaaccccgtctctactaaaaatacaaaaattagcgggtcacagtggtgtgcgcctgtaatcccagctactcgggaggctgaggcaggagaatcgcttgaacccaggaggcggagcttgcagtgagccaagatcgtgccattgcactccagcctgggtgacagagccagactccatctcaaaaaataataataataacaattattattattatactctttcttcctttttctcattccatttttcttccctagtcttctttccttattccctataagtaaattcggttaaattgggtgtaatatacaacagagtatcaagaataaagtcattggtttcctggctcttcaaacttttttgagaatagcataagaaaggctgtttataaatccaagagatacttttacagaaaagagattttctaaagctacgtcttgtctccttgttccatctgcattaactgcattagatgtgttgtctcattttgttctgagttcttgtaatatgactcaggcttcaccactcttaacagcttggtgtattcagaagtcattccaaagtgggtggcatgatgttgagggtgtatgctgttgaatcacacagccagagttcaaatcttactttcggcatgaaatatctgtatcattttagacaagatgtttccatggataaatctagtttccccatttgacaacagaaataatatcagtgacatcataagattgttctaaggattaaataagctaatattacaaacagcttagagcaatgccagcatacagtaagcactcaaaaattgttggttataatcattagccctatagttggtttgtggtgcccttgatttgctagttgcagtagacactatcagtgctctactcagatcccctggagtccctctcacctcctagttttcatgcactttattctaaggacttgaagtacaaaattaccttcgggtgactggagtttcccataggattaaagagacacaagtgccaggtaaacttgagtgttaactgggtagcccaaagccaatggttgacgggtacagaaatccattgcctcaaggcagaacagactctgcaatgcaacttaagctccagagcttcccgtgggatgatgctgaggctggacttcacctaaaaatcacacccttgcttagcccctctccctgccttctcctgcctcccttactcccttatagatttctcttgagagcactacataagtcgcttgcacacaaatctacatagcagaattcgcttctagaaaacccagtctgagacactatgaagtttgtattaccaaagctattactatttagtaaagttcgtttcaggggaaatataataagtctgcaaggtgagcattaaaataaagaattttggttcatttgatttacaagctatgatcttcccaacaatttttatcacagtcattgtggtttacatactggtaaagaaaaaagtccaagctaaagaaagaagcccaagattaagcatcttggtcagataatataactttctgttggcttttctccctttatctcctctgaatagccattttattatgaatttaagtacaacctaaatcagttcagggtaccttaactttagcgcagtgggtctgcatggcaattaaattctgcaaacatttttctgatagatagatagatagatagatagatagatagatagatagatagataaaaatatttattataaagaattggctcatatgattatggaggctgagaagttcagacctaggagagatgatggtataatttgaatctgagtccaaaggctgagaaccgggagagctgatgcaataagttccaatccatgtctggcagtcagtagcaagggaaaactgatgtcccagcctgaagacagggagagaaaattcattcttactcagctttttactctattcagaccttcagcgggttagacgaggtacatccatattggggagggcaacctactttactcagtctactaattcaaatattaatctcatacagaaacaccctcacagaaacatccagaaataatgtttaacaaaatatctgggctcccagtggtccagttaagttgatacaaataattaactgtctcaggaatttatataaagctggctatagcccccgttcccacacttttgtgaattgtatagctcatcctgactctgtacccccgcttctgttgaactctcctctctccttgcatctcaccacttatggctattccttactcttttctttgccaggccagagaacttagtcctttttccttgatatcctccaaaaccatcaatacaagaaatttagatgggtaacagattttattacaacagtaaactttggtgctagctattacaatagttttcatcatgctatagaggtacaaatggatattttggggggagtctaaaggaagaagtaattaattacaagtaagatagaaactgaagcaatggtttcacagaaaaggtgaacgtttgtgcttgcctttgaaatgtgaaaaggacttttcacattggcaaatataggtcaactatgttttggctgtttaccatgagccacaaagccaccttcagactgtactaatcagtttcagaaggaaatggaaaccaaaattttttttagactgaaaaagattacaaagaataaacttatctgaaaagttagtaaagtggagtttgggaggcagtggatttattgttcgtttgtgtgtttatttgtttgaatagcttgtcctttgagataaaaatgtagaagacggagaaagcgtaaaaattgtactgaatcaatattttaggcctgacacccaaatgtgcttcacagtccacatacccactaaagtgtggcattgattaaggtgggactggtctttggggactcgtaaaggtgctccatacccagaaggcacatggcaagcctgataattacctccaggcataaatcatcagctggggaataggcatctgtctactaccattgcattttaagttcattcaagaggctgaaatatatttgtatacattcttctccttcagactaagcaggaaggagtggtaggagatagcgagacacaggttttcactgttagagggtaagaatatttttaaggttctctatggagagcaagtcactcaaatttattgacggctttactgcaatgaagaaaaagcagaaatgttgcaaataaaattgagctatcaacaattattgcaaatggataaaaatactgacagtttcgaagcacaaaatggaaatcattgttgattattttgattttgtaccttagattgcttttcatttacttcaaaagaactcagactaacatgtacgtgggtcataatatctactccaaaaaaatctcattaacaaatttttactctacttgatctctcacacctaaaaacaaatactgttaaatatctactttgtggtattgacttgtacttaaaaatcctcaacttattagtgaatattcatttcagcagtatattgtgagctttattctcactaagggtacatcatttccatttgaccaccatacatgaaaacatatctgcacatgttttctttggcacctaatcttgggcttgcctcagtggtaaactctattggttgccttacaacataacatttctcctttctttctatccaaatcaaagttttattcagctctagcagtgaattttttaaacaaattttttctcaaaaaaaattttttttattttttaaaaaatgttttaggccaggcgtggtggctcacgcctgtaatcccagcactttgggagaccaaggcgggcagatcatgaggtcaggagatcgagaccatcctggctaacacggtaaaaccccatccctactaaaaatacaaaaaattacccgggcgtggtggcatgcgcctgtagtcccagctactgggaggctgaggcaggagaatcgcttgaacctgggaggtggaggttgcagtgagccgaggtcgcaccactgcactccaacctgggcgacagagcgagactccatctcaaaaaaaaaaaaaagttttaaatatttgtgggtacatagtaggtgtatatatttatgggatacatgagatgttttgatacaggcatgccatgtgaaacaaacacatcatggagaatggggtatccatctcctcaagtgtttatcccttgagttacaaataatccaaataaattctttactttaaaatatattattaagttattattgactatagtcaccacactgtgctatcaaatagtaggtcttattcatactttctatttttttaactcattaaccatcccccccccgacccgagccccacactaccctttccagcctctggcaaccatccttctactatctatgtccaggagttcaattgatttgatttttaaatcccacaaataagtgagaacatgcgaagtttgtctttctgtaccaggcttatttcacttaacatagtgatctccagaccatccatgttgttgcaaatgactggattacactcttttttatggctgaatagtacaccattgtgtatatgtaccacgttttgtttatccattcatctgttgatggctgcttccaaatcttggctattgtgaacagtgctgcaacaagcataggagtgcagatatctcttcaatatactggcttcctttttttgggtatatacctaggagtgggattgctggatcatatggtagatcaatttgtagtttcttgaggaactgccaaactgttctctatagtggttgtactaatttacattttcaccaacagtgtatgaaagttccttttcctctgcatcctcgccagcaaatgtattttggtttcttgtgtaaagctggctcagttgaaatgcgccactaaataagccagaacttaatatctccaagagaccacagaccccagcctagtaactcccattcaccttatggttttctcttaatgtgactgattttgtcatttcagtgctaggagaagagaaggaaggagaaacaggaggggagcgtgcattcaaattgcttatttggaatcctgcagataagttcaatatttggttcaaatggatttgaagtgatttcaagaattatacattcagcctggaagtcagggagtctaagcgccaagcaataatacccttttaatacactataaatgtttgatcatttgtttgtttttccaaatcttatcactctaccactaagagcaaaattagtttgaccttctcaaaagcctaaagactcattgtccccataaaacaccaggagaactgttggactggacttctagtttggtaaacactttggtttaatcctaatagaattgccacaaagcttcttaacggattaacagaaactcccagcatgaacatactggctccctaatggaactcaaatgcttaatgagtcacagaaaaatgaacaaaaatattcagatctgccttaaaccttggacgttttcctagcaaagaccttaccaatttcaatatataattacatttagggaaactaactttaattttgattctagagcatttttctccgaggaagcgttacttgtaaggtgcaccataggcacagggccacaaatacctgatattcagagacatgttaaacattggattgtccaaataaataaacttgccagatcatttttaatatttttttacattttattttattgacacatagtagatgtacatattttcagggtacatgttataatttcatacatttatataatttgtaaagatcaaatcagtgtagttgtgatatccatcaccttaagtatttatcttttccttatgctagaaacattctaattattctcttctagctatttcagaccattttcttgggggtttgaaataatagatcaccatagtcataagtaagattgttacctgagactatatctattatctgtatctacatatgtctctatatagagatctatattatttcaaattattaacgtgtttatattatattcatataagatatatattatttcaaatacctagactatatatagaaatatatatagagataggttttctctctacatatataagtggagagagtctatataaagagagactcagtataggctggggattggtttcagggcccgggtgtataccaaaagccacacatactcaaggctaaagttggccttgtggaacttgtgtatagggagagttggcccactgtaaatgtgggtttcatattccacaaatactgtgttttcaatcttcatttggttgcaaatgcagaactcaaggttatggagatccaactttgtttattttttaaaaatccacatatagatgaacctgggcagttcaaacccatgttgttcaaggatcctctgtatattttttactcttccccatattcccattttactaccctttcccttccttgtgtattgtctctagccagaattggtatagaggtcatgtctctaggcagcaggggttagttggcactcacatcccaagaaactaccattccctttcaatgcaaattgcagaaacagaacaataaagcccatgtaatccagaacctggctgaatgttggggctggaagggggagtaaagaagacccatcccctcaaaggtaagtcagctcataagggaatatctaatatcaactatatccttggagaaataggtattttattcctaagaaaatgatataagtgaaaacttcactaataaaaatgtcaccactaatattttagatttcaggcaagtgaccattttatatcaacagtaatcttataagaatgttcctatgttaatagaagttatggtttaaccaatttaaatttataataagattaggctaacatgcatttcataatttttataattgttcttttattgcagagtaattaagcataatgaaaatatttaatgcaaagaaattaataaaattcttacacagcaagcaattttttaaagtttttaatctcagtattgtgctaggatctataaagggcatcaatgtctgcaacttttaaaataccataaacctcaatccacttaaacatttaatatcttctgatacatattttcattatagaatcaatgggcttattacagaaaattacataaccatataatatgaacattaaagtctcacatagaattccactttccagaggtgaatagtctccatttgtgttgaatttccttcctgtcacttttatgtgtatatatatacacatatatatatgcaattttcatatagttggaaattgcatgaaatttacatatacatactgtataaaatatcataaacctcaatctgcttaaacatttaatattgtctggtacatattttcattaatagaatcaatgggcttattatagaaaattagataaccatataatatgaacattaaagtctcacatagaattccacttcccagaggtaaatagtctccatttgtgttgaatttccctcctgtaacttttatgtatgtatgtatgtatatatatatatatatatatatatatatacatatatatatacatattttcatatagctggaaattgcatgaaatttacatatacatactatatatgtaaattttattctttatttttgctttgcattatttcatgaacatttttcatgtcattaaaaattatttgtaaacatttttattggctggataagatttcataacataagatttttccatataacatgaatgtgcaacgtgtttcttaactatttattcttatttccatgaacattctcattcttaaatcctcttatattgtgattcatattttgaataatatttccttaattttaaaaaccggcaatctgagaaaattgattcaattaagaccatgcatcttgtgaatcagattgtttattgtttatcacaaatctcaccttcctttcgtagaatctgaaagtttgtaattaactgccagtgatggttttcagtgaagcatttaaggaaagaacaacacataaaggaaacatttatattcatattcaacaaatttcaaagaaatggtgacaacatttcttgtatcatgtactgatactgacaactagggaaactgctcgaaatgtgttttgcaataacctttatctgtgaaaatgtgaatccccataagtatcacctaaaaaggtaaaatgggaaaaagtaagtactgataactgcctttgctgaacatataaccccttccccaccacatttaaaataatttagtttgcacaaattcaatttagagtcattctagaaataaacttcagttatacatttataaaaactaaaatggaaaccctctagtatgtgtccatattcagcagcagaattggttttaaagaatttttcatgagcaacatgttctctctaaagtatcagtttttttgtatgaatgcccaattttcttccatcaagtcaattctatcattgcattgtgataccaaatattttaagaagcccagcattttatcttggttgttttttaaagaaatgcagctttcctacttcttgctgtactgattctatctccatctctgtttttttctgagtaatttatcatattgataacaagactttctgatgtttttaatactcgagcaaggtattctttgggtttcagattagcaaaacacattcttgtttcttaatgggccaggaaattgagacaatagttattttaagatagttccatgtgggagacttggtttgctaattacgtatgagataaatttctgctatgataagactatagtgaataaacagcaaggtatcaaattgcagtgattcctaactcctttagagttgtaacgagctgtttttgtcatattatttataagatccctgtcttaggttggattcccccagaggtagaccttgaactcatgatttgtgtgcaagtgatttattaaagagaaaccataaactactagtagggaaagcaacacaggaaaggagaagaatctaagcaagggtgagaagtcaggcaaaatttggcagaggtcaccatcatcatgactttacagagacagataatgtttgctgttttgtctccattgtcctttttaaaaagaattcagaatgaatgcttgagtcattgtccctttgcatatatgagcacatttaatgtttctggaaaatctgtaataagtcattgattctcttaggttataagggattggttaagttcttcctcgtatttctgtggttttaattattttccctaaaactgttacttttcagcattattgctccgttgttttcagtattttttggatttgggttttttgttttgttttgttttgttttttgtcaattgcctgtcagttgacatggttttgtgagattttccggtatattcctatgagccaagctttttaatatcaggaagtttcttctgcagatatgaagacttcacaatgccctctttccttgagactatttgtaaacatgaaattggcacaagtcacaagacttctttatctaaacaagtgttcttttactccttcttcttgttactttctcttaagcagctttttatccaggcataactttttcccagttctcagagagttgtgattctttttaatagcctttgatttgaaaactaatcaaaagttatacaaaatgtattaagatagagtcatgcttgttgaagaatgactctcttggggaatatttgtcatgagagactttgtgataagatccagtttgggcagatgccatatgttgaaagaagctgggcgggcggaagaaaccctccatgtttactgaggcttaactttgagtgtgctcagcatggctttgcacagctaggaaagaaacaacagtcatgaataaatacggagtcctttctgagcaaaaatattttaatatattgagagccagtgggaggatactggtgtgtgggaagagtgcagattttggaatgtaaaattcagggtctgaatcctgacctccttatttaatagccctgtgacccacaagttacctctcggagattccactttcctgtctataaaatgggaatcataatgtatttttcatgggttgttgtcaaagcaatggtatgacatgtgtattagttcgttttcatgctgctgataaagacatacccaagactgggcaatttacaaaagaaaaaggtttaatggactcacagttccacatggctggggaggcctcacaatcaaggcagaaggtgagaggcacgtctcacatggtggcagacaggagaagagaacttgtgcagggaaaattccctttataaaagcatcagatctcatgagacttattcactatcatgagaatagcatgggaaagacccacccaaatgattcaattatttcccaccaggtccctcccacaacacatgggaattatgggaactacaattcaagatgaaacttgggtggggacagagccaaaccatatcattctgcctcttgcccttcccaaatctcatgtcctcacatttcaaaaccaatcatgccttcccaacagtctcccaaagtcttaactcatttcagcattaactcaaaagtctgcagtccaaagtctcatctgagacaaggcaagtccctcccatctatgagcctgtaaaatcaaaagcaagttagttacttcctagatacaatggggtacaggcattaggtaaatacagccattccaaatgggagagattggccaaaatgaaggggttataagccccatgcaagtctgaaatccaggggggcagtcaaatcttaaagctccaaaatgatctcctttcactccatgtctcacatccaggtcacgcacgctgatgcaagaggtgggttcccatggtcttgggcagctccacccttgtagttttgcagggtacagcctccctcctggctgctttcacgggctgatgttgagtgtctgtggctttcctaggcacacagtgtaagctgtcagtagatctactgttctgcggtctggaggacagtggccctcttctcacagcttcactaggtggtgccccagtagggactctgtgtggggctccatccccacatttcccttccatactgccctagttgaggttctccatgagggccctgcccctccagcaaacttttgcctaggcatccaggcatttcagtacatcctctgaaatctatgcaaaggttcccaaaccccaattcttgacttctgtgcacttgcaggttcaataccacatagaagctgcaaaggcttggggcttgcaccctctgaagccgtggtctgagctctacattgccccctttcagccacagctggagcagctgagatgcagggcaccaagtccctaggctgcacacagcatggagaccctgggccctgcccatgaaacctttttttgttccaggcctgtgataagaggggttgccgcaaaggtctctgacatgccttggagacatttcctgcattgccttggtgattacatttggctcctcattacttatgcaaatttatgcagccggcatgaatttctcctcagaaaatgggattttcttttctatcgcatcgtcaggcttttatgctttgtttcccttttaaaactgaatgcttttaacagcacccaagtcacctcttgaatgctttgctgcttagaaatttcttcccccagatactgtaaatcatctctctcaagttcaaaattccacacatctctagggcaggggaaaaatgccaccagtctctttgctaaaacataacaagaggccaggcacggtggctcatgcctgtaatcccagcattttgggaggctgaggcttgcagatcacaaggtcaggagatcgagaccatcctggctaacatggtgaaaccccctctctactaaaaatacaaaaaattagccaggcgtggtggtgggcacctgtagtcccagctacttgggaggctgaggcaggagaatggcatgaacccgggaggtggagcttgcagtgagctgagatcacgccactgcactccagcctgggcgacagagtgcaactccatctcaaaaacaaaaaaaaaataacaagagtcacctttgctccagttcccaacaagttcctcatctccatccgaggccacctcagcttggatttcattgttcatatcattatcattttggtcaaggccattcaacaggtctctagggagttccaaactttcccacattttcctgtcttcttctgagccctccaaactcttccgacctctgcctgttccccagtttcaaagttgcttccacatttttgggtatcttttcagcagtgtcctattctactggcaccactttactttattagtctgttttcatgctgctgataaagacatacccgagactgggcaatttacaaaaaaaaaaaaaaaagaggtttagtggactcacagttcctcttggatggggaggcctcacagtcatggcggaaggtgaaaggcacatgtcacatggtagcagagaacagaagagaaattgtgcagggaaattcccctttataaaaccatcagatctcataagatctcactatcatgagaatggcacaggaaagacccaccaaatgattatctcccaccaggtctctcccacaacacctgggaattatgggagctacaattcaagatgagatttgggtggggatgcagccaaaccatatcaacatgtaaagtaaagtgcctgttattatgtggctaagtgttgtgaaatttaggttttaatgataggcactgcatgtggaagctacagcacaaatgaaagcataattttttttatattcagagtacagaaagaaggtctggtcagccttgaattttcctcaggcaaatatgaaataccacagtgttgatggcattgtctctgaatcttacaaaagatgggagtgcaaggagctgtgcaggcatcagaatcaggctgctgtgacattattctgcccgcatatattattttagtgatttttgtgtcattgttgacaatagactttgtcagtcactgtggccttgctctcttaatggaatatgaaacactagttctagagaagtacttagcttgcaggcattacatcagaggctgaagcaaaacctgacagcaacatctctgcaagtggaagaaagaataaaaactaatatttcctgagttcttattgtatttttttgggaaataggtttggctgcgggtgacagagacacattataatcatgacttaaaatgggaacatattcctgtctaacgtaaaagtctgggttgactggtggcttttgtggtattgttatgggggctgcattaaagcaggggtctggactccctatcttttgttgctccaccatgttgagagtttagctcttgatccaggatggttcattcctatgttctcatcccagcttcaggaaaaagagaagaggtcaagggaagaggattctccctcttccattaaaggcatgacctaaaggtatatcgtttctgattacactccattggccagcatttagtatcatgacaaaacctaactgcaagaaatactgagaaatctagtttttattctgagtggccatgagtatagctagatgttccactaataaagaagaaagggagaacagatattgggaaacacataccagaattgtctattccataattattatgtgtcaagctgtgctaaacacttacaaacattgtcttacttaatgctcataacaacactgtaatgctgtttttacagaagtattttgagacacaaagaggttaagtctccttaagtcttgagacagagagacgttaaataattgtcttaaggtctcagaggaaataagtggcatagccagaacttgaacccaggcactctgactttagaaccctgtgctctgggccactgtgtaatccttgcttgctcattatctcccttaggccttgatgtgctctactagatgagattgtttaaaagcatcaaggaattaaagatactttataaactgtttattcatggcttcctcttcaaggcagctaattgcttccattctaaaattcctatcttatttggtgtaaaatggtgttcagtacaatttggtccagacaagataacacaagaaaaataatgccacacaaatgtgacaagaattttaatgaaagcaattcctgatttgaaagaaatgtgtctatgtgatgataaagcaaaaagtctttttaatacatggaacatttttgatgatgggatggaaaaaaacattcaatatatcactagaatacagaaatgaaaagattgtatcattcaacaaccatcaagatagttaatcttttcagtctttacaatttcaactacatataggtcagcaatttatatgttaatataaatgtatctatagagcaacaaggaaaattaaagaatgtgaagctgttgtagatttggtggtcagagaaaaccttccctgggcaagcagcagtaaaactaaaattaaaaaaaaaataagcgggagccagccagattaagaattaagttgtatgtttatcagtcaatataggttaagtgatgctgcagtaacagctccaaactcttagtggcttaaaacaacaaagatttctcactcatgccacatgttcataacaggatgtctggggactctacttcatggcattttcagaccaggatccagacttgcagagcagacactatttggaacattgtcattctctatggaaagaaaagggtgtgtggtgaaccctgcccttgattttaaagcttttagctgggattacttaccacgtttcattggccagtgtgagtcacatgatgacatctaatgccaacagggcagaaaggtgcaatcccaacttgctttcagaagtaaggagaatgggaagtatttagtgaacagataaatgactactgttttgggtgatggaatgtggagggaaggcattcccagctgaagaaatagcatgttcaaaggccctgaagtgggaaagaacttggtatatttatgaaactttaagaagaattatgttgctgaatcctatctcctatctgtagacaggagatgaccagagggaagagggagcagattaggcagatctttacaggctatgggaaagaggtataaatttcattaaaaatataaaggaaaactactggttggttttaagcagaggaaccacatgatgtaagaaatattttaaaagagtattgactaatgatattgattattccatggagagtagattggaagggaattgaaagtagggacacctaataggcaccttttcaaaattctaagtgagattgcatggtggttccagtttaatgcagtcttatttgaggcaaatattccatctattttagacattttttaaattattaattattatccatttcaatctccttcccatatgcctcaaattcatacagcacttcaagccactgcagtgagccacagggaaggaataaaggttttcttttcctcttcttttacttctttttctcttttctcttcccctactaaggatctgtgcctgcttatgttgaaggaaaggaaagagaaaagttatgcttcattgcttgaaatatttggtgatgggacaaagaggtctcctttctgtcgtcattaccatttctccatatgaaactgataacagaaggctgtgatatcttctcactctgtttaatccacatgaatgttcaaagagctgatattctgcctccaggatgtttgtagggtaggagacgcacaatcccaagcagggttccttctgttctggctccaaggggaagtgaggctgagaggagaaatgatggataatgagaaagtgatgtactcattagaactgaataatggtttcaacagtgtttaaattcatgattttggatataatataatttctagagataacaacttccagggtttcttcatgagagtgaatggtgcacatggacaggaaggtcaaagaagatgaccaggtcaaagaactgaaagcccagggagttggatgtgttatgcccaggaatgatgtactctgtaagaaatgaagccaagtcaagggtatatccatttcctgtggctgctgtaacaaattaccacaaacttggtggggacttaaaagtgcttagtatggctgcctgttgcaacacatgagtcatggtgtgtcatttgtctccttaactaacataaagggtaatggtaattcttagtagatgttttgtttagactcatttttttcctcaataccagaatgcctagcacagtgtaggcgtactataagtgcttgttggatgaatgagtgagacatgaagtcaaagattttaaaaactttgctctacagtttgaaaattctctttttatgaatctatcatcaggctgagaaataaatgacctggttcctgattccatctgtactgcttattatttttaacatgagtcttacaatacctcacaagctagtttgaaagatcaaaagaaataataaatagctttaaatattcaactgctttattacctagcatgaaattggatcctgagcagtatatacaataaactaaggcctttgttcctgcctttgggaagatgctagtctagatgggcatgacaaagtttaacaccacaaatgtaaaaagatatggtataaaatgtgtgggatgattctcaatttttttttcctagaacatagacattctgtgttgaagaagagattggctcagtagcaccaagcaatgacatgtctgtgaagcatttaagtgagaaggaacctgtcttctggagcagtgttttacaaatttggcaatatattggaataaacagtgaagcttttaaaaatcccgttacctaggccacatccaaagctaattatgttagaatctgtggaagtgagatttgcgaatcagtatttttaaaatctttccaaagtgattccaatatatagccaaatttgagactgaatctccaaagctgtgcttctccaactcaaatcacctgaaaattttgttaaaatgtaggttctgatccaacagggtctaaggcagtgcctgagattctgcattcctaaaacgttcccaggtgatgctgatactgctggaacaaggaccacacttggaacagcaattttctaaaggataaatatatcacatgtcaggtagtaaaagaagggacatggaacctatgtaccaagcagcatgctgggaactttacatttatcatctcatttaatctttaaaacaatcatgaaggaatattattactctcattttagaaatgaagagactggggttgagtgggtaaatcattgcctgaggctggacagcttattcatgatggaacctggatttaaacataggcatgtctaacagcaaagcccataggctaatagaaattgttggaaactttcaaatgctaagcagaagcttttcgatgtgaaatggtaggcagtctacagccataccactctgaaagcacctgatctcatctgaaatggtaggcaatgtctttattacttttcttaagtgcatggagattgtgcctacaatgatgctgagtttgatttcacactcctgcctcaagtagtatatataggcaggtaaagaaccaggtactgtgtatgcctgtaacctggggccatgctctctagtgttatggtatcaaagatatcctagagaagttacagtagaatgagaataaatactaatagcaaaataatagtgctggaagagaatgtcaaaattcaaaagtaaaacacaaacattttatttttcagttactgatatcaaaggattgttgcctctggagggagaaattgtatttcctgaaaatatttggttctaactccttgattcaaatgtccttccaaatgaaaatatctcttgattaaagagatgggaattgaaactagcgacaccaaataggcaccttttcaaaattctaagtgagattgcatggtggtccccagtttaaagcagccttatttgaggcaaatattctatctattttagacattgttttagacattgtagatatctctgctcctgtttgtttttttaagtgattttttttcccctcttctttcaggaagctgaaaaatgaactcttagaagcaaaacgtagaagtgggaaaactcaacaagaggccagcagagtttgtgttcactgtcacagaaacctgggcctaatctttgaccggggagacccttgtcaggcttgctcactgagggtatgcagggagtgtcgagttgcaggccccaatggcagctggaagtgcactgtctgtgacaaaatcgcgtgagtttcttgatttttcatggaaagtggagattgatgactgaagggattggagtggggaaggcaaaagagaaaaagagtattttaagtttaaggatagagagtgcaggtgaaattacagcccaatcacaggcttagcaatgccttggcagggctctggggtgtgtgtgtgtgtgtgtgtgtgtatgtgagagagagagagagagagagagagagagagagatacagaaagaatatttttttaaaaattgcaaagcattgtaaaattggaagcctcactgaaccatatctctttctttttaatcattattaatattattattttagggacagggtctcactctcaccctggctggagtgtagtggctgttatcatggctcactgaagcctcgacctcctgggctcaagtgatccactcatctcagcctccagaatagctgagactacaggcatgcaccactacacacagctaattgaatggcagggtcttgctgtgttgtccaggctggtcttgcactcctggactcaagggatcctccagccttggcctcccaaagtgctaggattacaggcatgagccactgcacccggccactctttctgtatttcaaaacttcccctgagcatccttgtctcagggcccctcttggcttcacgtggctcctcagagggcatagataatttccctgagacattcttagacatttgaggtgactggcaatatggttctcacatgttcagcctgctctgcacatcagctgacaagcaaagctggagtacttcccgaatttcctccaaaccgaatttcctccaaattctttctcattccttgagaaagaatgaagggagagaaccttcccatttgcctctctgtttagcctgtgggagtgcagtaagcacaaatttcactttgccaacttgggtgaaagccaagagtcattgttttctcagttcagttaaaccagtcttagtctgattcagtctctactgctcccctccttttgagaaatttcccctgaatccactggtatgttttctccctcccagtgtctgtctcctctgctctgggaggtgcctcataatctcatctcaaggcagctgagtgttcatctacctttcctgtgaatccaattcattggtttttgttttgttttttgcctagttaactcatcctgttacagtagtttaggggctgtcttgggaggaaaagtaaatagtgagatagtagaagtgatctttcattttcatcttctctaaatgaggactaccgttctgttgaagacgcctatattcagtgcttacatttttagccaatgttatgttccctgtactgtttcacaaaagtgatcctgaatagagcaattcaaactatgttttaatactggattgagataagtagggttatttttgtgaatacatagcaggtatatatatttatggggtacatgagatattttgatacaggcttgcaatatgtaataattacatcagggtaaatggagtatctattacctcaagaatttatcctttgtgttacaaacaatccacctatactcttttagttatttttaaatgtaaaattaaattattattgactatagtcacccagttatgctatcaagtactagatcttatttattctgtctaactatttttatacctgttagccatctccacttcccttgacccccactacccttcccagcctctggtaaccatccttccactctctatgtccatgagttaaattgttttaatttttagctcccacaaataagtaagaacatgtaaagtttgtctttctgtgcctagcttatttcacttaatataatggcctctattttcatccacgttgttgcaaatgagtggatctcattcctttttatagctgaatagtactccactgtgtatatgtaccacattttcttcatccatttatctgttgatgagcacttaggttgcttccaaatcttggctattgtgaatagtgctgcagtaaacatgggagtgcagatatctcttcaatatactgatttcttttcttttgggtatatacctaggagtgggattgttagatcatatggtagctccatttttagtagtttaaggaacctccaaaccgttctcctagttgtactaatttacattttcaccaacagtgtgtgagagttccttttcctccacattctcaccagcatttgttattgcctgtcttttggataaaagccattctaactggagtgagataatagctcattgtagttttgtcatgcatttatctgatgatcaatgttgttgaacaccttttcatatgcgtgtttgccatttgtatgtcttcttttgagaaatgtctgttcagttcatttgcccattttaatcagatgattagatttcttcctaatcagattattagattttttgtagagttgttcaagctccttatatattctgattattaatcccttgtcagatgggtactttgcaaatattttctcccattctgcaagttgtctcttcactttgttgactgtatcctttgctgtgcagaagctttttaacttgatatgatcctatttgttcatgtttgctttgattgcctgtgcttgtggggtatttctcaaaaagtgcttgcccagaccaatgtcctagagatttttctgcgaagttttcttatagtagtttcatagtttgaggtcttagatttaagtatttaatccactctgatttgatttttgtatgtggtgagagatatgggtctagtttcattctatgcatgtggatatccagttttcccagcaccacttgttgaagagactctcctttccccaatgtatgattctggcacctttgtggaaaatgagctcactgtagatgtatgtatatgtttcttcattttttattcggttccatcggtctttgaatctgtttttatactagtaccatgctgatttgtgtatgctatacagcataaaaacatagaaattatagttctgtggtataatttgaaatcaggtaacgtgattcctctagttttgtttttgctcaggacagctttggctattctgggtcttttgtggttccatgtaaattttaagattgttttttgcagttctgtgaaaaatgtaattggtatcttaacagagaatgcattgaatctgtatattgctttagataaacagttttaaagaaacgaatcttttaagttcttttattacttactttggatacgttattttgatttacttaagcaattattctcaattctttatctcacataaataaatttttcttagtcctttctgtcatcagcaaacttccttctccagatctgggaggatgaacagtgatgaaataaacaatatatggatttcaacataatcttttactgatttgaaggagctctttatatattctacgtacaagctatgttggttacctatattgcagatatcctctctcacctcctgacttggctttccattgtcttaatggtatcattttatgaacagaaatctctactttttagtagttccatttgttaattttttcctggattactagagggatttttttctgaatcctgttgaagaaaactttccctaacaccaaaatcatgaaaatattctcctatgtgatgttttataattgttattgtcttaccttttatctttaaacttataatccacctgaaacttattttgtgtgcatactgtgaattagaaactgatttttatattttaatgtgggaattatgcagtggctgatttgagtatcctagataactctattcaatgatgtttgttaattgcattgtccaagtcttccatatacttagtgatttttaatctgcatatccaatcagatatcgagaaaggtatgctaaactctctcaataataattgtggatttcttatttatccttttagttttgattatatttgctttatatatttagatttactacagagttaccctttccactgctctttattctttgctatatctctatgcttccatcagaataatttttcttcttcctaaagggtaccctttagtatttcctttagtgtggctttgctggtggtgaatactctcaatttttttcttagcatggctttatttcactcttaattttcaaatgtgtttgcactgcttattgaatcctaggttggatgttattaactttcagtaatttgaagatcctattggcttctgatttccagtgtttttattaggaaatcagctatcagtatattattgttcctttgaaggtaatatttttaaaacgtttttaatattttcccctttttgtcgtgttttcaacagttactataacaaacctatgtctgattttctttgtatttatctattttgatgttcctagaacatcttgaacctgtacattaatatcttttgtcatatttgaaaacttctcagggaatatctctttagatatttcttttcccccattatctgtctcctctatgccaggtagtcaagatatgcatcttagtaatattcagcatcttttagatatctttatgctcccttctgtatttgttatccatttacatctctaaactcagtttgtatattttgtctgacctatatttcagttcatgaatcctgcctttgtgtctaatttgctattaaacacatccatttaattcttaacttcagttactgtgtttttcaggtttagaattttcattttgcctctgttatgttttctaaccgtctgctgacctactcatttttttcttgtaatttcttgaagtaattatttggaattatgttaaaatgtataaattatagatctgttatctgagtcccctacgggactacttctattgtttattgtttcttgtggttttggtcatgtctttcttcccgtaaacctagtggttttttattgatggccaaaatatatgaagaaatggtaggacttaatgagactctgtataatatgcctctattgagaatgtacatttttcttctgaaagggaattaggataaggctcttgcatatttaagattaccttaatcaagtcaaggattgaactaatttcaaaattgggaccttggtccccatgagggctgatctgtttctggatcacataaactcatagggaatactccttcagagactcataacatgcctattagataagagaggcaattggttttatattttatggatagtgtaaacaagaacgctaagagttagatgtgtgttagtagagttgggatgagtttaaaagttttggggttttttgtttgtttgtttgtttgcttgttttttcacacagctcttttcccaccagattctgccaagatgagattttccattttagagcaatgaagaagaaaattgaattttaactaatgactgatttgctagtcctcaactatggagtctgaggatttatgggggaatttctcaataactatttctctaaatttataaaatactatttgatcgttagtatttatttttgtcatttatattccatgtttgttcaccctcttctttacacccaaggccctcactcacttagacaacagtaaccagggactgtgactcaaaaactcttcaatcaattataagtcatcttaagcttctgtaccgggagaagaattttatctttaacttctaaatatcactatctaaatatatctatctaaatatcattacaaggtaattactgaggtatacttttcaatacaagatccaaggagattgtgtattcacacattttgccatcaactaatctgctagttagtacggatgataactagaggcctaagtcactcataccgctctcctacattttatcagattaactttaggttattttaatgagaaattaacttttaatataagtcagtggaattcggagattgttttagaagctagcctacccaaattaatataaccctttcctgtggtttttcccttaatacttacatgctctatattttacttatttatcttattatttttctttctccactagaatgtaagggcaggagtttttatctgtactgttcactgatgtagttctagtgcctaaaataatgtctatagtaggtactcaatgaatacttgttaaatgaacagatagatgaatggataaacaaacaaatgaacaattgaatggatgaataaatggttggcctctacttaaagtatatcaggcttaagcaagtggaacaaatgtagaacaattgtggttttcttctgtcaggagcatgggattaaaaagaaatgagccatgccaaatgcatttgccctctgaacaaagtaaattcctaactgtcacgtaaagatgtaacataagttgttgtcagagggtataagaataaataataacaaatcaaaacttccgtgtcttccttgggacatgttaatgcattgatacagaacttctgaatcaattgcactaattttattggtgtaacaataatttaatagacccaaatatccacctatataattaatccattcattaacccatccatctatctttcccacacatttattgataacctgttaagtatactagggactaaggatacaaagttgaataaaaaatggtctatcttcaatggttacacagtataaggaggaagatgagtttattattttattcataaatttctgtcttgatgcgttaaaatgtcttaaggaagaaacagctctttcaatgtgtgattctaacccttctatgacaacaacttgtcttttagttatatccttctgtgacagctagaaatttacatgatgagtatttaatttgatatatcaaaattacttctcatttttaaagctgaaaatcagagtacattacttctccaacattgcaactgttagtctgtgtgatattagagacttaaactatatctcagtattggaagtatcttgtttgctattcatggagtggttttcaaaacggaagcataaataatattttattggcagcaaacactctttgtttattgtgagagaatattgcagccccactgagctgtctctatatttaatagaccataaaattgaaattcccaccctgacctctaagagatgagatgagtcagaaggtgactcactctctaatcagttggaagtaaatgacctttattgtcatttactttggattgggtaaaagtaaagagcttttattgctttagcactgaaacgattacagcaaggactgacagaggaaggttacctgttataatgggctgagcaggccctgacattttctccaatcccttctgattccaacaagttggctattgtaagcctagtttttaaactctataaaaaacatgataaaagggaccttgacacagccagttaattcatttttctatcttaataatacctacaaaattccacattgttatgttagctgaggcagttgcagtccaacacaaagacagtcataatgatcattttttctaattagtacccaattgaattcagaaggccccaaagataaaagcaacatgagttggaacaaaacatgaaatattttttctttttttcttttttttttgagatggagtcttgctctgtcacccaagccggagtgcagtggcgcaatctcgactcactacagcctctgcctcccaggttcaagtgattctcctgcctcagtttcccaagtggctgggactacaggcatgtgccaccacacccggctaattttgttgtatttttagtagagatggggtttcactgagttggccaggctggtctcaaattcctgacctcaagtgatccacccacctcagtcttccaaagtgctggtattataggtgtgagccactgtgtcccgccaaaacatgaaatacttctaatatggcattgatgggcagatcttatattcatgctatgttgcaacatattaccgtgctatatgtccttgtgagaatctttgtctttttaaattaggaagatcctgatgatatttttatttttgattgattggtaatgattactgcaatggataaaatataactgaaatagatgaaaaatactgagtgtttatcagtaaaatagatttcaaaaaagataatactgatggatggaacatacacagagtgcagaagacgatgtatacacctttgttataagaaagagaaatacagcccctgacatctggaaactgggctcacactgacaaacctagtcccttgatgttaagagctggtcttgcacttacaggtaggccatactgttatcctgttggacatcaagcagtctcagggtaccagaatcccacaagatcattctacaacaataataaagtaaacaaaacaagaacactttgtaatcttatctaagcatagatgaaaacaaggtgactgttgaaaccgcaaattaccgaacatccccatttcttgactaatgtgaataacctcctactttcttaccaattagagctttagcctagcattagtctgccatccttctaaataaaatttatcaagataccaatgttagaattgtccccattctctgacatcgcttaatccagagaaaatccctgctccatctaactctcccgaaaattactaacataaacccaaatcctatagtaaatcctttcaagtgccctcttactgagactctccatgattcctcatggtatgtggagttttttttttcattattatgggcaaaaatctcaacatgtttgtccataggtgggacgagcatctggtcatctttggcctgatgagtgagtattggtaattgccacataggtcatttcaaaatcacttctaatttagcaaattttcatagtgcagctacaagggaaagattcatattggagtagtcctacatttacccaaagatttcttgaatggcaagaagctatttttagtcccttgacatgctattttgcatcaactatcaattatatacaagtgcctccacgcttgtatagaatgaggtgttcactatgagtatggtaccttaatagctatataaactagaaagatttttaaatctaaaaatatagtacatatccaaggtactctataatacatatagtttaaacaataataaaaatagcccctgtgtattcattacccagtctaagaattagaacatcttgttttgtatttttcattcccttgctttactttatggttttactgcatttggatgtgtctctaagtaacatgttttctagttttgtatttttgaatattatggaaatggaaatcatactacctgtattcttttgtgatgtttttatctcaacaacatgtttgtgaaatacatccatgttcgtgtgaataacattacattcatctacactgttgttacattcccttaatgcatctattttctggtcaacagacatttagattgtttcagtttataattttaccaaaaaatgctgccatgacattcttatacatatggcctgacaaacatgtatgagtgtgtacactcaatggtgggattcttaaatctgtggatcatgacctattggtaggtagtaactagcattaaaaacaagtggtgggatttttaatctgtggatcatgacccattggtgggtagtaactaacattaaaaaaaagtggagtaaaaagtgtcagtatagatatacatatatatatgtgtgtgtgtgtgtgtgtgtatgtgtatacttatacatgtgtgtatttattttctgagttgtgacataaaatgtatttcttattgtgacctctgccaaaaatgcttgagaagactacggcagattgtgcatctgggaatgaaattgcacaccaaacggtatgagcattttcagcttgacaagataatgttaaattcttttttatagtggttgtaacaatcaaaaccccactagcattgtataagtgtttcctttacttcatgatcttaccaacacttggcttcatgaacattttttattttttccaaaccgatagatataaaggaatatctccctatagtttcaatttgcattttactgcttaagtatgaggttgagcagcttttcatatatttattagctttttgtggttctttttctgtgatatgagtatttatgtgtattgcacaattttattttaggtgctggtcttttccttattaatttggaggtactctttatgcttcccttcatctctaaatatgtttttgctttgaaggctattttttctgttattaatacaattacatcaaatttcttttggttaatagctgcatacatgtttttccaacatttgactttaaacctttctgtgtccatatgtttaaggtgagtctcttttatgtggcatatgtattattttaaaatatagtatatgttatatgtattttaatacttgttatacttatatgctacatacattacatatgtgctgtatatacatatacctgatatatatactatatgtaatttttaacatttaatctcataatattgtttcttaaattatagagtttagtctgtactcactgattactgcaatatttacatttatttctattatcattgtgattcctgaaatatttgcatttatttattttatctgtagattcattaaagtgtatttttctcatcccatgttatcctttctactggtattcgtattatatgcttttttcattttcagtggttaccctggaaattataacatttatatttaactttgcaaatcaatagctaaaagaaacttggtattcttgaactctaaatattattttcctggctgatacataatttttgtcctttgttttagacatttcttattgtataatccaacaatttatgtcatctcatttttctttataaatcaatgtttgtttagatttttatatattttatcaatttcattgttcaccatttctttttatacctcagacctattttacctctcctgaagtatagtctttaaaagttcctttagtgagaatctatttggtgataaattatctgttttcattatgttgaaaatttctttatttcatcctcattcgtgaacagtgatttctgtggatatgcaattctagattgatagtattttctcccagcactttgaagatgtgtcattggtttctggatttcatcattgctattaaaaatcaactgtcatgctaattgtggttcttttgtaggtttccttttgccttcctggctacttttaagatgttccctttgtctgtagtgctctatagtttcaccataatgtgtctaggggtttcttttcacttttcctgcttggaaaggaagaaaggaataaatgtacaccagcatcttcatatggccaaggtccttgtttgtcttcttcacctctgtattcttagccttagcccggggcatgacacatagtagaaatgcaataaatatttgctgtgtaggccgggcgtggtggctcacacctgtaatcccaacactttgggaggcagaggtgggcggatcacttgaggtcaggagtttgagatcagcctggccaacatggtgaaaacccatctctattaaaaatacaaaaattagccgggtgtgatggggcatgcctgtagtcccagctactcgggaggctgaggcgggagaatcgcttgaacctagaaggtggaggttgcaatgagctgagagcatgccactgcactccagcctgggtgacagagtgagattctgtctcaaaaaaaaatgctgtgtaattaataaatgtataaaaaaattgaattagtttccttatgaataatagaaaggaactaatatcttatctcagagtatctaataagcatatcttgttgcagatgtctccagcagttaatagaaaataaaggagcaaaatgaatcttttggtcattattcttttttaagataagattacctattttcccctgtaaaactatagataatttaatttgactttacattcatataagcttccaagtgaaggcttgaaaagtcccagaggtttagtgttaaagaaaaccaggacaaaacaaaccctgaactgtcagtaatcattattcacaaataagtatagcccactgtgattttaatcaggcccattcttcagagtatgacttacagtgcataaagtctatgtcaagtcttgtgtttttcaaatactagattgacatgacagagagggatataaattttatagtgggtgggatttttattttcttttgtcttttaccccttctgtattcttaccactccaccctcaacacacaaacatgcacacgcacacacacaccccacaatcacagccaatcatatgcaatgctatgtttgttattccttggactctacaggttttcacccttcctcaaagccctgttatagttgacaagtatgagttctcttcagacaatttttccaagtataaagcatgtgggatttcaatacaaatcctgtctctgacataatacctttataactttgggcaaattgtttaacctatgtgagctttagtttccttgtctgtaaattggtaatggtaatagatacttcattgcttatagtgagaattagagataccgtatataaagtgactagcctattacttggtgactgacatgcactcactaagtattagtttcctgttctaccaagccttctgtctgcctcctgacaagacgtgacacctgagagggtgacaaaggcataatctcaacaatctgttctggtattttctctgaaatgacaaatgactcaagtgcattatctgagttgaacaaatacaagacttatagttattattctccaagggtagcaagaggtaatgactaacaattctgggaagatcttatttgtgttaggtgttggcagctctaagcatgcatggtaaaagtgatatggaggcccatttcctggagaatgtagactggatgtgtccactttcttctgtcacacatgaaactgctgtcagtatgctatctactccatctcacatccaaagaacatatcaaaaaaaaaaaaaagatctaaggccttggcatgccactatttagcaatttttagtcactgaactatagtattcccccttgttcttatttctttttgtgtactctttgcctcctgcaaaagttaaaaactcttcttttttgtaataaaacaccagagagcaaatattttaggctttgagagctatgtggtctaccgctgcaaccacttagctttgtagttgtagcacaaaagcagccaaagacaacacataaacaattgagcatggatatctttcaataaaactttatttatatgatcaatgaataaaggactccctatttaataaatggtgctggaataactggctagccacatgcagaagaatgaaactagacccctatttttcactatatacaaaaattaactcaagattgattaaatatttaagtgtaagacctcaagctatacaaattctagaagaaaaccaaggaagtatcattttgaatatcagccttggcaaataatttattactaattcctcaaaagtaattacaataaaaacaaaaattgacaaatgagacctaattaatctaaaaaattttacacagcaaaagaaactaacagagcaaacagacaacccacagaatgggagaaactatttggaaactatgcatccaacaaatgtttaatatccataatctgtaataaagttaacaagcaaagaagcaaataatcccatttaaaagtgggcaaaggacatgaacagacccatctcaaaagaagatatacaaggagctaacaagcatatgaaaaaaatattcatcactaatcatcagagaaatgcaaatcagaagcacaatgaaataccatctcacaccagtcagatggttattattaaaaagtcaaaaaattacagatgctggtgagtcgtggagaaaaggaaatgcttatacattgttggtgggaatgtaaatttgttcagccactgtggaaaacagtttggagatttctcaaagaactaaaaacaaaactattataccattcaacccagcaatcccattactgggtatatacccaaaggagaaaaaagtcattgtacaaaagcacatatacttatatattcacagctacactattcacaaaagcaaagatattgacttaacctaggtgcccatcaacagtagattggatcaagaaattgtggtacatatacaacatggaatactatgcagtcataaaaataatgaaatcatatcttttgcagcaacattgatgcagctggaggccattatcctaagcgaattaatgcaggaatagaaaaccaaatactgcatgtcctaacttataagtaggagctaaacattgggtacatatggagataaagatggcaacaatagatactgtggactcctgggggtgggggcaagggttgaaaaactacctattggatactatgttcagtacctaggcaacgggatcgtttataccccaaccctcagcctcacacaatatacccacgtaacaaacctgtacatgtaccctattaatctaaaataaaagttgaaattattttttagaagaccctatttatagaccctgaaatttgaatttcatatacttttcacatgtcattaagtatttttattttgatttttttcaaccatttaaaaatgtaacaatcatttctagcttgcaggctgtacaaaatagatgatggggtgaatttgacccatgggccatagtgtgcctaccttttcccttttgtttctgaattttccttattcatcttcttacaacctatgcaatttcctgagttgaatattagaacaaatatatttctatgttaacttatcatagtagttttctattgccaccttaactattactacagcttagcagtttaaaacaatgcaaatgtattatttcacagttttggagctcaaacgagtttgactcgtttctctactccaggttctgtaaggctgaaatcaaggtgttggctagttgagttcttttttctataaagagattctgggaagaatccacttccaagttcattcttgtggacagaatccagttccttgtggctgtcagaatgaggtgctcatttccttgttgactgttcacggaaagccattcttagctcatagaggtctcactttccagtcattgcctgtggacctctacacctcagagctttctcagcacataaaatctttctcatatttgcaatctgactttccattctgcattgtctttactgacttcctcttcttcctttgtgtttaagggcttatgtgattgctttgggcccatgtggataatctaggataatctcactattttaaggtcagctaattagtaacctaattccatctgtaatgtctgatcacatcagcacctggattagtgtttgactgaatagccaagaaacaggagacatctttcgaatttagaataccacaattgtcacctggatttccaacactgtgatacataagtctatagatcacttgaaatgtatccagaaataacttaacccattcaagcttttggttttggtaggttatatcttagatttgaccgtattccataagcgtattttatatagttactgttatggagcttatccaatagtctgggcttctcaataggtaatataaccacttgggagtaaatctatggtagacaaactatggtcttacctttcaatgaatacttttctccaaggttaacattttcactttttgccagtagtggaatggtgtttcatatataatttacctttgcctcagattccgaagcagatttcaggataattgctgaacaagcagatttcaggataattggggaagaaggttgacatatttttcaagagtgacttttctatttgagatccagctattgattttcaagtccaataagttgctgaatcaaatggatataatattctggggcttgaaatgcctatttgactctcagttgcttttcctcagccaccatatcagacatgtcaccaattcttactgattctcattctcagtgggccaagtgtatgtgtctttccctttactcctcacctccatgataccctgatttgcatcttcatcattttctatcctctttattgtttaactttctaatttgcctgcctacctctggtttctctcttcttcatatatttagccagagattatgtgattcaatctgaactttagaaaaactgctagaatgacattccacctctttacctcagcattcaaatatttgaccccaaatcctaccttttaactccagttttcaatagaattctccacaaatcctttaccgtagttacatagtcctatttactattttcagaacatgcccatagaggttttgggacaatagtgctcacctaatcagctaaagccatttcttaatttttaattagaaatatatttagtctaccgaatgacttctacagctgttaaaatccttgtgatatgccagaaaaggacttttatagcagcataactactataggttgaattccaggtattctaattcattccacaaatatttcctgagtgccagttactgctcctggaaatggtgaacaacacagccaaggtccctgccctcatttcactgatgataataagaactatgagaatatgaaaagaagggtaatgtgttaaaattatgagagagtagtcattcatttgaaaaacattaattgagatcgtggtctgtgaaagactttcttgtaggtactatggaaaacaaaagatgaagcagacagaaatcagttctcagagcatttacaacccagtcgaaatgagagggtagaaataatactgaaggacgctataagtaatgggagaagtacagacaaagaagaggattataagcatttcaggagggaagatgggggtgatttcatgtagccattgcaggtagggtttaaaagatgggtgtgactattcaaggatccttctttcccatctttaacattgaacttattaccaaatccaggcaagcacttccaccacctatgatctgaatttattactcctcttttagtcttaccattgccctagcatgggtgccatcatctgtctcctggactattacaatggccaacctgtctctttatcctattctctcatcagtctaacccactgtacatgttatatcaaagaatcttttcatcacagagatctgatcataagtctgatcacagagtctgatcatgacctctttttcattccaaacctttacttgatccctattgcttgcattgaagatcacttatccactaatgcagtggttaagaacttgagccccaggtcagacttattgggatgggatcctggctctgctacttaccagctgtgtgatatgaggcacattattttattgctctaagtcccaatttcctcatctataacattaggataatagtgtttacataaggttgctatgtggataaaaatatatgaagtatgaaccgtaattagcaagtacctagcagatagtaaacattcaattaatactggctattattatcaccataaaatactccagagattgagataaactttataaataatttgctgttttcagtttattagggatttttgagagttaattatgtggctaaataattgaatttcaatgctcttcccttttcccttgagtaggcagctaaggattataactggtgagtggttttttgaagaaaaggcaaaacgtttcaagcaagtcaatgttctcggcactgatgttgtccgacagtccattttaagaagaagtccaggtaattaaagcaattatgtggtttcacaactgttttcatctccatttggctaactaaataacttctctatgttatgtagttaatcagcataaatgagtttcttgaatcccttagggcatttcacaacttggtagcatgaaatctagatacgtaattcatacaagacaagaagaagtcagtagaaaacaaaattcacaatgattttccatatatctcacccactaagattttcaaagaaaccatttgtctccatcatagacagttctctttctgaatgcatccaatattttactaaacacttaaagtaacataaaacagatgaattaaatgattcacattgtgaaagcaatccttgatttttcaacaatatttatttccgatttcctttcaatgttactttttaaatccagtggttctcaatcaaagattgataatatgtaccttgtctccctccctcaaaatgggagcatttggaaaggcaaggggggcatttctggttgtcacagtgactggtgagtcaatggcatttggtgggaaggagccagagatgctaaatggcttgaaatgcatagtcttactgaatgaatactggcaccaaatgaaaataacactttaccttgacagtgccttttggtgcattcaaattacaatttagttaattaaagatggagtaaaccttgtgattgggagcatgtttctcgtatatggtgtagtaaaagcggaagaaacatctttcagcctgtttctaggcttatctcatctttcatccagaggagacaagtgcccttgtatttaagtctggcacatatggcgagaaggcttggaactgattccagtggtacttctgggtgtggcactagcaaggaaaggcttttccacataggtcacacagatccgatactacagagagatggtgtggagtacagttagaattaggcaatcagccatggcctcttcttccactcaaaccccagtaccttccagaatgtaggcagttcctcaagtcacaatatatttgcacagatgcccaccctcccaggaagtgtggcttatatgcccagaaattaggacatcatttctacaacctcatgctagaactcagtctccagggatttggagatcttaggagaccatgttcccctgctctaaaaatatcaacagaaggctgatgcagtcatccctaggaaggttatctcagtaaacctcccacagatgagttcaggatctttgtcttcagttaactctagaacactcaacaaattagaactaactgtgtgacagaaaaacttgggatgggaatggcattgccaattattatagacttccttgccctgagctaatctgggaaagtgaaagcagaatataaatttgctctcatttctggccattttgtatgtaaatttctcttctgattgtttgttaatgaggagctgaagaagtacagagccaagagcaaacccgccaggatgcagaaaagtcagacacttcacctgttgctgggaagaaggccagccatgatgggcccaagagaaaggggtaagacatggtctttctgagggaatttttgatctttattccagacacctctgaaatgaagactccttaatttttcaagtttgatgtcacttcaatgacccagaggaggtcagagactcaaacaaagtaacactttcttatcattctcctcaggaaatgcagttttaataattttcaataagtaaataaaagtcctgtctgacctaagcacagaagagttttcctttcatttgacatatccagtcttgcactatatggttcccattacttataagtagaaagtttcatgccaggatcagtctataaagaggtgacaacaatttctgttgtacaatgtcaatactcctcccctccaacctgtgtgctgatatataattttatccaaaataaagatttattaattgagcttaaagcaccatattccctatttaaaattcaggcttccttaagaaaaaaagtcacatttggccaccacagtaacttagttcagtaaatgaatacagaatatggatgccaagtactgagaataggaatgggaggtacataagggagcaagaagtttctttcaagggagaaaagtggatcccaaaatataggctataaggaccaaaaggaaactgcatttttcagtttttgtttctcatgcagctattggccagtttttgtgactgaagtagtgagagttctaatgtgcaccaagtcattttatggtcctttctgtttttttattattattgagatggggtctcattatgttgcctgagctggccttgaactcctgggctcaagcaatcctcttgccttggcctcccaagtagctggtactacaagttgtatgccaccatgcctgcctaactttatggtccttttcagacagcattgcttcattctctcagtagaatgcaaagtgagagggcattagtgttagaagatttatctggctgtacaaaatgtctagggttcttttagaatcttgggctgtcagtaggaatacaatctaaatgtcatctaactcaagcactcatgacaaaccatgttttcattgatgagcagagatgagttggaaagatagcctagagtatcctgtatatcctatcctatgtattgatccttcctaccatcttgagttcatttatcactctttgggtcacccacaatgctttgtgcctttgcaccaccaatcatattgcactctgacaccccctcaacacacacacacacacacacacacacacatgcacacacttaattgtaagcttctttagtggtagaccagtggtttctttgcttctgtgttgcagtatctagcatggcacctgactcatcaaaaacaatcagtggcttgattgaataagtaactcagagcccacaaatgcctctaggagttgtcatttgcagaccccagctcaggcatcatagagtaggttacagaatagtggacttggagataggagacagtaactaactcaccatcacaatcaattatgcaaattctgaatcattgaaaccattgtagcactgggctgagccttagattctgattgttctcagtcatcaaggaatataacatctatttggggagaaaaggtacacacctgaaaagttactaagtataaaagaattgcaggaaaatttaagatggcaatgtgagcttcctaaaagcctttctaaaacagaggagggtgttcaccacaagagatatcctaaggttataaattactgagtacatataaataagcaggtggacaataagtgccagttgagtataggagtcatccagaaagacatcaaattgtacatgagatttgaggaggagataaatggggttcaggatcacaaaacggaggaagagtgactccaggcagaggagataccttaagtagaggacatgcatgaggtggttctcagagcagcataccttgacattatattaagtgctattctcaccaaagaaaaaatgtaattttccagtagattaaagcttcagatgctttgacaatgacactattccaggagtctttgaaacagagacaacatggcagattctattaagattgtgccagtacctttggaatccatgttttcctctagaaaactgtagaatgtaaatgaagtgtatctcccaatgccattacaaaaaggaatatagctttgattttcttattcaagtacatttggaaacacccatgttttgggcacatggtatcctggatcaggactttaagttcctaaaaggctgtttctgcttaaaccccaaataatttagtgaaattggaaggtaatcagattttatccaacatgaggcacaagaataaatgtcatggaagataataaagatgagtttagtcattcgttccacaagagttggttggattccagtataagccaggcatcattctaggctctggaaatctgtcaaggaacaagaaaggcagagtcactgctctcatggagctgcagtctaataagcagctacctcagtttgtccaagaggatcatcctggcttccctctctgagcaaagggagttcaaactctctattctcactattcctgcaaacaggcccaactcagggaatgcatcttctttctcaggtgacagtgctgagttctcagaataggcagtcttttgcttagtagtgacctaccagcaagtggtacggtcttgagagaacggcgtaaccttccccattatcacccttgatactgtattgcagaggcactgggaactctccagaacctctcagccctaaggctgctttattgaagaatcctttattattaaaagtactagaaattgtattcttgaaatgatatttttaaatgctttctttcttatctaattttaaatacatatatataatttcagatttcttcttagcaagttcagatcggcaaccagaggagaaatcataactcccaaaactgacactgggcggagctatagcttggacttagacggtcaacattttcggagtttaaaatcacctcctggttcagacaggtaagagtcatacagattgagcaatgatgtagcctgaggttaaggttgatatattcccattcatagggggattttaggtatctgtgaaatattaccacttggagaactcctaacacataatgtgaaaattcaggaagatattttttagttgatatggaaagcacgtaccctacttctagaattacagctattggaattgcctatgtcacctgcagggatgaaactttatattctggcacttggggctgcagttcaaatggaaatgtacagggcaagtaaatgtttttcattgacttcttgagctttttctatttaagctcctgaaaaaaagaaacctctgagtgtcaaatacattccttgcagcttttaaaaaattattaataattttaaatttgaatttcctcagagactttttcataaatttcacttcctttctagttccacctcttctaactggaggagattatcagtggagccaattgagaatgtcctatccacagatctatcacttgtcaagaaaaataatgagaaacacaaaggatagcccagagcatagtcattttatatcaggcgtgattttctgtatcctattggagcatagtcaagacttattttcatgattagtgtattatcaaagctagcaatgagaaaaaaatatccaccttcatatttcactggtttgtccaattgttaactccctttcgtttgcttgtgtctggggtaattttgcaagccagatagtacaagtagcagattttcttttctccttaggttaggaagaatgcaagcagaattgcattcttccctgtaatccattttagaatgcagaccaaaaaatttccttagaggggacactattttgactattgggttattttttcatggtgactctccatagctgtttcttttgtccctataacagtcctgcatgcaagcgttactttatgtaaaaccatacagaaaaaaaaaattacaaggaagcgtaaagtcatttatcacccattatcaaaatattaatactgtattcagtatttcccaaactttcaagaatgctgatatattcccttttatgattacaaactgttaagctatggttgcctttatccttgaaatagtttcatttgtcttccattgaggtagcttcatgctgtgtcccacaaaactttctataaacatctcattttggctgggcacagtggctcacatctataatcccaatgctttagaaggctaaggcaggaagattgcttgagcccaggaatttgaggttacagtgagctatgatcatgccactgcactccagcatgggtgactgagcaagaccttgtctcaaaaaaaaatgaataaataaatctcatttttgtttttcatagttggactcctgactctgagatagtagtggtcaaaattatttagagacagtaagcaactaatttggtgttctttttgctcagcctcctgggactccatggatgagccaccttggctaacacttaaggctagcatttaagaaaggcaatatatacaaaaagaggaaagacaatgttccttgttttttgtttttgttttttttttttgagatggagtctcgctctgtctcccgggctggagtgcagtggtgcaatctcggctcactgcaacctcagcctcctgggttcacaccattctcctgcctcagcctcccgagtagctggaactacaggtgcccaccaccacgcccagctaattttttgtatttttagtagagacggagtttcaccgtgttagccaggacagtcttgatctcctgacctcatgatccacccgcctcggcctcccaaagtgctgggattacaggcgtgagccaccgcacccggccaatgttccttgttaaagaaaaaaaaaaggctgccagcctaacaaaattagattgtgctattttaagttatatgtcttacagttactcaacaagaataatagggagcatggtctccagtatcagtgcttataccgtaatggactctatctgcctcagtttactctttgtgtattatctactactaggcataaataaccaaaactataaagccatatggacatgcatcaccaagtactggtatattgacccaggagcttcttgttctttttgtaagctgaaagaaagtccctaagtagactttatcttaaattgtaaatacctgaaatggcttacacatagtcagaagtagccaggagtgctttggcttaagcatgttaagaacaatattttgccactaagaaagtgagtaaagatgctcaggagatcaatagagcaaaatgtcctttcccttgaacgtgcatttatcacagtgatgactcattaatggactgccacagtgagatgagttccattatttcaaaatgagtccttagaaaattgaggcaggaggtagcccatcttttcttaacttccatcatctgaagagactgtaagatcccagtctctttggtctattgcctgacccagcttactaatatttcccctttttcccttacaatgcatattttttcatggatcattggtattttcatggagcagctgggcttcggcattcctttttaaggctcacatcatataagagtgtaaatgatgttttatcagatgtgcagttggctttcttttcagtagtttcaaagcaagggaaagtatgaatagattaaagaagccctagcagcctctcagaagagcttgtcaaatggatgttcaccggttgctagggacttgacacatgagacaaagaatatttttaggaaaataaatgtaagctgtagttaataaacaatattattcaaggtagtgatttctaatccctacaaagttgtgatgagctgtcactgtggtatgatttacaagatctctaacttaagtcatgctctcccagaaacagacccctagacaaggatttataagcaagtgatttattattaatcaagtgattccaagagaaaccaggaagggagtaggagagacagaatagagaagaggaagaagctaaacaatggtgctagctccagtgtggtctgaggactcagcctgatcctgtaggagactctagagcataaactatatccctgagctttttccacattgaggagctggaccattgcactcctataccagtcagtcattgaccatggcctcccttgaatagagtctctagacttagcaagtgaagatacaggatgcccaggtatgtatagttgagactaacaactgttttttagtataagtatgtttcatgcaatatttgggacatccttatacttaaaattaatttttttatctgaaattcaagtttaactgcgagttctgtattttatctgacaactcttctataggggtgagggggagacaaactccagggcatttctaggcctccagctccagggctaaagggaaggtctctgaaggtggcaggtgacatccattagcagaaaagaactcaggatctagggaggagcatgcacagctggtaaaaggaatctgagggagatgccaacaatgttatctttaaaaacagagtaaaactagaactttgaacctaaaatgcattttgttcagtaaaaatggaggaagaatgatgctgtttctcagtagcgtttctatcatgtcattggagaatatggcaatatctacatggaatgtgaacagacggtgggaccttgtttggtctcgtaaccaactaggttctcatctttctgccctcccactcctccactccacgcacaccagtttcatccagttattcctaattgctctccagtggatctgggactgatggtcacagtctctgtgaagcttcacaagctgctttgctttggctgtgatccaccaaaagcagagaccacaccattcaaaccagcccttagctagttcttgtcctcatttcaagcactgcccctctctttttctctctctgtccaggaaatatggcactttggatattatcatgaatttaaagaatcatccattcctcatatctattattttagtaaagtgagtttattaaacccattctatcactaaatgatgccttctttttcatcagaaataaaattattctcctgtcctgaatgtaattttcattgacatctttgcaattaaggtgccaattaggtggcagcctcttactagaaatttgaatatagcaaggtgggagtgtttaactctgagtcaggaccacatccacaaagtcaacaatggtctgttttgcgtattagataaaacattacatagctagttgctaatgctattagcaaactccattccttaccaggcttaaaaaaatgttcaaatgtatagcatatctctgaaagtatgtacatttattctataatgatcgttcggtgactcaacaggataaaggctgtgagcattgtcctccaaaggaaaattactttcacctctttcctgtgcctttccctcctttgtcactgctaattcctttttttccattttaatctcctttgggtaagctcagccctccttaggaggagcgaggggtgggcaatcaaagccacaagctgtagcaaatgctaacagcctaaagcaattcgcaaaaccatggtggcctgagaaaagtgaattttaattccagggagcaactgacacatgataaaacaggagaggaaacatgaattcaccagagtattttgttatgctgtgaccttatcagtgggagatacacagtctgaagttgcaaaaaaaaaagaactttagctagaaacttctatttagaactcaaagccatccttttctaaactcatcctttgcccaccatatgcacaaatatgcacttgatttgggctcctttggaagacaatcctgaaataaggattcaagagtaagtaatatgttcaggatgtggtctaaggaaacagagataggagagtggggaaatgagccagggaagggaaggcaggcaaaaaggatatgtcattaagccagttgttattgtgggcaactagagctcaatctcactggccaattctagaaaaccgtgctgaatgtacctcagagttatccagttaagagatagggaatctggggtatttttacagcagctctttgttcaaaatttattgagggctgcttctagggcactaactctctggcacttccgacttgccctgttcacaggggctccatgctcccatgagtcaaaaaactcctcaggcagggagttctgggtattcccagtaaccaagattctgtgggtagaggtaagtgctgaaggcaaatgggcagggacactgagagtctgctacaacctccctcccaaactgctctcagacctccttcaaagacgcagtttgtcagaccactgttcagcccctgatttctgtttactttatattatgtgtgactttcctcattataatgtcaataatgtgagaaggtatggaggctcagtaattcagccacacccatgcttcattcctgtgatcaaatgattgtaagcctgaagcctcctccttgctgttttgtctgtttctccaattgtttcccatggattcactgtcttggcatgctctatttctatgaactaaatctaacaccttcccctcctccaatttaataaattgctcttttactcactgctacctaaatatgtattatgtgacatgttaccactctcagggtagctaagatacaatagatagcctttcttcttctacagatcattgaagagcagagatatgtgacttggtcatctatgcattctattcatacaaatgaattcaacacacagctctgttaacattattgacctagtactatatatgccagatggtaaatgtggaagttcttagacagtaatactgttccacccttttatgagcttccaatttagcaggaaggctgggataactaaacaaataatttaaatacaatatagtaatacgattttaaaaagatgttctgcgtgctatgggaaaaccaaagataggcatttatcctttcaaaggattcaggtaagcttcattgaggtgatccctaagcagcttttaagaaatgaggaggacttggccaggtaaagaaagataggaagagcattctacacagaggaaataaaaagtacaaaggaaaatagacataaagtagactgtgtgctgaaaagaaactgttcagagtttctagagtataaaaattgaagtatggtgtacaagagatgaggagatggagaggtaagttggaccaggatgtagatggctttggatgccttaatacctatcttcttatatgcaatataacatcctactcagaacaagaggttggcaattctgaactactaagtatggagtaagtatttgttccatttagttgctgaaagttaagttctgttaaacactccccttttttgtgtgtctatgggggaaggtagttggctttcttcttgcccccgacttctaattgacccaaggcttttcatggctgctggcctctctcctcaaaacggcttctggtcattatttagaaataagacatttgatcagaattttaatgggatgctaaaaaacaaaaatattatcacgttgagagtaccacctgttcttaagatctacttcttcatacccagctggagtcccttcctcatggtaactgtctcctccattttagagggagtcttcttaaagggaacaaatccattaaggaaacactaaacattttaaaaccctcaaacaaagcagcttttgttttattaagtcaaattataaagctatttctatagttaacattaggattcatttggcacaatttcattgagtgcccactaccttatactactcttgtcctctttccaaaaaggaaaaggaagatatgtgcgagtaagccatagaaggccagtggcttcaggggacattgcagctacagaagctgcttgaggaatttccatgtctttctcatctctctgcttccctaattctgctttgaagtgatcctatgatggctcacttgggcctaagtttaacacacaaacacccaatacctgaaatttacttcttttgggtgtattagcttctccaaagagtttagtttttaaatagactcatgtgtgtgtgtgtgtgtgtgtgtgtgtgtgtgtgtttgtgcgcataggcactgtggtgttaatatatatatatatataggttttcatccatagttcctgcctcccaacttccatagtccttgttatactgttgggtcactttaggcctcagaaaacataaactctctctctgaccttctgctgtccttctttcacccgccaaagcaggactctaacctgattatggttcaaaagaccctcattccggaaaccctgcctcataacctagaggaaggaatgctacacagagaaaccaagaaaagtctgaacagacaagccttgctaggtttagatcatgcactttctgtccaatcacatttttacatggttgtcaatcatgcctatgtaatgaagcctccataaaaatccaagaggacagagttcagagaacttctggatagccacacatgtggaggtgccaggagggtggtacacacagggagggcatggaaactctgcagtcctatccccatacctcaccctacgcatctctttaactgtatcttttgtaatagcctttataataaactggttgatgtgtttccctgagttctgtgagccactccagctaattaaacacaaagagggggtcatgggaaccccaaattgaagacagttggtcagaagttctaaaagcccggacttgtgactggtgtctgggggaggacagtcttggggactgagtcctcaccctgtgggatctgacactctctttgaatagatagtgtcagaatttaattagaggacacccatctggtgtctgctgcttggtgtgtggggaaaaaccccacacctttgttcaccagagacttccgtgatgatcgatgattgttgtagtactgtgagagcagaggaaaaacatacttagagtttttccccaaactggcatacacacagagatcaaaaaccttttctgtaaaggtacagataatatttttgactttgtggtccatatgatctctgtctcaactactcaactttgctctcagaacatggaagcagtatagacagtacatgaatgaatgggctgcctgaattccagtcaaattttatttatgggcactgaaatttgaatttcatataatgttcatgtgtcacaaaatattattcttcttttgatttttttcaaccatttaaaaatgtaaaaactactctaagcacacgggtatatagaaacatttggtgggcccaaatatgtccacaagccatagtttgctgacttctagtgcaacacattcactcactaagacaaagtgtccttcagtgtatcacagtctgaaccacaagaacagcttagctcttttcatgtcagtactgttgaattaaaaaaaaaaatagtggtagaagcagagggagcaatgcaggtggagagatgtctgagatcaatgaacttttatccacagcttagcacagtggttttcagccttggcttcatattggaatcacctggggagttttaaaacatcctggcacctagatgccacacccagagagtcccatgtgactagcctcagtatagtctggacatgggagttttaatggctccccaggagtttctaatgtgcatctgaggatgagggccactcatctcacataagactattaataaagacacagcacttggggatcaccaaagactagaagattgagctacattcatttttagttatctctttcccatttagcaggcttatctcactttctaactgcaaccttccttggccatctttcctgcatattcattgtagatccaaaataactataagaagttaggaaagctcataaacctcagagagaatattttgcattgtctctgtgttgtactgcacattagtctcattgtcccagtgagttttaggatctctcaggttcgtgctgccttaggagagcacacatttaaccatatgggaacaggctcaacactatcagccactctgggaaggttggatcctgggaaattatttcctggctacaactcctaggagacctttatgtaaagcagaaaggcaattacattgtaatctctaccccctatccttggatcctctgtctagaaatggatgtatctgggaagctgttatcaagattttggagcaacatggtgctgtgctgaacccctattaacctcaatagggaaactgccaggttcaagagactcagagccagcaaacgagacatacaattttattagcatcttacacacaggggacagagtccagcagtggtgggctgggcaggaaaaccataaccgcttgcaaataacaatgcagtttatatagcattttcacttaaaaccttccccctaaacgacctccacctggaaaccttcatttaacccaaaactcagggcctcaatccccggtatggcccatgttccatgagaagggccaggggctcagatgtttttcataggtaagaaacaaacctcagggctggccactcctggattccctagcttggaacaaacattcagatgcatctgccacacagggtcattgtaagagtatactgaaatgattgctgtcagatgtgtttcccctacccatggaattagagataacaaaacagaaggcttttaaagtatatttcataaggtaaagtaaattaaactttttcctaatctggaaaatgtgtctttcagcaacccagaatatccaaactcccagacagtgacatatccccacatttgggccttttacagtgagataaatgtatctctttcttgccggtttttacttaaccacattttagcttgaaggtttgttggcactgatttatcatacttcttatttaaatctgagtaacattatagctggattaaaaaatagctttttcttagttgacctttacacttcacaactttaattttgacttgacatagcttttatcattttccaatttaagtggcaaagattcgtgtattttatgtcatattttacataccttctaaatgagttggcacacaaatatttatgataatatgccttattagactaaaccttttttgagtttaatcaactggaaaaaattttttgagaagctcacagtaaatgtcagggacaaatgtgaaattctatgtcatttttgagataatgctgctggcaatgataatttgcagtagctgacttacaatcacaagaattttttccttattacaggataacttcttgaatgtcatcaccacaattaatcaacttctgccagagcttctacataagtagcacttttggtttcagcaaggctaatccatgatggggcgtttctcaaaaccacctggctctgggaggaccttccgcacacacacaagcagaaacacccacatgagtccctttggttcataacttcttgggtcatttctgcaagattgacccctgccctttctttttaaaggatattttacctgaaacagtagggagacatatttctgtgttaacattgttctaaagaacctatggtcacagtacagcatcaatgggaaagtctctatgcctctcctaagtagaacctctgagatgagcagaatacttggaagggtacaaatatggctaactgttgtcaaatgtagaaatgtcatgcttcaggtagaagggttcaggaaaatcaccaaagaaattagaattccaaagtgtatcaatttacttaatcacaaaattttactctcttgtcagaatcaacaggcacagtcttagagatcttctcagctgagttcatagcactgtaatttacttagactgctatttctacaaagaggaagccagagatcctttctgcagagactgtttagtaaaaaagaaaagccaccctttagtaaccactctttagtaacatagaaaattttcataattctcttaatcaagtcccaagaaactaattcctagctctttgctcctttgattaacttctgtttgatagttcattctataaatgcaaaacctgcctggctggaatgatttgttcttagtgaaatgatgagtaagcagtatgagaaactagaatggtcacaggctttgggtagactgacaatactgtttttatgctgattttatcacatgctaactctatgatagcatagtggtatgtcggtgtgtgtatgcatgtgtgtttgtgtacatgcatacatgtatggaataattaacctctccaatactcaatttcttcatttaaaaatattaaataatattctaaaacatattttacaaggatattgggggatggaaaatggctaacacctagaagatactaagtaaatgccactgctattcatgattattgaaggtggtggtagctggtaatgtggtccaaaagaaatttggttttggtgacttctctggtgcacagctttgaaaaaacttaggagttgtggttgacagttctatccaatggtcattgcctattcttctgcctgatttatcttctagtaatgatatgtgcacatttaaacattcttttaaaaaatattcctttattctatttaacctttcctcttattggctcaactgtaagtcctcatcactattaaccactgctggtatgctttaccaataagatgtgtactattatatgtgcatttgtaactcattaagacagtaactgagagagtaaaactcataagggcttctattttaccacttagcatattttgtgcccactgagggaaaagaataaaatgggaacaaacacttctcttaaactccgacttgtcaaaatttatgttgacttatgaagctcatttaataagaaaattgtgaacacctcaagggcaggaaccactttttcatttattgttattggattgaattgaatagttttagcacacatgaaagtgattcaagcacatttaccaaatgtcattatttttgtaccacatttattaaatgtgcaccatgaattagacactaaaacaacacagagaaatgaaatataacttctaatctttgattaaatatgtactgagtggcttctttgtactaaggcactacaaagctgctggagatacatgacaattatggcatggactctgttcccaaggagttcatagtttaatgaaacacccaagctcacatatgtggatccattagggagccaaacaagacattttgcagtcaaatactaaatacagtagtctggcaaagaccgtaagtcaataggaattgagtggaacagaggttgacaaggcttatgcttgacaggaaaggcctaatggggaaggctggacttcatttgcccttgaagactgagaaagatgtgtatagacagagagtggttaagagggcataacaagtggagacaaggtaagcaaaggcctcaggaggtggaagtcaagatggtgagctgagaaaatggtaaggaacccagactggctgagagaatgctggtaagcagaaggaaacaaaatcagaaagatggggtgaagtttaattactgtggggcaaatggggacaaacctagtgatcccctcagggcctttgaggaggaaggtaacatgatagtttctaagcagttccagtgtgactcttgtgaactcagtgcggttcatatgttcttatcagtttcctcatcagctttactctgcctgtgtatttggttgctgctctgcttccatgttaaagtcagaatatgctttctcatttaggggaagcactggctcatcagatctcaatgaccaggaacctggtcctaggaccccgaagagcagtcggagcaatggtgtgaccccaggcactcagagttcaccagccccaagcacacgaactgtgacctcagtcatcagtagagtaagtacacaaacctgatgaacaccgtattagttcattctcacactgctataaagaactgccagagattgggtaatttataaacaaaagagatttaattgactcacagttctgcatggctgcagagacctcaggaaacttacaatcatggcagaaggagtctgtcaaacacttataaaaccatcaaatctcgtgagaactcaccatcatgagaacagcacaggggaagcctcccccatgactcactaatcatccgccaccaggtccctccctcaacacgtggagattgtggggattacagtttgagatgagatttgggtagggacatagagccaaaccatatcagacacccagtctctgaaattcaacctcaccactgcagcatggctaggtttcaactctgtttgtatcagagcatgttctttatgctgctgaaaggtagaagcttcatcaggactgaacctcctgcatcttagctcctggcaggaaacccaaaatgaaaaagggaagagaaagaccaggttcaaaggtagcacttgtatgatggagttttaaattgctatatggcttaaataaatataaaacattttagaaggctctgattttgatcctctctgttacttcttagagaaaatattcataggttgagtgcacaaatttttccaaactgatttaaatctggaaaagtagaacttttatctagtttttaaagtagaaatttttattttcttttctatacatctgttaacataggggtcaacacataatgaaggcttaaattgcattttatatttatatgtgatcaattatattttctactggttttctcttttaaaagagaatatgaaaaaagtatttggggaaaaatattctcttttattaaatattctgttggaagttatatttggaatgaattagcatttgtgagatttttttatttagcaggaagctccatccacattgctggcatctatatttgataaatctttatatgagcagtgagttcatacaatacaaacaattatttgactcaaccaacatttaatgagaacctactatatgacaggctctagtcaagcaaagacttgaaggaagtgaaagaattagcaatgtagttttctggggcaaggtgttccaccacgcagagacagcactgatattcagcaggtacatgcagggaaggctgctctacttccttgtagctggcctccatcttgattggtcagtgcccttgctcagccagtttctaaaatatttttaatgcctctagaagaacagccagtgtggagcccctgaggtgggagcacaccgggtatgttcaaggaagaggaaggaggccaatgcagctgtggtgaatgaatgaggcaaagtgaactaggaaatgaatccaaagaggtcatagggctggatagagccttgaagagtgctgtgtgcagtcagcattcactctgattaagatgggggaaactggaggttttagagcagaagagtaacacaatctgccttatctttaagcaggatttgggggctgtgctgagaagcagctgtaggagaacaagagtgaaagccagaaaagcaatcagtaagccattgtcataccccatgtgagagattgggttttgaaacaaagagatagtggaggtggcgagtagtcaaattccgttaaagcattcagacagactgaaaaacagtaatagatttatttaaacatctatagtctaaattgtagttgtgaagataaaaggcatatttaaaacttcataaatatttatgctaaggtcagcaagccatttctgttcaatagctagaaaggtgcatggatagttgacgaatacactcacctcttggaatctaaaaaggaatgatattcaaaccacttagtgaccagtctggcagggatgttgagaaatcacaacagacactggcacaaggctggggcagtatgcgggggcccttctatgtcatgcactaaacctgaattatggggaaacctgggcttatagatgagagggagcacagggaagtgggaggtggactgggagtagtgctgtttattaactgacacagaagtatttttaaaaatttaacatctagtacagttgtcccagtgggtagcagctgacaatcagtccaatgaccaataagttaatcaagtttattctcacaacaaggtttatctttctacgtacaatttgagattattaggggggaaatcacccttttcatgtgctaataccctcaaaactaacagcccctacttgtgtatttctttgttaaacagcacctagatctctgcaacagaaattccctgcaatttagtagagtatatatacatatacataggcagtgcctatgctgatctcattcttgcaatctagctggtctaagctggtcttttctaagagaaaaaaagaaacaaagagaagtactttctattgaataaaaataagacagcacagtagtttatgaagtacatttgctctttcattaaaagggaagtatatagcattagatggcaagtatatagcattagatgatgagcaaggtaacaactcagtttctcccatttcttagcatctctttgtttcaatgttcttttctgctctagcatgaaagaaaatatattagtcagggatctccacagggatagaactgataacatatatataagggagtttattagggagaatttgctcacacgattataagacaacatcccacgataggctgtctgcaagctgcggaaagagagaagacagtaggatggctcaatccaagtctgaatgcctcaaaaccagggaggccgacaatgcagccctagtctgaagctgaaagcccaagagcccctgggaggctgctggtgcaagtcacagagtctaaaggctgaagaacccggagtctgatgtccaaaggcaggaggaggggaagccaagtgtctggtgcagcttgggaagagaaagagtgagcagactcagcaaacaagccgcttttccctgttctttcgtgtgctttgttctagccacactggcagctgattggatgttgcccactccacactgagagtaggtcttcctctctcagtccactgactccaatgtcagtctcctccagcaacacccttacagacgcacccagaataatactttatcagccatctaggcatccctcaacccaatcaagtatacacctaatattaaccatcacagaaaacttttagagcatgaaagtctctaacctgtcctctactatgatgcaacctattaattttaggcttgacaccctgaacctccagggtatgtattgcttgttaatgacagtgcaatattaattggcctattagtgctcaatactaatgatactcacagatcacctgtgggaaaacttgccattaacataattgcctccaaggaacttggtcttgcttcattaaaggactccatgtgtgaacaactttttgaagaggtgttgaaaattgacctaaactaatttatcagtttgacctctgtcacactcctgataaacttttcttgtttatggcaattagaggaagttaggagctatatacctccagctacaggtattatgtgttggagaataataagatactaaaaacagtctaaattgaagctgaatcaattagcatattaagcaagtgaaagccacatttcactgtaatgagttcatcagagtgtccctgaatgtctaagagatgggcaacaaggagggaattattcctctaggatttcaaaaggcactttttgattgtttacagaagggagaattgaaaaatctgttttagatttgatcattatcataccatgatgtaatttgaatggacacttaacctcagcccagttctggaaaggtccaaaatttgttatagttgttgttttaacactcaagaaagcttcggatgaggcagcagtcaagccctgccttggtctatggcagggcaaaggtcacagacaaagttgggtctatggtcatgggcgaagtcgggacagaattttctttaccatatgttacaataaatgcaagtcccagactgaattctaccacatgtacaagcatttattaacaagcagacaccacacaaaaaaaataactattcctgtgagcttgggaagttttctctctttatttttttatgaacattggtaagtaccatgcatgaaagtcattccaaaatagatgtaaccacccatattctgaccagccagccttctagatggaaaaggtacatgacatcctgttaaatgggggtggaagaggtaagggatggttgaagagagggtatgttgaaagagggaacaaaataggaccaaacagagttctaagcttgagtgctactctgagagtgtgaatcttgacagattattatacatccctcatgtaagattgagggtacctgtataatcttccttattaatcatatattagaacactcattgatttggggaatgagaaattgtccggataccttttgcactaattaacaaacctcttggaatggattttggatagcaattattgatggtaaattttgaagttacatggactcctggtgagggtccttcaaatgtcaattagctcctcctaaataataatacatataaaggtgtttatactgaagtatatttatgtagatgaattttatagtaaattacagtcagtataatttttttctcatttttactttgtgggaaggagtatggttttgaaaattccatggatttggctgctattgaaggtacctctcaggagctcacaaagagtcaccgcagaaacacttctggcacaccttccatagcagtgtctggaacctctctctcctcaggtgggtatttacaatgtgcctactttgttgtttaaaatgactaaatcaaatggaattgactgctatgtgtggtattaagtggatgtttcatcctttaaaaaataagcattcccttctttgacctatggtggtaggccactccataagaactgcttgaagatagacccaggtaaagctttgggcaccttacattcatgaaaattccatttatttagtacatactcttgccaggtatcatcactgagtttcagtgctacatcagaatatcaatatttgaatgaaggaaatataaattattccaggatacatttgctataacagataagaatgcttgctcagagttcaaggaaatggtagttcaattgatatagtagtcagaagttccctacatatagacaaaagaaaatcattctgtggtttaaataagaagttatttgcaagcagcactaaagtattaataattacccctttcatttgcatggtacactcaaatatgtcattttacttcattatcacaacagtcctctgaagcagctattattcattttgaaatgttaatagctatgactaagaaaattcttcggagaaatttgtcataattttgaagcttatgtcccatacatggaataaaaatcatgatgcagtcttcaacattaaaaagctacctgtaacctaatgattatatatgcataaagcctaaggcaggattctgtttgctgaactgaggggtctcttctagccagccagctcccaaaggattttctaaatgtgtgtggttattgctacattttgctcaggagtaaaaaagctgttcacctgttaattaaatttttaaactagtttagaaaccaacatcatagggtctactactactacttctactcaacagctcctgttaattgagtacgtactctgtgtcaggcctatgctaagtacttctgcattatttttttcatcaattcaaacttaagtacttgattactctctccaatctttctcatttataagtaactatattgatctcagtagtgctttggtatagaactattttgtggaaataagctgtcctgacttggtaagctgtccaaagcattactaagaggtgcattgctctgtaacttatattttcaaaaagtgaaaacaaggtgttcttctgatgaaagactcttctggtccattaagaaatagaacttcctctcattgcatctatagcctctcatttttgtgtgaaaagaacttgctatatcacttcaaagtggcagtttagaataggttgcattgcattttatgtcaaatctgaaaacacagtgaattctctaaatattgcaagcaagaattgttaatgtttttttttctaaatttaagggcccattctaagagagttttttaaagtctaggagcaaagcagttgccttaaacagcttaaaacatagcattttacagtagaacatttaacctcctgtgatagaaggaaacatgaacacctaagtgtaattcggtccaaggcaattaccaaaatattattaaaaatagaagtatgttatcataaacagcatgaagttactgactccgactgttgctttcatggcactatttatgatctgtgcctaaaaagaattgaaataaaggtgaaacacttggaataaaaaatgaaatcttctcacaaaacaggctgactcacgtctttctttttcctttccaccttccagatcagagtcgatctgagttagatttgagtgagtcatttacagaagactcagaggatactgtaagcataagaagcaagtctgtccctggggctttagacaaggtaagttggatgtggaagaaaatataatgaagaggaggaaataagggcataatcttgctccaagtggtttcacttttaggtgatgatgagttgagagtaaagagaggatatacaatcatctcttcctgttagtcttcacagtcaacacataaaaaccgaaagaataacttagaaaatataatgggtaatcatgttaatgagtgaaggttatgtctaagaaaacacatgttggagatttcaatttctggctaaagtcttatcacttaatctaaacctgggaaatgagagatcctaacattttccttagccaaatattattagaaatatctgattacatatttatatcaacattgctatatctcaagttaccaccaataaattcacttctaaactgagacaaaattatgtgaaaattaatgtttcagtgaactcatttctagaatgagaaggttaaattagattattgtaaaggttatttcccagtctaatattctgatattcagatttctgtaattgctataataaaatacggactccttggaagaaatagaacacaaatgtaaaatggtattgatagtttttccaaagcacactaggaaacttagagttctaaaatgaaataatattttctatagtacaaaaaactgggaaaatactttaaaatctacctccaaaagagagatgggcagtgagattaaattatttcaaagtttactcatgttcaacctttaaagaattactaattccaacattattaaactattaaactattcgtgatcttagaaaaccattgaaatcttttcattcattgtatgcagccagtataatcttgacactcagacttgatttttaaaatagtttgaaaaataaaactacaagtcaaactagtttacgaatatacatgcaaaactttaaatataatatcaattaaaatctagcagtgaataaaaatagcaataagtaagttttatgctaagtatgggtggaagaatgagtctatataagaatatttgtcagcataatttatatcaatatactaaagaagaaaatgacatgattctgtatgtagaagatactaaaggatctacaaaaatatgactagaactgataaacaagttcagcaaggttgcaggagataagatcaatatacaaaaatcaactgtatttatatatactagcaatgatcaattggaaaatgaaattaagaatataattccattcataatagcatgaaaaatatttttcaaaagtaaggaataaattcatttttaaaagtgtaatacatgtgcattgaaattaacaaaaatatttctgaattaaaggagacataaataagtagaaacatattctgtgttaatggattagaagattcaatatttttaagatggaaattctctccaaataaatttgtagacaatgcaagcccaatcaaaatacaagcaggataattttgtagaaatagaaattattattctaccatttatatgaaaatatatgggacccagaataacaaaatcaattttaaagagcaaagttggaagacttatactactagatttaaaaacttactctacagttatagctatcagtacaacacagtattggcataagcattggcaatcagtggaatagaattgagattccagaaaaaaaaaaaaaactttatggccaattgatttttggtacttcagtggggaaagaataaccttttcaacaaatcatactgggacaacaggatatccaaataccacaaaacataaaagaactttgactcttaacatataccatgcagaaattaagcaacgcaaaatggattataaacctaaatgtaagaacagaaaccataaaattctaaaagaaaacctaggagaaaatctccatgactttcagttaggcaaagaattcttaaatatggcactgaaagcatgatgcatgtattcaagaaaaaaaactggtaaattaaatttcatcaaaatgaaaaatgtttacacttcaaaagacaccactacagatgtgaaaagtcaagccacagactggaaaagtattttcaaattatatatttgttaaaggacttgtatctagaatatatttcttaaaacccttacattcaatattaaaaagacaaataatcatattagataatgggaaaaagatttggatagacatttaatcaagaagatttacaaatgcctaatagctgcattaaaatatgttcagcaacattagttatcagagaaatgaaaattaaaatcacaatgagataccacttcacacccccttgaatgggtgtgattaaaaagacataataataagtgttgatgaggatgcggagaaattggaacccccctacattgctagtggtaatgaaaaatgctacctacagccattccgtaaaagagtttggcaatttctttaaaagttaaacataaatttactatatgacatagcaattttgatcctaggtatctacccaagagaaatgaaaacatatgtccacataaagacttacacgcgaatggttataatagccaaaaagtgaaaataataatatctggtgaatagatggaatacaatgatatattattcagaaataaaaagaaatgaagtactgacacatactacaacatgcatgaaccttgaaaatattatgctaaatgaaagaaaccaggcaaaactacatatcatataattacatttatatgaaatgtcaatgaaaggaaaattgatagagaaattaaagcagattaatggttgccagggagtgaagaagtagggactgactgcaaacaggcatgggggagcttattgggttgaaaatgtactaaaactggattatattgaagtttgctcaactataaatttgctaaaaatcacggaattacatgcatacaataggtaaattttatggtatgtaagtcatacctctataaagttgtgggagaaaaaattagcagcaaggaaaatagctggaaaagtgataattgttaaaactaggtaatcagttataagggttcattatgctatgctttctattttgtgaatgtttgaattttttaatatccacttttgaaaagaaagtaaagaaacatgaagactggtactttatgtgatgactactgggtaattgtataccaagaaagagcaaaacataaaaatatagaaaaggggcaatttgaaaaaataatagggataatagggatgcattttttcagaattaaagagcttattagtttcggcagctttttgctgaagtttttagagtgttctatatataaaatcatgtcatctgcaaacagacaattttacttcttcctttccaatttagatgccttttatttcttttacctgtttaattgctctggctaggacatccagcactatatggagtagaattggtaagagtgggcatactgtattgtttctgatcttagaggaaatggttttagcttttcaatgttgggtataatgttagctaagagcttctcatgtatggttttatgttgaggtaaattttttctttatctcatttgttgagtttttagtatgaaaagatgttgattttgtcaagtgccttttctgcatctattgagatgatcatatgggttttatccttcattctgctaatgcagtttatcacaactattgatttgtttatgttaaaccatccttgcattccaaggataaatcccacttaggttgaatgagcttcttcatgtgctgttgaattcagtttgctagcattttgatgaggacttttgcatctatggtttatcatggatattggcctgcaattttccctttttttggtagtatccttgtctgactttgctatcagagtaatgctggcttcataaaattagtttggaagtgttccctcctcttcaatttttggaagaatttgacaggaattggcattaattcttcctcagatgttcagaagaattcatccatgaagccagcactttcttacaagatgctattctacaagatattccagctcatcttgtgggctcatcagtgagaaaaaggcagctacaataagttctcatttaacatcatcaacagattcttggaaactgccactttcagcaaaatgacatataacaaaaccatttttttcctcatcaatgttttaatgaaatgacattatttgaggacctgctgcacatcctttcacttaaaattacagttttcaagaacctatggatgacgttaagtgacaacttaccataaaccaatataaaaataagcaaattttgaacaagtatttcacaaaacaggaaatccagttggctgattatcacaaaatggtattcaacttagtaataagagaaatgaaaattaaaatcatgaagactgtaaacatctactggattggcaaaaatgaaaaaaatatctaacaataccatctgtttgcaggcaaggaagtggagcaaagggaactctcatatactactggttagactgtaaattggtgtaactacttctgaaaatttgacattatctttaaaatgatatagataagcacgtggagatatgttcaccccttgacttgacaattcctctcactggtatatattcaagtgtgtgaacatatatactgtgttgtgtgtatactgtggtgtgtgtatatgcgccaggatacatattcacagaatatacatatcagtgttggtcacaatagaaaaaaatctgaaaataacccaaatattcagcaacaagagaatggataaagttttggatatcatacaatggaatattaaatgacaatataaatgaacaggctacaaaaatatgccacaattttgatgaattttaaggcaatattaagcaaaaaaagcaaaactcaaaggaatatatagcatttaattacatttacacaaagtacaaaaacaggcaaaacgaaatcattttgtttcagagtatacgcttatgcagttaaactataaataaaagcaagaatgtggttaaccataagagttaaaatattaattattcccgaggggagaaggggcttgtgatatggacaggatacacagggagcttctgcttcatcatttgattttgttattatactatatatctatgttttatgtactttttaatatgctgtatcttataataaagacttttttaaagcaagcccagaagtgtacatcataatcctgatttataaaactatagttaaaaaaattcccatgaatgtatacttatactcagatttgtgtatgtttttatatgatttttcacataaacaaggagaaagacatggaatgtaacatgtgcagcaggatgctaaatattaatttcacctggtgtgaaaggaggggaaggaggagaggagaagcaaaaaagaaaagtgcccataataaaaagcagtatgcatgatacaatctatctatgtgtatatatgtatgtgtgtgtgtgtatatatgtatgtgtgtgtgtatatatatatgtgatgatataatcaaaaatattgaaatttgatcattaatatgttaatgagagacctaagtttttagtttccatttatctatattgcttgaaataattttactaggaaaatacatcacttaaataactaggcaaaaaaaaaaaaagccattttatcatgaaggagaaaaagaaatgggaaaggaaaagtagaatctgggattggagatgagagtccagtatctagttcatcctagtggagagatttttgagatatgctttaccatcttggcagtgtgtgtgtgtgtgtttgcacacacacacaaattttttttaattttaaagtaacgtaagtacattgcccaacatgaatcaccttagaggtaggaattgaacccaggtctgtatgattccaaatttcatgttctttcaataaagtaagcaccattagaaaggagacctcactctccaccccctatccctgcccacttctccgatggtataattcagattgaccggagaggaaaagagaaaaacctaggaatggagtgatttctagaaattttttatctgattctcaaatatttatgaaagaaagtggtttctcaagtgaaaaaacattctagaaaaacaaatcaaccaacccactgatttttccctttcttttttaggactccttggaagagactgaagaaagcattgatgccttagtgtcctcgcagttatctacaaacactcaccgtctggcaagtggcctatcaactgtaagcagttcactaggacatgtggaaagtttcttttccctctttttgattttctgtgcatttccaaaggagatatgaatgttcttaggaaaatgtgtgataatgagttaaaagtcattgtaagatcctgcttgccctttgcccacagagtacatttcagtctaatttggtgtgggttttttctcaggctcctgatttcttccttcttccacagtcctcacccaggttttaaaatctcctcactccctagttcaggctcagtcagctcaagcctataaattatttttcaattatctgctgacacatttccctgacaccattctctaaacttcccagctgtcctccagactgctgccagtcatttatcctaaaacacatgcccaatcaggtctgtcttctactcaaaacccatccatagcttcccactgcctacaaaataaagtcctttcttactttagtgttcaaggccttttttgagaggaaggccctgtgtccttgtatctaactgtgtgtaagtctttttcttggcttctctgatttctgttgctctgatgctttttttcttttgatctttggatgacttctctaaagagttctcaagcaggttctgacaggaagtggacctacctaaatgtgcctgatgctgactcagacactgtgagttttcaacctttcctttttgttctttccaaccatacttcacaaatttcatggtctgggaactatgattaagcaatttgtcccacatttatctttttccgacttatatacaattaaccagaggttatcttctaaaagattgatgagatgatcagaaaccaagtattccaattcattaaacattggaatctgaacaccactcaaaagacacatgctctaaaatgattaactatcaacaaaacctttgaagtaaacaactattttaaatcacagccttagcttggttaagagcatatagtttagttagtagtaaaattgccataggtgtcttagtttctcacaagcctccgtatttgtgggttcctaaatttccttctatccgtaggggccctctgcttacagaggattttctttgaaaatgtggctacagagatctagtatagacacaaatcagtgatataaggaggtaatcaggtatggtggggtagtcctcagactagaaacttggagatcttgctttatttcttggccataccaacaatttttgtgagccagaattttctcatttgtaacatgagtaggttggggtttattcttgaaacctttgatactcaaagcattctctatggaccagcaacattgcatctctcggaacagataccccaaaactttctcagttcaaaaagcccctaatgtctcagtaattctttcctggcactcctacactaaaagtagcacctgactagtccattcattaagtagttagaaccaaataatgtaataagcagtgtatcctaacaacttactagccatttgtaaaaaaatgctacaagtgaaagaaattgaaagaaaaatagtatttttatttcatccttaaatagcacctattacttaccactaataggatatgtgtgcctattgagcactacacagttaccaaatcttggaatctgattggacatcactactttcatttcccatttcacattgatttttatgcaatacttgctttttgttgcagcaactgccaaaaactcagcttcagacaaataggagttcattgaaaagaataaagtgtggtttaaagttgacactgtgaattactagttagtggcttacatggtgtctgataggtgttgttgtgtttcccttgagaatttaaaatatttctgtgattcccctgtgagtttgctgtggtgctctgtggtacctcgatacacagtttcggaactgcaggcctaggagtttgttagaacagccaaatctcagacctcaccccagactgaggagataagcgttttcagtttaaaaaggtatctgggtgctgctcaaagccacctgctaaacatgaaaattctgttgctttgttttaggaataagaaagacagattaggtcactcactggctttctttaagctgtaatttccaaataattatggaattattggtctgctcttgcccgtgaagaagcttagaagacatgtgaccacatcacccacatcctgttctttggtcagtctctacttccagaaattggtggaacataatggcttttaccaaaagcaaattatgaaaaagaagacagtctaaggtccctgtgtatttaccatagtcttgacttcccagtggttcacagaaaagtggttttgaaactattgggtcatccacgaaagacctccaggtggtcttttgtgacagttactgagatacatagttttcatttctagtgccaaaggataattttattacatttacagtagtcacctttatccacagaggatacattccacctaccccagtggatgcctaaaacctcgcgtagtaccaaaccctagccaagaaacaccaaggtcacattttcacttaaagaaagcacttttggcttctctttgacatatgtaaattactaccatcattactcttacactgtggagtcattattaagtaaaataagaatgagttgaacacaagctctgtgatagcaggacagtcaatctgataactgagacagctaagtgactaatgggcaagtagcatctgcagtgtggctcctacagtgtgtccaactggacaaagggaggcttcacatccagggtgggatggagcagtatgatgtgagagttcatcatgctacttgtgaaccccaaaactctgaggcatgtctcagttaatttagaaagtttattttgccacggttgaggaccggcacccctgacacagcctcaggaagtcctgccaacgtgtgcccaaggtgctcagagcgcagttttgttttatacattttagggagacataagacatcaatcaacatatgtaagatgaacactggttgggtctggaaaggcgtgacaacacgaagtggggagggagcttccaggtcataggtagataagagacaaatggttgcattcttttgagtttctgagtagcctctccaaaggaggcagttagatatgcacttatctcagtgagcagggggatgactttgagtagtatgggaggcaggtttgctctaagaagttcccagcttgactttttcctttagctttctgattttgggtgcccaagatattttcctttcacatactcaaaacagcatacaatttaaaacttatgaattttttgtttctggagttttccatttaatatttttgaaccgcagttgaccatgggtagctgaaactacagaaagtgaaactgtggataagggggactactataaattaaaagctgtctcatgtcattagtgtcttgtcaaaagcctcattcattctggtagatttggacttttttaaaatttattttcctgattggttggtgtgtgattttattgtgtagtagtttattttgtgggctgctactttatacagatttacaaagccatggtcatatactactcatgtagccacacagctagctactcagttgagggaaatcatggaagctgtgggtatgtgatgttcttctgatatgtccttgttaaagctgtagttatggctccccggagactgatgggatgctccatgtaggtgtcaaagaaagcagtatgtggctcctgctagcacagaatatgagataagctaccctttgtcccaatcaatgtattctacaccttatagtagattgaacttgagtctaacagtgaaaatggagaaagctgcagagatagacgagaagtgagatttgaaatgcctcaattaccctgtattcattagtagaagtgagtaagcaaagggtattctctaacccaagaaggaaatgcttcccctctaagcaaattttctgccttttttcctgatggtactagatctgctgtcttttctccagctgggattttatacaacaccagccaaacaagtgactcttgttttctttcctcaccctagacttccatgctcattataaagaacaggaactataattgaatgaaatgagttgattctgtgaagagatcattagaatgacactagaagcctttttccatcttgtttattccagaccagccttaacagcatgatgagcgtttacagtgaaacgggagactatggcaacgtgaaagtcagtggtgaaatccttctccatatcagctactgctacaaaactggtgggctgtacatttttgtcaagaattgcagaaatctggccataggagatgaaaagaaacagaggacagatgcgtaagcacatagcatgttcctcagactatttcagtcactgccttttttgtctgtatgtgtgtttccttttcaaaagagtcttagcattcttcttgattcagtcttctcagagagttgattgtcatgttcctcctataccacacttttaaatattctctgaagcaaatgtatactggttgtgtctttgattaactgatttttaaaacataattcaggattgacatatttgcaatttacacagaggcagctctttgaagtagaatgctgacatgttggcacacccaggatgtacaaaagcatcttgtcgatttctgttctgggaaatcctccagagaaaattaccaaactgttacccaattaaacaactcaaaagggcaattatgaggctctcaggattctagagatcagcctgggagggcaggtatggaccatagcacactggagagaagctagatataaaggtgtgtcaggggttctcaagaccactgccaggttcagtgattcactaggaggacttaggactctgcacgcagttataatcagcaaagaggcacatggggcaaagtccaggagagatcaggctcaagctttgcaagggtcctttcccagtggagtcacataggatgcatttaattcctctggcgatgagttctgacaacatctgtgaaatgttgtctgccaaggaagcgtgttagaaactcagctggtcacataccaaatttccagtctctcaggagaaaaagaacccgttcagcataagccatattgtttgtacaaacaatttaggaacaacgagccacttttatcagttctgggaatggtgggaatcctgaaatccaagttgccagatgccacccaagggccaaatttgtaagcaggcatttagaagaatggtagtctcaggcccactatgttaactcttttctgcacaatagatgacctaagtccaataaataactcagtgaacctggttccaaatcccctaagatagacaaatgagtggattttgactacagattggtccacctgcctcctcagctacatttcagagggctacaggaccaatgtaattattttgactggcatggaaaggggtcttctaaaactcaacagatattctgtagaactttggtagcatcttatacatttcagctttgtacacatcttgtacatttctgagtctgctgtgataccctgcttcaagaggctcctgagatagctcaagctaaagtgttgggtagaattgctatcactacttcaggttgttattttttattttgcctttttcactgttttcttttactcacccattaccattgaccccactctctgacatcagaaggcaagactagtaatagagaagcatctaatcccagaaaaatttgtgagaccattaatattaatagtgtattacatgtattgagtagtacaatatggtagctccttggatgtgtcaactaatttaatcctcacaaggccatcagttagacagtgttattttcccagttttacagatgaagaaactgaggcacagagtggttatttagtaaattcttgaggtcaccaaatctctgaggcatggagtgattcaaaaccaggtggcttgacttcagaacccacactcttttatcattatactttaccacttctctcttacggaaggcccagtgttctattttaaggtatcctgttatatagacaaaattctctttggtatttccgctcatgctcactggccctttgccccttttattcacagcgaagtctttgaacatttcttgcaaatagatgtttcacaataattacatttatattttcttatctatagttatgtcaagtcatatcttcttcctgacaagtcccggaacaacaagcgtaagaccaaaatcagaacaggcaccaatccagaattcaatgaaacactaaaggtaaataaatacggtctcatagtaactcatgtggtactgttcacaacttcaatggtttagaagtaactacagagaatattttatttgtgtgtcaaggcttgtatatgttttagaaaattagaatttgaataaattaacataataaccttgacttttctaacatcttttgagaaaaagaaaacactcttactctatttaagtctacgctgctactgaatttgaaccttgagtagagaggatccagccaaactgcatcggtgctgatgcttcttgctaaaaaatcggttttacctttgggcaaacagtgctttttctgacttccgtaaaagaagcttgtcacagttttgacactacttaatgagtcactttgcacgcattcattgttctgctaacatagcataggtctatactgtttgttgttaggatttcagaatttgaccaaatgtaggtatgtggttaatgaatagtggaaatgcagagccagatttgagaaatctcagcaaaagtagcctagataaaatatggcccaatccaggtcaatgatccagaaaatagaaatctctttccaatgcgctttcacataattaaccccttctcttgctatggaacaatctggcctggtaagaaacacccagggaggatggaaagcagaagttattgccaattctatggaaatttatgggcttgtgccccagagtgatggtgtcagagtccactttaggaggaaattggtaaaggcagaaagccacaagcctgcatgtgtcagtgggagcgtgtgtggaagcaggaactaatattaagacagaacaaactgaaaaatgaataaatacaggtagagagtaaattcaatggccataacaggataggaaagatgagcccaaacacagtgagagggtaaatttaggaagcagggagccaaggttaattatgacagtaacagcaaagacaagaataggcactaatccaagatcaggaatcagtcagtgtgaagtgtgtcccagatggtggttgcatagaacaagcagaaggctggagggtgtgtgagcatgtggccctggatgatgttgttacaaaaaacaaaaaaaatgctagcccagcaatatcttctttctgtttaatatacatgtacaccttttcacctctgcacttaggctggactttataaaatttggtgtttgcgagtttctcattgtcaatccttttctggatttggggattctcattatgaataaaataagagagaaggtggagaatgtatatattaaaccttgagcttacaaagtaggtatgaaaaaataattaaggaaaatgaaaaaccaataaaactggaaagaggataagcttcatcacctaacactttttatgcagtatatggagtttatctctacctcagataatttgtttatatatctttcaatgcaaagtctggcacaaaatgagtttatggcatagaacttcaattgtagcagaaacaaagaaaaacaaagagttttctttgtgtttgttttgttcatattactgatgcatatgatctgaaagatgttggaagtaaatttcgacctctcctggaattggatagagccctccttgtggagtgtaatgttgtaaatctcattcgcagtacactatcagccatacccagctggaaacaagaactctgcagctctcagtctggcactatgatcgatttggacgtaatagcttcctcggggaagtagagattccttttgactcatggaactttgaaaatccaactgatgagtggtttgtgcttcaacccaaggtaggaaatgctctcagattagtcagttatgcaatgagacaagttatgagcgaaattgatgtcacagacctaaagaacttgaagactttcaaatttcaagtgataatctgcaaaaaattagtgcagcaaattttggaataatattataaaaatgttgtaaatccaccgttttggaaattctttgtcaatatagatcatctgtataatgaaagctacataatcatttttttgttaaaaatttttattatttgacagtctcattggataactgaaagcaacacattatatgatcttattagagagtcttcattttcacataggcgaaaccaaattcatacagcatgaacaatccccaaacattacctttatttctcattctccacaatttataccacaaacaggagtgatcttgcctttgcttatatgagggaataaccagtagctaaagtatctgattttcttactttcctacttttgggattcatgacccaggccttgagttacattcagaaaaaaaatcttagagctgataattaaatgccaatactgtatagcatgttctaatctagaccaacagtaccttggattcactttaagtgactggagtctctatgcatttacagtactttttaagccaaaatggaggtgagtaaaggtcacatttatgcagccaaagattattgtttatatacagaaaggcaaaagcacattatgatgaagacagtggactcaaatcaaacttacttggttctatcctggcttcatgactgcccatgtgaccttgggcaaattatttaactttttattccttagtgtcctcagttataatataatcgtgggatgtagcttataggtctgcggtgaagcttgaataaacattctacgcatggccgtcagcattttattgggaacattgtaagctctcaataagtgctagatagtatacgtgttacttgggagtccttgtactgcaacagacagaaactccagctaatactgctcaaaaaatagagggagattattggccagcagtgattaggcatagcttgatccagatgttcaaatcttatcaaagtcttggaatttcttggtctctcttcttatcttcattggcttcattttcaggttccatgcagtgttgccctccctgactagctccaagcatgcctctctaatgactacagtggctgcaagcctttcatctttgcaccacactgttcagaagaggagagttcctcctcctccaacagccaaatcagtgcattgggcctggttctcctaattataattctgtcatttgcctattctaagctattgactgtggccagggaggtgagatgcattagctggcttaagacaatcagaatataccctggttctgaagaagggaacaatagcatccttccagtaaatttcctggaaatagttgaaggactttgctggaatgatatctaagctcccctagacctctcctaggcatcctttgtgcttagaaatcaacattttccacagtaatcacttccacattgtcaatgagtggttcacagtctatcataagagggaagcatctctaagtctttctgagtctactgaaggtagaaaagttctgattgcattcactgtggaataccatgggtcctctgccagatacccttaggttcctaaccatgtcttttaggagatttgccacaacagcctccacctgagactctctttagaagacttccctcgggctactgtagctttttgcctatgtaagcagagagccagaagtcctgggaatttttatacccgctgccacaagacaacccttcatcaataactgataggtgggggagtatgaaggcccacttccttactgaaggtgggaaaaactccaaagtgttacatatactaccacatcaggtggaagctatcttccatggaattatgcccaagattagacttgtccctatagacttgcttcccatacctctttactggtctctctgagagaacttccttaataaatcacttcataagaatcttcaccttagagtctatttctgaagaacccaacagaagttagtgtctctaatctctgccatcttcctctgcccagcttcctctgttctatatagaagaaaagctgaagacacaaacgtgcttagatatcatgtcttccataaatggggaggacaggcataaaggcatgctctatcatgctctatatgctgccttgtgcttcattagtggctcatccccaggctgagctgggctctgtgtggttgattatcagccagctatgtgaagtggcacttcagtttcagtttcctgcctcggtcatttccatgcaattgtcactccagcagctgcagatgtagtatgagcagccttggagacttgacgtttctcatagattatgcagtcgagaaggtgaaacatgagttacacatactgatttccctagtaataggggatcagaattaataatccttaataatttagaaatactgacatacttctgcactaggagttccagaacggcatggtgccttattgcttattgactctattagtgaaggttcctcaatatttatctttgtatgggttagatcctacagtgctaagccagtgaggaggctggtgcagagaaagaactcaagatgccaaacatactgtagtttcacagtataacttccattttacttcatggcatgggattatttattagctgtaaagccttctgaaaggcatgtcaggtagttagacaaggttttatcagtatgaattgcctttcatgccttcccagagtgtactattataaaaacaaggacatctgaaaatcaacagcaagcttacgtggttttccaaggaaacgttctcttattctgccttcaggtagagagtaaatgtatgttcctttggaattatacctagattaaaggctctctctttttttggcagacttttgtctgtaattccttactctgtgttacacctgtaaatgcactgggagtctctttctcactccgatggaaagtggacctctctttttttcagaaagcaggaggtggtgggtgtcatctgcttatttcacatccatgctcagatagtctcagtggttccctactacttttggatatggtttgaataaatactaaccctcaccctggcactcagtgttctgttgaatggcccagcctactgtagcagccaaagatgttagttctctacccatccccgttttcttgcaaacagggctccccacttctttcactcccaccagccaacccctgccaatcattgtaggaggggagccttcgggctgctagagagggcttggtttgcaggccagaaaagccaacatagcctgggtatttaagtctcctgggggtgagcagagccttgatcaatgactggtggattaaggaacgtcaatactcccacgttcttgcctctgattggaacagctctgaagtgtgatctgtcacatctccagagtacccctatgggacttaacaacagttactctccatggaactttgcctgaaatcacatccttaagcctccttcacttttggtcccccttccccagtacccttcctaataaaatactataacttaaataagtgccttagcatcttctgggaaaccctgagttgacaccttattttcatcctccttgctactacctccctgtacacactcccctgatcacatttgacttcctgtcagtccctaaacatattctacacaacccccatcatattttactcatactgctttctcaacctggactaaccttcccaatccatcttcatctgtcatcatgtctcccatcctttaaggaccaggtaagagccacctctttatcccaatctggattaatctttctcttcccatagtagtttctttttacttgtgttggaataactgtcaccatttatcttacattgaactttctgtatagtagaaaccctcttgccccagaaattacaaccagtagtaggtcagttaatagacaaagtcacagaaatcacccacatacaaacacacacaatatatttcttttatttttaattattttgaattgacacataaaaattgtatatatttatcatgtaaaatatggtttctaaatatgtatatattatggaatggctacatcaatctagttaacatatatattacttcacataacatacttttttgtggtcagaacacataaaatttactctcagcaattttcaagaatacaaaacattgttattattaataactatggtcaccatgttataaaatagattcctcaaatttattcctcttatctagctgacattttattttgttaggccagcatctacccagttctccccacccccagcccctgataaccaccactctactctctgcttctattaattcaactattttagattccactattttagatttatatctattttagatataagtgaggtcatgcagtgttcatctttctgtgcctggcttattttaattaacataatatcctccagatttatccatgttgttgcaaatgcaaatgacaagattttattttttaaggctgaatagtattccattgtgtatatataccatattttctttatcacttcatccattgatggacaattaggttgtttctatatgttggctattgtgaatcacgctgcaatgagcatgggagtgtagagatctctttaagatacttatttcaggccgggcgcggtggctcacgcctgtaatcccagcactttgggaggccgaggcgggcggatcacgaggtcaggagatcgagaccatcctgggtaacacagtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaagatacttatttcaattcctttggctatatatcttgtagtgggattgctaggtcataaatatggtagttctataacacttactatatttagtctttttgatattagccattctaacaggtatgaggtaatagctcattgcaattttaatttgcatttccctggtgattagcgatgttgagcattttgtcacacacttttggccatttgtatgtcttcttttgagagatgtctgttaagatcctttccccattatttaattggattatttgttttcttactattgaattgcttgagttcctcatgtatcttcgatattaaatgatttaacttaaactatatcagatgtatgatttgcaactattttctctcattctgcagattgtctcttcactctgtcgattgttttctttgctctgcagaagttcagtttgaggcagtcctatttgcctatttttgcttttgtttcctgtgcttttagggtcatattcaaaaaaaaatttcccagacctatgttgtggagcttttcccctatgtttttcctagtcgttttacagtttcaggtctcatgcttaagtctttaatccactttgagttgatttttgtatatggtgtgagacaagggtccaatttcattcttctgcatgtggatattcagttgtcccaatactgtttattaaagagactgtcctttccccattgtgtatttttggcacttttgttgaaaatcaattgaccataaatttatttctggactctctattatgttccattggtgttatgtatctgttcttatgccagtaccatgctgttttgattactatagtttcccaatgcatttcttaaacatttatttttaacttaaaccaaataaatgtacgttcatttgcaagtcttctgatatagaggcaattaattttgtttgaatttcgttcagtaagtaaaattctgccatatattccttgcataaattctcctcctaatgcatcatcatcagaagattctaatttgagcttttctcaaatgaaacaagaacataagaatactttcaaagtaaacaaaatgcaaattcttctaaaaaatgtatgattttttctaacctttgatagattcaagcccacatataatccaatagcaactttgttttcaaatctttagttcttctattcaactgaattgttatagtagcagctgtctttttgcactcatcaatttatgtgactttaaactatataattaaaatcacaaatatgcctggcctaaagagcttaggggactaactaatgcagctgactctcagtgtgcatacaattgaactgatgggagcagatgcatgttctttgcagaaaggattctgctattcacgagggatgaagaacactaattaaactgatgagtcagcagttaactaagtgtgaattaatagatcctgctactgcaaatatgtctactagatagactgaaaactcattgaaagcagggtctgtcttttgtgtccccacagcacttagcaaaatgccttataaaaatgtaagcattccatatgtgttggtagagttgaattgaatatgattggattctgctaactttttctgagtaatagtgggttggataatgacaatggtggtatgccaggagagggtgttgcctaggaatttcctggcaaaatataagtatcaaaaataccctaagacattagacatgtgcaggctgcaatatgactcccctgctttaattttttatatgtgattataatgctacaagcttcatcattattgtgttttcctttcataagacttgaagtctatatttatacggggtctacagtatattttaagctaaaaaccaatggaacattggtaagtcccaataatgcatgtttttgatctctggtagcacactatatattagtatgtgattcctacacatataactttttcctactggcgtattttcatacccgaagatctcactcaaaaagcaaacacagcctgctctggttaactattgctgtatgccaaactaccttaaaccttcggggcttacagcaagaatttattctctctcatgattctgtgggtcgactagactcatctaggtagttctcacttagggtttctggcgccactgcagccagatggttgactgaggctgatgtcatctgaaagctcaactgcattgattgttcgagttggctcacttccatgtcttacacatgatgttgactgctggctagaaactcagctaggcctgccagctggagcacctacatgcggcttctctctgtggctttagcctctcttagtacgagttcccagaggaagcattcggaaatatccattccaagaaagaaaagtagaagctgtcaatcttaagacctggaccccaaaactggcacattgtcacttctgccatattctataatactagtcaaagcaatcacagagcccacacagacccaaagagaggtcacaaataccccatctctcattgatgacggtaccaaaaaagtggtaaccatctttaatctgtcataacatccattataattttctacttatgatagtcacctaaactaaaatttactgagattgtcaaaacaaaaagaagagtccagttacaaggaacctgatctaaaataatcagattaaatattagatggatagtctattttaccatataatctcatttttgccccgggtaagaaggttgaataaaatatttcaagcatttttcccacccttactagtaagttttactaccaccagcaggaaagaaaagggaaagtcaggcaaggattccttttctttgtaacagtctcagtatttttaatttttttttactgtttatttgcttatttatgccaagtcttgaacagtctctggcttggctatgaatgagctaggtttcgggactctcattctgccctctctgagagagcagttctctgcttttgactcagaagtcagatccctaaaggaaaagcctgacaaagtatactgcctttcctgctctacctgtgaaagaactcaaagttcagttgactcaatggcaagtgggagacctatagaatagaggttctgggtgcacgtgcacattgactttctttaatttaaactttatattttgagatgattataaatctacatgcagttacaagaaataatatgaagagatcctatgtacccaatacttgattttccccaatggtaacctatagcaaagatgtactataatatcaaaccaggttttgcttatttttttagaggcagggcctcactctgtcatccaggctggagtactgtggcacaatcatagctcattataatctcaaatttctgggctcaagctatcctcccacctcagcctcccaagtagctgggactacaggtgcatgccaccatgcccagctaatatatatatatatatatatgtacgcatatacatatatatatatatatatatgtacgcatatacatatatatgttgagagatagggtctcactgtgttgcccaggctggtctcaaactcctgggctcaagcaatcctcccacctaggcctcccaaaatgctgggattacaggcatgagccactacacccagccacaaccaagatattgccattgatatgattcaccaattttattcagaattcccagtttggtactcatttgtgtgtgtgtgtgtgcacatgtgtgtgtatatttcatcctatgcaattttatcacctttataggtttgtgtatctactaccacagtcaaggtacagaacagttctaataccacatgtccctcaggttgaccttttataaccacatctaactccctcccactactcacatccctaacttctagcaaccactaatctgttctccatctctataattttgtcatttcaagaatgttacataaatgaaatcataaagtatatgtcattttaagactggcttttttcactcagtataattctctagagattcaacttgttgcatttatcaatagtctattccatttttattaatggatagtattccatcgtatgaatgtaccacagtttgtttaaccattcacctgttgaaggaaatccatgtggtttccagtttttactattacaaataaagctgatacaaatattcctatacaagttttgtgtggatataatgttttcatttctctgggataaatgaccaagagtgcaatttctggttggatggtagttgcatgtttagtcttacaaacagtcttacaaactgttttccagagtgactccaccattctacattcccaccaacaatgtttgagtgaaccactttctccatgttgaattttgattatatgaattaccaacattgcttttaacagttgatggctggcagccccatgtgaatcaagcattattgcctacttttccattcttgatcacttgggaaagacttaaaagacatcaaagatgacagggagaagtaatttctggaggtattttcagtggcatttttattcctgcttcttcatatcccaaactatatatgtaaactcagtgataggtccagtcatcaatgcatcacaggtgctcaatatctattgactggccaaatataagttatatgtcttctttcaaatttcttttacttaaatgttaaaagttatatgcaaatgccttcatagagttttccagcctttgttttctcttacctcagtcatctcttaaaccagtgagagcgaacagagttgaaatgagaatggattgtcacatttatgccactaagtaaatattgcacattcaaatgtggactacaatactaagccaatcatccatactctttcaacttacttgtttctccttggccaggtggagtttgctcctgatattggccttcaatacaaaggagagctgacagttgttttacgttacattcccccagaagagaacctgatgcttccaccagaacaactccaaggtagagtaaaaatcaatgactttgatcaatgacattctgtttctagaagtgtggtagtgggactcagggattggttgcattatatttctttcatattacacaaacaaaacataaagggtttggtgtcactgtcttttggggagagttgagatgtgtataccgtatatatagaagaatgcaggactcttacaaggaatccttgtaagattcatacttagaaaccagccttggtggtcagttttgttttatgtcccaaagatataggatcttcccccagggttgggggaaggcaggctgctggaggcaagtataggaaactgctccatggatttatgacattcacagctattcagggagtcttgaggaagaagttgatctagaacacaggatttaaaggaaaaaatcagatggaatcaatttataaatctctcttcccctttgtattaagctgtttttgcattgctataagaaataccaagactaggtaatgtataaagaaaagaggtttaatttgctcatggttctgcaggctatgtaggaagcataaaacaggcatctgtgtctgaggaggcctcaggaagcttacaattatggcagaaggtgaaggtggagcaggtgtctcacatgacaggagcaggaacaagagaaagagagaaggtgccacatacttttaaacaaccagctctcacaggaattcactcactatcatgaggacagcaccaaggggacggtgcaaaaccactcatgagaaatccaccccatgatccaatcacctcgcaccaggccccacctccaatagtggggattacatttcaacatgggatttgggtgaggataacatccaaactatcttgcccttcttttaccatcaattcttgcaggcagcctcctctgtcctcccattcactattactcttttcagtgtgaccctgtgcaagtaactcactatcacctgacctcaatttcctcacttcaaagggctgttgtgaagaataaacaggttcatatatgtaaggtgcttaaaacaatactaaataaaggtgctggttgtgatactggtttatatcattcatgttgaatgtatttcataagaaaagaaaagtgaggtggaaaagagatttctctcaccctaaaacgtaactgtgtttgggctgtagcctctagagctggctctgactaaaactgactatttgtaagactaaaatatcaaagggagttattgaattttctctttttgagttttggtgcatgtatattgtcttcatcatagttatttctcactaagagcaggaatggtgctccgggaaactcttaggcattccatgcctttataccctgtgaaaagatatgctttgtaagggagtgtttaaagttttaaatttatttcttcatttgtttcaacaaatacaaatgaaagacctatctggaaggaatccaatgggggcaaaaatgtttaaatgaataaaaatatacaataatgtaaaggcccaaattagtcagcaaatgaaatatatgtttgtagatgatctttgtaaattttgaaatggaactcatgatttatctatttttttttctctttctccaccattccctcattttggtggctgacacaggaaataagacttttaaaaagggaaagaagaaggagtcacctgtaatctctggaggaatactagaagtgttcatcaaagaggcaaagaatttgacagcagtgaagtcaggaggcacttctgatagctttgtgaaggggtaactttgttttagctctttttggatgatacttaataggagatgaaaggatctgtgatccacaagccactggtggctgtgagccttccgtgttctgtttactagaagtgtatgggtgagaactacccttacatgctggctcttacatctaaaataacacaagtgttgagggaactgctgattctagctgtcactctgtttccaacatatttcaggaattcccatcactcttactctcaagacagtcaacttttttctgtaagattcatttatcgaaagtggacaaaagtatgatttcctatgtataatgtatttatattgttctttattatcattttgtcctggcaatatgcaacaatcaccaaaatatcagatccttgatatttttctctcttgggggaaattgtaaaaagtagagatgtcagagcatccttgctggacttattcactgtcgagtgctttggagaggctccaagaccacctgctaggcatttgtgcccaagttgtggagcaaagggcagcttcctgagggaatgcagccttaaaatggatacttttgcctaactctaggcaactcaaacatcaaatcccttttgattcctgactactggatatttttctcttggaaattgagaaactaagactgcaaggttatttttcagtcattcaaacaaacacaaaatgcacatgtgccaagcaccaggtgctatgctttcaaaaataaataacatattatccctgccctcatggaactccgtaaagcacataaggtaaaacaaattcccatgatgccagaccatgaggttcattctttgagtcggatggcaatattgttcctcttcacatgctgtattggaaaagagtattttttcctacaaggaaatgggttgagctcactctcacatgttatttgttgttgttgtttgtttttgtttttgttttgagacagagtttcactctgttgcccaggctggagtgcagtggtgccatctcggctcactgcaacctccgcttcccaggttcaagtgattctcatatctcagtctcctgagtagctgggattacaggtatttttatttttatttttatttttagtagagacagggtttcaccacattggccaggctggtcttgaactcctgacctcaagtgatctgcctgcctcggcctcccaaagtgctgggattacaggcatgagccaccgtgcctggccacatgttctaactttggtaaagctagtagtggggagaagcagttctggggcctccccattggtgagtgtgtatgcctgaatcctggcacatcttcccttcactcttccttgcagtagatttaagcatagaagaaatgctttctttggatactgcagttacaatttgtgtcattagccctaccatccagtttaagcttctgctgctggaatgaggagatgactcccaacccgtggccacattgtgaccttgcaacggtacttgacatcttctggagcagtattcactttatcttgtggaaaatgtataaagcagaaataataaaagacagtatttttgttctagaaagaaaaacaaaagccaataactttccggtaaattctgtctataataatacttaaatattaggctgattctaaaaagacatgagatttttttaaaagacagtgagggagcaagaatagaccctctgtaaagtttaataatataaaatatatccattaacattaggtcggtctgtgagccaaaagaacagtggcttaaacaagacaagttttttttctctcttacatgtaaacaaagactgaaggtaaggtccccagtgcaggtatggaagcatcatgattatcagggacccaggatttttccatctcgttatggtatccacctaatgggttaggatagctgctcctgtttcagctatcccacacaaattccagctgacaggacactttccagatgtaagaagtagttttatcagcactacttcttatatcccattggccagaactcagtcacatggctattccagctgcaagggaggttgggaaatgtagtctttattctgggcaacactgtgctcaaataaaaacacagttttttagaggaatataaggagagaatggatattaggagataataagcagtctttgcttggtacatgaaattaaatcttaagtgacttaatgtatcttctttattgtaaagtcatttgcttgtagcacttttcgtttttgttccatgtactaattccatatgtacatatgtcttcttttctaaagtatgctccctgaagggggaaaacagccatttttatcacatacctagagcctcatacagtgttttgaccatagtcgagaaaacctaggatacaggcgttttatttgaagacaaatttcaggaaacaccagtgaggaagtggagaaaatgaaacaaggaagaaagagaagttgattaaaacatatgttaatgggcaggttaccactgtgggcaactggagcatgattccactagggaagcagtgaggaactctgtggaatataccttaggattgtcactttgagggacagggaagatggggaaattatccaccaatttctcaaactcatcagttaaaagttgccccaggggtattaaattccaagtaatcccagagtttcctacacataagctgagccagctaacacaatatcagataaattccttaattagaggaatttattccttgtatcaagagacacaagcacttgaggtgggaagctgaaagtatatcaggaacttcccatcctggctgcaagtcagctccaaggaggccaaaaagatttgaagcaaggcattcaatagtgtctattacaggaggtattttcttttcaagatggaaggaaggacctaaataagattagaaaggagagtgagggcattttactaatgtcccactgggaagaaataataagtcagttcactatataaatccagatttaagcatatagaagcctgggaaggaaaatcaaatagacacatcacacttgtgtacacgctgacattttctgtctgctgtcttattgatgatttgattgttttttctcatgcagctacctgctccctgatgatagcaaagccaccaagcacaaaactctggtaataaaaaagagtgttaaccctcagtggaatcatacattcatgttcagtggcatccatccccaggatataaagaatgtttgcctagaacttactatctgggacaaggaggccttttccagcaacatctttctgggaggagttcgtttgaattctggaagtggtgagggatttggggacccacagggatggtctgtgactaggcccaggtgggggcgctattcttgcagatgtgatgtgcagtggatgtatatatatagtttcagctaaatcctgaaattaccacaaatacttcattcctttagctaaggatctattcattgttaaaatacaaatataactacagtaactttgtatccttaggctagaagattggaagatatcatatttatattcaatcctttcatagactagcatttacaccttagtctaagtgaattgtaagtactttcttgggccttgcttcatattttgctcaggggatgattaccaagacagcataggcttctgatgggaggagagcgactttcaagaccaacattacttcatcatcttctcagttctgtccagcacttgcagctattattcatactggttgaattgaaaggaaatcattttttcataaaaataacaccagtattgttaaaaacagatcaaggaaacccaccactggtgccacaagacgcaactgtaacagggtgaattggaagagggattacagtagtagagcacgtgcattcccctaactctcattatcccatagcctaagccagacatagatgagaccatcagcatacaccatggtaaacatttctgttgaggaaggtcctatcactatgataattacttatttatagattaaggggagccaaaaatatctataccactaaaaggaaaactccccaggtcagaaaagtgcccttgttagaaaaagagagccaaattcatcccattcttctgtcatgttagcacagtccagatgaaccagctctctgctaaagtagggaggaagtgagtcaccagggccaccccgatttgcctcatatggcctaggcattagagaatagtgcaggctgaaatgattgattgattcaattctaacaccactcactatatatactaagtgagaacaagccagtaaaaggtactctggtgaaaaggcctgctcagaagttgatagataccttgcaggagagcaaagcatttcatgtgtgacataaaattttcccgtttcgcctcttcaggtgtgagccatgggaagaacgtggattggatggactctcagggggaagagcagcgcctttggcagaagatggccaacaaccctggaactccctttgagggtgtactcatgcttcgttccagcatgggaaaatgtaggctctaaagggaccagttctccaagaatgaggccaccaggacctatctggctgtcttttcctaccattagcaaactgagacctgggattctgcttccctgccatttctcacctgacagtgttgggacatgaggggagagatgtcagtagtatgaacatttagggtcttgctgagtgcctaaaaaacatatatttccatccaatcaaggccttcttgattggatgatagaaagtgtactacttgtcctgtcaacaagcaaattgtgcaaaggcttatagggtttatgccataaaagaaatggcacaagcctccatttgctaattataagttactttagatttcctcaaatcctttgaagagaaagaggaccactgagaaggtagatcacttgaaaagtcagaagaaaggatactggccaacttttactcaccctaggaatccacatgatctcaagaaggcatggtggagatggttgcttgagcaaggggattgtcctgttattgcagcaaacttgtggattaaccaagtagtatttcaagatggattgacagggctttctatgattactatagaatttatcatctaaatcagtttactttttagaacaaagagagctaaataactacatcagaacgattgatgttgattagaattgacctgggaaaattgggatgtagggtcaccctactgatgacctaagagagctctgttttaaacatttattttataaaatgttctaagccattaactaaaaggaaatgagatataatggtcaattgatataccttttcacattgtgttcactgacgagactagtttaatgaaaaaggaggtactctacctgctattttacttctgttcctcttctgccctgttatgggagagaatcaaagactccatctgctctcttcccccttgttttctccttcactgagtttttcttatctccttttgcagtggttaactattgtcacaataatgctgaatgaaaaaacacaccaaatgtcagtggcttaaaatgaccatcctttttctcacagttatgaagattggctatggcacctctgcttcctgctataggcctgaggttctagggcttcttatgcctcatcctctttaagccaaagggatagccagagcatcttgatggcagaagtgcaataagatgagccccactgctcgggtacattttcagcccctggttgtgtcatgtctactgatatctcattggtcaaaggaagtcagagggccaagatgaagaggcagggaaatatgcactgcccacagtgaagccatgacaagagtgaggatgcaggaaggcatgaagaattggggccaacagttcaatctaccataccttctctcacctggaattccagatgcttgagctacgaaacttagatgcaaagaaagttaaagctagaaggaacctcaggcccagttgctcattttgcagattccaaatgtgaatttcagagagctgagataacttgcccaaggccatatagaggctgtgactaaatctggacttaaatccagactatcaatcttaggccagtgttcttttttcaatatagtccttggcataatgctatgcttattaggtagataaaagggcttatgtcaagaaatttggagcagagtctgattacttgagcatgaacatacccgaccaaggtatgttctggagtcatattctagcctctgagctcattttttcatgcgagttcatataaaatcctcgaaagtttagaaactaggttttagtagtaacggagctagaatcatcttcgggcttattcctgctagttgttccatatttctagatttcatcttgaattttgaaaactgatttaagaatatatttagtattattattagtaagggaatacgcaatccagtttcaattttattcagaagtaggtcacctaattctagaaaatggttattagtctagtgtcgcttagcaaggtacttaaaagaaaatctgcacatatccttgtgctgcccttcttaaaaacagaaaacaaaaagtgtaagatcatcattgcttcccacataggaaaaataaaatgtcttcagacttgatgtgactca

SEQ ID NO: 1451 - DNA, 122239 bp, Homo sapiens; identical to SEQ ID NO: 1450

SEQ ID NO: 1452 - DNA, 23085 bp, Homo sapiens
tccatttaaaatgaacaatttatttattgcttaaagaacatagaccataaaacactaataatatacctagaaaaaaacccaaacaagattgttaaagaagtcttcataggcattatggcatcttgttcttcctaaccttaactgatgagggttaggaggagaaggctcagaataaggataacagttcataatttcttcatctctgctctaactgttcccttagttggtgaataacaaccagctccatcctaaaaacaacagaacataagcagcagcaaggaatcatccttgagcaggaatgcagtcctgttacctgaacagagacagaacacaatctagtattaactgctgcaaggtaggcacttaaactcactatggcaggtcctagtgcttagtagaaatgacctcgttttttcccctatgttttaggaaatactaaaaaccaaaagaaaagctaaaacatatgcaaaccaaacagctgtacggcctctaggctagactgcctttagaagcatggctgaataatctgctggtaccatagcacagaagcaatataatcaattcttgtttggtgtggtggtgcacaactgtagtcccagctactcaggaggctgaggcggaaggatcccttaagcccaggagtctgaattcagcctgggcaacataacaagaccccatttctaaattaataataataattcccaaattgacaaagagaaagtctcatggtcgagtggggtctttaagtctactacatttttatactggccttttctacatgactacaaactgtgagcatattttaagtagcaaagaaggtacagataaatataactgattcaacataaggcaactgaagggacaaaaacgtgcacagtttcatccaatctgcagtctggatggtgaatccaaggtttgtgggccacgccaatggctctcctcacttcttcagaaaacgctgcaactgttcctgtagggaaatgagctgtagggagaggtagaaagacatgaaaaattcatttgaaatttgaggtcccattacttgatctagaatttacttaaatgaaccaaaaagaactactgttatttggcatttataaggttatcttagtcttgcaatgttccagagaatactggccacagtcaagaatgcatgcatactgctgtggccatgatgatgtcctttattatgcccaatttatgaagagaagctttgtattagtcagttttcacactgctgataaagatatacctgagtttgggaagaaaaagaggtttaatggacttacagttccacatagctggaggcctcacaatcatggtggaaggcaaggaggagcaagtcatatcttacatggatggcagcaggcaaagagaggagaacttatgcagggaaactcccctttttaaaaccatcagatctcgtgagacttattcactatcacgagaacagcatgggaaagacctgcccccatgattcaattacctcccaccaggtgcctcccacaacacgtgggaattaaagatgagatttgggtggggacacagacaaaccatatcaagctttaaaattgaataggctttaaaaaaaaacaatatttttgctgttaagaatttgtgcttctgtgaagaatatacagaggtcacagctcactgtaggggcaaaggagatgggatctctgtagccatattctaagagtcagatgataaaacagttgggacactctcttgtcccaatgaacacaatgggtcttagactgagtcttaccagctgcttcttaccacattaggagatacttagaaactgagccagagccctgaccaatcaggagcctgatgatgttctacttaatgctttctaagttagaagccctgaacattttgtggtataggatttacttttttttaacttgaaatggtaaagtgaccaataacattcagagatgtatgccatctttacaacaaaggttgtttttgaatattattcatttcaggacactccataccagaatgaatttttagtctgtgaaatgaaaggaacattataaaacaatcctatgctgcacatcacctaccaagccacaataattgctgtccgcagtaacttagaggctcttctcactcagttgctgagtgacccctgattgaccatgattacaaccactgactgatccagttctttctcctttgcaggctctttctcttcccaccaccccctatagataggtttttccttaggttcagacttcttgctgaacaatcaaccaggctaactcaactagccccacagcttcaatgatcatttctgtgtatgggcctctctccaatttcccattttcaaaagcacttctccacatacccctccaaatccactttttgttatcctattttcagttaatggcacatcatttcccagtttcccaggctttggactcatctttgttcccctttttgccctgtaaatccaatcaattgttaagctctgtttgcttctaccacttgcacctttgaagctccaggctgtccccactccaatttctcctatatacttctggcagaaaaatcttcctgagttattccccaggtaaaaaggctttgaaggttcattatgacctacaccaaaaatctaaactgttcaccctggcatcaccacctctgagccagtgtgcatgctgctttctcatggaatgcactcctttccctatctccttattaaaaccctacctatattttaaggccccagtcaaacaccatcttctccatgaagtcttctttaatatccatggacaatctgtcattcctttaagtccctacccctcttgccaatttctccccaaatgaagacagagactacatcataagcatatcatagctccctgtagagcctagcttaaagtagacacctactaaatctaatttggataaatgaactaacataagggactctgagtaaataaagtttacagctacatttctatgctgctcctcaatactaaatatagtcatgtgttacttaacaatggggatatgttctaagaaatgcatccttaggcaattttgtcatgacgcgaacatgatagaacatacttacaccaacctagatagtatagcttactacacacctaggctacatagtatagtctatcgttcctaggttacaaacctgtacagcatattactgtactgaatactgtaggcaattgtagcacaatgttaagtatttgtgtatctaaacatagaaaaggtaaactaaaaatacaatataaaaaattaaaaatggtacacttatatagggcacttactatgaatagagcttgcaggactagaagttgctgtgggtgagtcagtgagtgagtggtgagtgaatgtgaaggcctaggacattactatgcactactgaagactatataaacactatatacttaggctatagtaaaataatttaaaaattaagtaattctgctgctatgttatgatggccacagtgtcaccaggtgacaggaatttcttagctccattataatcttatgggactaccatcatatatgcagtctgtcattggccaaaatgttgttatgcagcatacaactgtacttacattgatgaaaacaaagatgtttggtgggtactaaaacaatcctggcattaactgttcatctgattgttttaaagcagtattaagcagtacttggataagtgatttgctgagaggaagggaatatatagaacataaaaattccgctagccttgtggggatgggggtggggagtagtgcctgtacttcaagagcaccatgctaagcccatcctcataataccaactccagtctctttaaaattgtaaccctcaacagtataaggttagagtcagcacacattttctatacagctgcttgaccctcatttagcctatattgccttcttctctcttcgccctgtacactctcttgtggctttgaaaaatacagttgtcgttcaagttagaaatacatacatccttaatgattccttctccttcaacacccagtaattgacccaactcctgtcaattctacctttaaagtatattctctaatatatcaatattcattgcagcattattcataatagccaaaagtgaaagcaacccaaatgtccatcagcagatgaatgaataaacaaaatgtggtatattgatccaatggagtattagtcagttttaaatggaaaaaagtactgatacatgccataacatggatgaaccctgaaaatatgctaaatgagaggagcccgactcaaaacaccatgtattatatgatttcacttgtatgaaataactagaataggcagtagattagtagaaactagatgagtggttgcctagtgctgggcaggggagaggttctggagaagtggggagtgactactaatggatacagggtttctttttggagtgatgaaactattctaaaattgactgcagtggtggttgtacaactctgaatatgctaaaagccactgaattgtatagtttaaatgggtgacttgtcgggggtggggaggacggggtttgaggcagtctcactctgtcacccaggctggagtgcagtggtgggatctctgctcactgcaacctctgcctcccaggctcaagcaatcctcccacctcagcctcccgagcagctgggactacaggcatacaccaccatgcctggctaatttttggagagacggggtttcaccatgttgcccaggctggtctcgaactcctgggctgaagccatctgcccactttggcctcccaaagcgctaggattacaggcacgcaccaccgcacccagcctaaatgggtgatattgtatggtttatgaattacatctgttataaaaacatttttattgcagtttaaaaatctatattctttcaatctccattgctactaacttagtccaagttaccatcctctgttattagagtaccacaaagccccccaaccagcctctttgcttctactctcaccttcttccaacccattctccagataataatcagagtaaccttttaaaagtttaaattaggccagacgtggtggctcacgcctgtaatcccagcactttgggaggccaaggcaggtggatcacgaggtcaggagatcaagaccatcctcgctaacacggtgaaaccctgtctctactaaaaatacaaaaaattagccgggcatggtggcacgtgcctgtagtcccagttacttgggaggctgagggaggacaatctcttgaacccgagaggcggatgttgcagtgagcctagattgtgccactgcactccagcctgggcgacagagcaagactccatttaaaaaaaaaaaagtttaaattagatgtgattttcctatctacaattcttcaaggacttcacattacacttaaggccaaacccatcctccttatcatggccttcaaggaaccatacactatggtctctgcctacttctccaaccttatcttaagccattctcttcctggctttaaatactccaaaggtcctcaaagaagccaagttctttctgagcatgagaccttgcatacgctccacctaagaggctcctcatcccactctttgcctggacttaatccttccggtctcagcttcaatagcacctcctaggagaggtctatcatgatcccccaattaattcaagaccctttattctaatagcaccactgacttttttccttcatagcacttcttcacaatttgtaactttatatttgtataatttgtttattgtcaatctcccctgctagacagctccacgaggataagtacagcaggtccttgaataacatcgttttgtccaatgtcgttttgttacagtaagtcctcacttaatgtcatcaataggttcttagaaactgcaactttaagcaaaatgacatgcaaaaggtctccaaataacattgttagttcaatgtcatttcattataattttttttttttttgagacaggggctcactttgttgcccaagctggagtgcagtggtgtgatcatggctcactgcagcctcaacctcctgggctcaagcaatcctcccaccttagcgtcctgagtagctgagactacaggcttatgccaccacaaccggctaattttttgtacagtcagcgtttcaccatgttgctcagattggtctcaaactcctgagctaaagcaatcctctcgcgtcggcctcccaaaatactggggttacatgcatgagccaccactcctggcctcattataatgttgatgagaaaaataaaatcacttccctgtacacattaggtgaattggtttgtctgaattgtcccagtctgagtgagtgtgggtgtgagtgtgggtgtgagtgtgccctgcaatgggatgccatcctatccaaggctggttcctaccttgtgccctgagctgctgggataggctctggccatctgagaccctgaactggaatcactgggtacataattgtcttacttgtttttatcagtctttctcaaatgtatgtatagctcacatttatttcaacgtttaattattagaagcgttttggtttttatttagaagtttggtgatgtttttgtgaccagaaatatgctataggaacttaattcttctttatatcaattagcctatagtaaaattggtttcattatatatacattattttgcttaaagttacagtttccaagaacctatcaatgacactgaggatttactgtattgcatttgtcttattcaacaccgtacatccagtgcttttcacttcataggcattcaatatctgttgaatgagtgaattttcacaaagaccttgttccaccctgctaccttcatttagaagatttggctaccactattcctatgagaggaacagccagcaatgatattggaattgaagtgggggattctctgtatcaaatgttttctggttaatttgaaaacatacttcttaccttctcatttttttgtttttcctgtaactcaagctgctccagcacagactgaaaatgattctgaaaaataaattgtataaatgatgaacactgagtctcaaagaaaaaaaaaaaaaccaagggaggcaaggagtttggcaaataattgtttttgtttttgtttttgaggcggaatcttcctctgtcacccaggctggagtgcagtggcgcaatcttggctcatgcaacctccgcctcccaggctcaagtgattctcatgtctcagcctcctgggtagctgggattacaggagcatgccaccaggcctggctaatttttgtatttttagtagagatgaggtttcatctctactaaaagatcccttactcagggatcatttactgtgatccctggcaagttacttaacctctttgagtttccattctttatctataaaatgggagtggtgacagtatttacgtttcaaggatgtgaggataaaatgtgataatatgtgtacacaattcttagccctttatgtgccttttacatagcaaatgctcaatattggcaatttttatctcatatcacctagtcccttccccaaaatgcttatattagatgatcaaaattactcaggtaaaaggaaacagggttatcttttattaggagtttctaagaggctgtttaggttcatgaatgaacaagaaccctgcacagagataacataagtggaaacacaaaggcaagatactgaaagtaagatatcaggatttctttatgccagccaagaatttaccttgagtgtcaggttttccactttcatgatgagatccttctgtctttgtgctttattctgaatcttatggagctttttctcctttttctcaatctgcttctgaatttccatgactaatagagaaacatagaactttatatattaaatatagcctaaatgaatggaccaagatccaaatcaagtaaaactctactacacatcgaagcgataacttcttgagcttagctttgagtctaatgtatgcttagagtcaactgttagcactgccacccaccctggtcccatccctttgttttttctgacttacctattgaactggtaccttcatttgccctatactggccagattcaataaactcggcctgcagctgcctttccagatactcttcagaacaatcttcctcctcctcttctttgtcttcatcttcatcctcatcctcatcctcatcctcatcttcatcatcctcatcctcatcatcatcattgttacttctagaatcactgaacatctcccgaagcatatcatattctactagttttaagcaagaagaaggtgaactatctaaaactctgcaaatgactcatactccagatataattatactcctttcacattccccaggcaaccagtgaattttataaatcattttttcatgcaggaagattattccctttataaaacaaggacagcaaatgcaaaacactgtaacattcattcatgtagtgaatgatcaagatatttagagactctaagggtcataggaagttaaaataccaggggtggatgggagattagaacactaatctaaaacccctaaactgccaagagaccaataagagggaagaagggctgggtgtggtggctcatgcctgtaatcccagcactttgggaggccaacgcgggcagaacacttgaagccaggagttggagaccagcctggccaacatggcaaaaccccatctctacttacaaaaaaaaaaaaaagaaaagaaaaaagaaaaattagcttggtgtggtggtacatgcctgtaatcccagctacttgggaggctgaggcacaagaactacttgaacctgggaggcagaggttgcagtgagccgagatcgcaccactacactccagtttgggcgacagagcgagactctgtctcaaaaaaaaaaaaaaaaaaaaaaaaaggccaggcacagtggctcatgcctgtaattcaagcactttgggaggccgaggcaggcagatcacttgaggtctggaattcaagaccagcctggccaacatggtgaaaccccgacgctagtaaaaaattagctgggcatggtggtgaacacctgtaatcccagctacctgggaggccgaggcaggagaatcacttgaactcatgaggcagaggttgtagtgagccgagatcacgccactgcactccagcctgggcgacagagcaagactccatctcaaaaaaaaaaaaaaaaaaagagggaaggacgaaaccatcctttttttctgggtttttttttttttggattggcctatgaatttatggaaaatgatctgatacccagtcaatacctgccctatctgaaactcctgctttgcctttactaaagtacctgacgaggtatgaccctgcttgtggctgctcattcccgaggatatcaaaaatcctgggatggagccttgactttctatttccttggttccatcttcagcaatgacttcccaacctgaaaggagtgggtagtcaaggaaaacacagaaggaaacaaaaaggcacagctgaaagggaaggggctctttggctaacagtgctatttaatttagtccaactttaggccatttgtattggaattcctagtttggagaagtgcctcatattgaattacacaataaataattttctattacatgaatttactgttcctagctagaacatttcaaagaatcttaagttccacacatcaagactggcacacaaacaccagaggtgaggcttcgtcagcatgtacaaatggggcagaacagactatgcagaaaatatttgtataaaggatacgggtacttacggcttcagcatccgaacgcagcagtctctttacttcattttccacgtctggagattcaatgtactgaagcaaagttggggattagagggggataccaatactgtcatttaacaccctgtgtgttgcaggagtgccctcctacgtaccaacgaattcaaatgttaggcctctttaaattctgatccaaccaaatttctactttaagtagtgctatttataaaggaatctttagccagggtctagaattttgtacagtaaacttacttttttcctaattaaacaaattacttgagacatttaatcttttcaatctgcagctctatggtaaagccctctctcagaggtgcaacccttaggtctcagttataaattatttctcctgatttatattggcaaagaactataattccttattagttatttagaaataatttggtttaaagatccaaattcccagatttcacttccccacatctttattattagagacgttcctataaaaactggatcttagctgcatgttctcccttgaatccagttttacataattatctccacagcaaccaatttgttgtgccacaaatagaaattaggattttgatggggaataagcaattgcaaacaactgctgttaaaagtgagctctggctcccaaggaatggcttttgaaataaatatcagaataaaaagagcagattagaatacacggggtcactggccaaattgtatcttttcctctagcagttatcaaacatcaaacaatgaattcattttttagtgaatcaaacccagtgtatgtgtttaggatgagggttagaggtgagaaggaaggctcaaaagtagcttctgtggtttatttgattcatttgaaactaatgagctattaaataaaacacattaagggtaaaaatgaagttatattatgattgctctacctcagtaaagctgcttttttccatttctttgacatcagggacctatgaaataaaacacaataaacaagttatattatgatacctatatttcagtaaagcttaaagagctctacaactatccttaacttagttttacatttagtaggcactcaataaatgttgatttacagagtataaaagccaaggcaactgtgttcatggattggaagactcaatatagtaaaaatgtcagttctccccaaattgatctacaagtttaatgtaattcctgccaaaattctagcaaggttttctatagctatagacaagcttattctaaaatttatattaaaagatacaggcttttggccaggcgtggtggctcatgcctgtaatctcagcactttgggaggccaaggcgggcggatcacgtgaggtcaggagttcgagaccagcctggccaacatggtgaaacccgtctctactaaaaatacaaaaattagccgggcatggtggcccatgcctgtaatcctggctacttgggaggctgaggcatgagagtcgcttgaacccgggaggcagagactgcagtgagcagagatcgtgccattgcactccagcctgggcaacagagcgagactccatctcaaaaaataaataaataaataaataaataaagatatggactctagaatggctaaacaatattgacaaagaaaagtaaagtcagagcaatcagccttctaatttcaggaccaattatatagcgacactgtgatattggtggagggattgacagatggatcagtggaggagaatggagaacccagaaacagacccataaaaccaagcccaactgatatttcacaaaggtgcaaaagcaatacaacagaggaagaatagccttttcaacaaatagtgcgagagcaattagacatcctttggcaagaaaagcaaaaacaaacaaacaaacaaaaacaaaacaacaacaacaacaaaaaaaaaaccttgaactaaacctcatagcttttacaaaaattaagtcgaaaatgggcatcaggcttaaaaagatgtaaaaaaaaaaaaaaagcaggagaaaatcttcaggatctgggctaggcaaagagttcttagatttactataaaaagcaagatcgttttcaaaaaaatcaatatattgtacttcatcaaaactaaaaacttttgctctctgaaagaccctacgaagaggatggaaagacaagctacagactgggagaatatatttgcaaactacatatctgataaaacactggtagtatttaaaatataaaaagaactctcaaaattcaataataaaaaatcaatttagaaaataggcaaaaggcatgagcagacatttcgctgaagtggaatagatggcacatgagatgctcaaccccgttaaccatcagggaaatgtaaattaatactacaatgggatcactatgcacctatcagaatggctaaaatgaaaaatagtgacaacacctaatgctggtgaggaggtggagaaactggatcattcatacattattggcaggaatataaaatggtacagtcactctggaaaacaggtcatttcttacaaaactaaacatgtgactaccatatgacccagcaattatactcctggacatttattccaaagaaatgaatacttatattcacacaaaaacctgttcacagctttatttataatagtcaaaacctgtaaacaacccagatgtccttcaaagggagaacagttatgtaatgtggtacattcataccatggaatactactcagcaataaaaaataaactattgatgctacaaaaacttatatggatcttaagtgaattatgctgaatgaaaaaataagctagtctctgatgttatatactatataattccattaatattaaatttttgaaatgacaaaattacagagatagagatcagattagtgattaccaagtgtcagagactggggtgtgaggtggaagggaagtgggcatggttatataaaagcaaaatgagggatccttgtgatgaaactgttttgtattttgactgtgtagacagatacatgaacttacacatgggataaaactgcatagaactaaacacatgcacaaaaatacacgagtacaagtaaaactggagaaattggaataagattgcagaattctaatcatgtcaattacctgtttgtggtattgtactatagttttgcaaaatggggaaaatggcgaaagggtacacgatatctctcttttatttcttacaactgtatatgaatttacaattatttcaaaataacatgtttaattttaaacaaaagaagaagccaagccacaatactcctgtagtttgcccaagattctacaagcctgaaataacattaggaatataaccacaattcccaattttcaggttctggatgggttcactttaaaactagatcttgcaatagaaaactgaaagcattaacagaagtttcaaatgtatgattcttccagaccccaaatgactagcctataacctcaaggatcaggtctttttattcactgctatattccctactgctagcatacagtgcctggcatttagttcacattcaataaatgtttattgaacatataaatgaattaaaaattaattcccaactgactttttctcttttcttctggcccatgatcctcttctaatcggcccggcagacacacaaatagcatgtaactaacctttttttgtgttttccggaaccttttctttctgacattcttaagtggtggcgtaactaaaataaatacaacacagtgaaacgttatatgactgatggtagtcacatagctgaatttgataaagacaaagatcatgctataaaccaaagggtcatgacatcactccttttttttttttttttttgagatcgagtcccactctgttgcccaggctggagtgcagtggtgcgagctcagcttactgcaaccacctcctcctaggttcaagcgattctcctgcctcagcctcccgagtagctgggattacaggtgcccgccaccacacccaactaatttttgtatttttagtaaagacagagtttcaccatgttggccaagctggtctcgaactcctgacctcaggtgatccacccgcctcggcctcccaaagtgctgggattacaagcgtgagccaccgcgcccagctgacgtgactcctcttaaagagtatctgagaacctaatgaaccaaacacctaagtgtggtaagacgtccctgtttcacaaggaattaggattcagcaaataaattttagtcagcaggaatgagcaaggggctggtgacttactgccatgcttccagacacatttttcttctctccccctttcttttttcctgactatattaggatcagtagaggcagctggttcttctggagaaaggtggatatcaccatcagcagtgcacacaagcatctacatttaacaaagacaaagaagttgactatgaccacgaattttgggttagcaatcataatcattcttaccactagaaatgcacagaagagactgatacttgccatttccagaaaaccaagtattttgtaatgtacatttatattctctcatttttgcagtctctctctctccctctcctccccaccaccagccaccagcagcactacatatgaactctgaaggtgctttgttttgtttttttttttccacgagagtgtttaccactacagagggaatatattggaaacagatcttggaacttagcttaggttttttgttttgtttttagacaaagtcttgctctgtcatacaggctggagtgcagtggtacgtgatcatggctcactgcaccctcgacctcctgggctcaagtgatcctcccacctcaatctctagaatagctgggactacaggtgtgtgccaccacacctggctaatcttgtttttgtagagatgaggtctcactatgttgcccaggttggtctcaaactcctgggctcaggtgatcctcccacctcagcctcccaaagtgtagggattataggcatgagccattgtgtctggcctatctcagcattttgatttagagaggaaataagaaatcaacagcagagatgatgaataagaaccaatttaaacctccagagttaacaacatactgttttaatacaaagttcagaagatcccagcagctcatatgtttcaattaatgaaaagtcactataagtggcaaatgggactctctataggctatttggtcaaaatacaatactgaaagctaaggatcaaacaccaaacgagaacatgacatttcattcctgtgcagtcaatctggaaattagaaatgccaagcagccattcaccaagtggaaaggagtactgaaagaaagaaaaataggaagagaaaagaattccttgaaggatgtgaggctagtaaagaaaactagtccatacctgagaaatgtctgctgttttataaaaggtttttttatcaagcgttctcaggctttcaataacacaaggcaagtcaaccagcttagcagctagtgggacatcttctacttcaacaactgcatggcgcccatcagctgaagagaagtaaagattaaagttgatatcttcccagtgaactcttaaacttcctaaggtttgaataatgaagacttatgtgggacagattagtctttccaagaaacctactatctctcataatgctagaattgtgtacacaattaatagcttcctaaagaaaagaaatggaaagtatatggagctcttttttcctagtttacgtcacttgtgcaaaagtagctaagtttcttgttaatggatgtgaactaaatataggtgaagtaataaatgtttcattctcatcctgaaaagcaaattccattcattaaaaccaattcctttttttttttttttagaagcattcaatcgtgtcattgtacatgtgtgttttcaaagggctgggtgagggaagggttgactgaccctagaatggtgctaataaatctcaagttaaatctctaattagcttcataaagataaaattctatacaacagccatatactaaactctgaatattgctgctcagatgtcccaaacataaatgtcttttgacacaagaggattcaggtataatcttctagtattatgtgaaaaaagaaagatacaaaacaatgtttatcattttgtgtgaattaactctaaaaatagagagattgcttcaattctagtattatgcataagagttttgtcaataaggaagtaacaagaaacagtatcagttatctgtggtattgaggttggggcaccataaggaagaagagttttatttctcctttcgaacttttctttttcatttgatttttttatttttctttgagaaggagtctcactctgtcacccaggctggagtgcagtggcataatctctgctcactgcaatctccgccccctgggttcaagcaattatcatgcctcagcctcccaaatagctaggattacaggtgtgcaccaccatgcccggctaatttttgcatttttagtagagacggggtttcgccatgttggccaggctggtctggaactcctgacctcaagtgatccgcccgcctcagcctcccaaagagctgggattacaggcatgagccatcacacccagcctgttttatttgaattttctaactatgaacttatattatcttttttaaaaaatgtcagtaagtgttaactaactggtgagattatgagccactttttgttttctcctttatatgcttctctgtattaaaaaaaaaaactagcaaaatttatttatttttggttgtgtgttttttaggcagataaacttgtgtggaaacatttatttatttatttacttatttacttatttatttacacatgctcttggtgcaaatggcctctagattcatccatggtgtcccaaatgacagaattttgttctttttaaaaggctgagtagtatagcattgtgtatacgtatcacatttacacttaggttgattccatatcttggctattgtgaataatgctacaatgaatatgggagtgcagagagatatgccttcaacatgttgatatcaattccttctgtgaatatattcacagaagtggggttgctggatcacatggttgttctatttttagttttctgaggaacctccataccatttaaaaaaaataatggctgtaggccaggcacagtagctcacgcctgtaatcccagcactttgggaggctgaggtgggtggatcactcgaggtcaggagttcaagaccagcctggtcaacatggtgaaaccccatctctaccaaaaatacaaaaaaattagccaggtgtggtggcgcatgcctgtagtcccagctactcggaaggctgaggcaggagaattgcttgaacccaggaggtggaggttccagtgagccaagatcgcgccactgcactccagcctgggtgacacagcaagactccatctcaaaaaaaaaaaaaaaaaaaaaaggctgtattaatttacattaccaccaatagggtacaaagtttcccttttctcctcatcctcattaacagttgttattgttctttttttttttttaataaaagccattctaacaggtatgaggtgatatctcgctgttgttttaatttgcattcccctaatgattagtgatgctgagcattttttcatgaaccttttggctacttgtatgtcttcttttgagaaatatctgttcagatcctttgcccattttaaaatcaggttatttgttttcttgctattgagttgtttgagttccttatatatttggatattaaccactttattggatgtacaatttgccaatataacaaatattatttaaaagaaaaatatatgtcactggccaggcacggtggctcacgcctgtaatcccagcactttgggaggccaaggcaggcggatcacaaggtcaggagtttgagactagcctgaccaacatggtgaaaccacgtctctactaaaaatacaaaacttagccgggcatggtggcatgtgcctgtaatcccagctacttgggaggctgaggcagaagaatcacttgaacccaggaggtagaggttgcagtgaaccaagattgcgccactgcactccagcctgggcgacagagcgagactccatctcaaaaaaaaaaaaaaagaaagaaagaaagaaagaaagaaagaaatacatgtcacctttataaacaaagaatggcatatccatttgtcattcccttggatgttcagaaatcataaagtttatatatgggaggctaccagcagtataaaaaccccacagttgacccccaagtttccttaaacacactatgataatcactcaactcaaggtgcaatattcctacttcctttcctcttaaaagaagaggacttaagcctctctaaagcatgagtccatcaagtcagagaccatattctatcatttttcacatccttagtaccaagtacagtgtatggcacatagcaatcccttaataaattattgttcaatgtatagtgaatggatattaactacttacgcaataagtcaatttttagtttatccttcatcttgacactttgagaacgtgctaggttcctgacagtacaagcatgttcctaaaaaggaggtaaattgaaaaatcagaagaactaaacatctacttggcagctaacagaatagatatatcaaagaaagccctcccttaaataaaactttacacctcccaaatgttactaacaagaccatgtaccatgagatactgtgcactgtataagtcaagttaggatgaagctgactctaaactcataattgtctcttagtagctacagttaatgctttctcctagctctacaatcctgcctctcactgctacccttctgttgtagttgctaaagaaaggcttacctagttgcagtttgcttggtatattaagtaaccctaattagggaaataggtttctgaaccccatccttaatatagctgcctagactaagtaattgcttgaatacaggtatcagtgtgggggaagagagccaaatacttgttgagatgagctttaaaagtcttgcatggtggtgaataatgctggcccttctcactgccccttttgaggtgacagaaaggatttcagaggagccgtatcttggctgtccagggaacaggctgttagtattggtggtaagtgaatgggtccatcattgtcacagctgttttgccaggaaatcaacctgcatgataggtggtattgtacaggaggaaaaaatgctgccaaaaaagtacacgctatgataggactgcttaacagaacatgattcctgggaaacaaatgttctgagtttttatagcctacctgaaatagaaatgtcagaatccaagtagaactataattataattaaactataattatgaagatatttgttctgagatacaagttcttaccagaggcagacgcaatataaactggttctcaacttcatcaggaacttcatcctggctttcactcatgtcttgattttgagttcatgaaagcaaaaagaaaaccatcactaaaaactcctcttgctccctctcctgaccacttctggtagtactggctaaattatacaagatcttgcccataatcctcactagaatgatgtgtgtacagttagacaataccttatttgacataacttaattatttctagacgttaccttagctcctctccaatatgtgtagattttccaaagtcaatccaaattacatgatgtaatttgatgaacaaatgaaataagagctgttatgaaacatgatttcgtcttcttaatcatattcttagactctcaggtaaaagactacaattcaacaacacgttggtggctacctaagcaaactaacctctgtagggaagaatgcaaaccaaaagctgaaattcgcctagaaaccacttgcataaatgttctgtgatgatttgaagtaaacaagggcttgattttcaatatttcacctacattaatggattagtagaaattaagcagtccatgggagaccaggcagttttttatgactctagagccagcaacaacagctttgagctaccctggggaaaagttaggagtccagttcttttttttttttttcaagacagagtctcgctctgtcgcccaggctggagtgcagtggtgcgatctcggctcactgcaacctccgcctcccaggttcaagccattctcctgcctcagtctcccaagtagttgggactacaggcatgcaccaccacacctggctaatttttgtattttttagtagagacaggatttcaccatgtcggctaggctggtcttaagctcctgaccccaagtgatccgcccacctcagcctcccaaagtgctgggattacaggcctgagccaccgcgcccagcatggaatccagttctttttttttttttgagacggagtctcttttttttttctttttgagatggagttttatggagaacataaaatctgatttgatttattcgttactaccctttcattcattactaccctttattgtgtgcattctgtatgcccagtactacattgagtgcattaggtctatcatttcatataatcctcacaatcaccacttacttcgaatgcccccaaaagctatttaaaagaactcctaagatggatctttttatttaaaatatatatatatacctttggtgaagtgaatactttcttccaagttaatctttttttgacaaattataatcatatataattatggggtacacaatgatgttatgatatagtgtgaaatgactgaatcaatctaatgagcacatccatcaccttaaatacttatcagttattccccctaactgcaactttcattttttttaattttaaaagccaaatttggaagtgggagattgtataccaactttagtggcattaatgttaataagttgtgataatatcccactactattggaccagcctaactgaaattttctgttctttgatcaacatctcctcaatgcccctcccgctactccagcctgtaataaccaacactactctctgcttctatgagttcaattattttagattccacatataagtgagaatatgtgatttttgtctttttctgcctggcttatttcacttaatataatatcctccagattcatccacgttgttgcaaatgacagaatttccttctttttaaaggctgaatagtattcagctgggtacacataccacatatttatccattcacttgttggatacctagattgatttcataacttagctattgtaatgctgcagtgaacatgtgtgtgcggatatttctttgacacactgatctcaagtttttaggatatacatctagacgtgggattgctggatcccaagtttttattttattattttttattgttttcattatttgtttttcaattttatgttcttacaatgaaccaagactttatttctaatcttattttccatgtatttgggatgtatttgtagagccctgcattttgggtattagggcccacacttttgttttgttttgttttgagacagagttttgctcttgttgaccccaggctggagtgcaatggcacgcatctcagctcactgcaacctctgctgcccgggttcaagtgattctcccatctcagcctcctgagtagctggcattacaggtacctgccaccacacccggctaaattttttttttgtatatttagtagagacagggtttcaccatgttggccaggctggtctcgagctcctgacctcaggtgatccacccgccttggcctcccaaagtgttgggattgtgggcatgagccactgtgcccagccaggcccacacttctgaggaagatttttctcaaaggtggaaagacagctgggcgctgtggctcacacctgtaatctcagcactttgggaggctgaggcaggtggatcacctgaggtcaggagttccagaccagcctggccaacatagtgaaaccccatctctactaaagatacaaaaattagctgtatctttacagctagttgggaggctgaggcaggagaattgcttgaacccaggagatggaggctgcaatgagccgagatggcgccactgcactccagcttgggtgacagagtgagactccttctcaaaaacaaaacaaaacaaaacaaaacaaaaaaagtcagcagtagaaaagcagacacccaggatgggagagggaaagatgcattatttgtgattgtaatttcttctcttcttgtttcatacagatatatatgtatatatatgcatatataaatacaaaagagaaatgtaaatgcaagaagagagttgatcgaaataaataaaaaatctgggggctgagcacattccctaacagaacatagtaacaattaaggctgggagcaggaacagattatttgaagaactagctgctaagcaagattttatcagatcagtagtaacttttagatttctcagcagaactaaaactggggcattttgttcatttccaagcctttttggtaattcctcttttatggaagaaagaatgtaagaactgaaactatttcaatgtatttgtttgataaacagacctaataaaaagtctggtgggagaaaagttagacaatcctggttgaactgggttttaattattttttaaatttacttgcatttacctaaaagactagttgtacggtattcactttaagaaaaagcatccacttttttccagcaagcactctttgatgcctgattaaattaacaggaccccttactaccattcacctctagttccatctcgctttagcagaattacaattggaattataattggctggagggcgcctggcagcatgctccaggccatgcaagtcagtacacgcctaaatgggtgttttttcaagttcgcagtctccggctgcagtttaagagactgacctccatccttatccccggggcactaagctttcaaagagaaagtttgacccctaggctttgatccactttcccttgaaaacttctcgcgaggcccaacaggtcgcaacgggtcccagccttcgcgcctcgctgtgcaggctggctggggagggctgcggggtgcaccgcggcggggtgcacactggcggggcgctgacccggtcccggccgcccggtcggccgcccgactcacccgctcctccgggaactggcgccgacaccgaaaaggctgggacctgcgtctctggtctgtgggttccggacgaaccgcgcgtgggctcccgcgcggaacgtagaggcgaacgct

SEQ ID NO: 1453 - DNA, 24819 bp, Homo sapiens
tccatttaaaatgaacaatttatttattgcttaaagaacatagaccataaaacactaataatatacctagaaaaaaacccaaacaagattgttaaagaagtcttcataggcattatggcatcttgttcttcctaaccttaactgatgagggttaggaggagaaggctcagaataaggataacagttcataatttcttcatctctgctctaactgttcccttagttggtgaataacaaccagctccatcctaaaaacaacagaacataagcagcagcaaggaatcatccttgagcaggaatgcagtcctgttacctgaacagagacagaacacaatctagtattaactgctgcaaggtaggcacttaaactcactatggcaggtcctagtgcttagtagaaatgacctcgttttttcccctatgttttaggaaatactaaaaaccaaaagaaaagctaaaacatatgcaaaccaaacagctgtacggcctctaggctagactgcctttagaagcatggctgaataatctgctggtaccatagcacagaagcaatataatcaattcttgtttggtgtggtggtgcacaactgtagtcccagctactcaggaggctgaggcggaaggatcccttaagcccaggagtctgaattcagcctgggcaacataacaagaccccatttctaaattaataataataattcccaaattgacaaagagaaagtctcatggtcgagtggggtctttaagtctactacatttttatactggccttttctacatgactacaaactgtgagcatattttaagtagcaaagaaggtacagataaatataactgattcaacataaggcaactgaagggacaaaaacgtgcacagtttcatccaatctgcagtctggatggtgaatccaaggtttgtgggccacgccaatggctctcctcacttcttcagaaaacgctgcaactgttcctgtagggaaatgagctgtagggagaggtagaaagacatgaaaaattcatttgaaatttgaggtcccattacttgatctagaatttacttaaatgaaccaaaaagaactactgttatttggcatttataaggttatcttagtcttgcaatgttccagagaatactggccacagtcaagaatgcatgcatactgctgtggccatgatgatgtcctttattatgcccaatttatgaagagaagctttgtattagtcagttttcacactgctgataaagatatacctgagtttgggaagaaaaagaggtttaatggacttacagttccacatagctggaggcctcacaatcatggtggaaggcaaggaggagcaagtcatatcttacatggatggcagcaggcaaagagaggagaacttatgcagggaaactcccctttttaaaaccatcagatctcgtgagacttattcactatcacgagaacagcatgggaaagacctgcccccatgattcaattacctcccaccaggtgcctcccacaacacgtgggaattaaagatgagatttgggtggggacacagacaaaccatatcaagctttaaaattgaataggctttaaaaaaaaacaatatttttgctgttaagaatttgtgcttctgtgaagaatatacagaggtcacagctcactgtaggggcaaaggagatgggatctctgtagccatattctaagagtcagatgataaaacagttgggacactctcttgtcccaatgaacacaatgggtcttagactgagtcttaccagctgcttcttaccacattaggagatacttagaaactgagccagagccctgaccaatcaggagcctgatgatgttctacttaatgctttctaagttagaagccctgaacattttgtggtataggatttacttttttttaacttgaaatggtaaagtgaccaataacattcagagatgtatgccatctttacaacaaaggttgtttttgaatattattcatttcaggacactccataccagaatgaatttttagtctgtgaaatgaaaggaacattataaaacaatcctatgctgcacatcacctaccaagccacaataattgctgtccgcagtaacttagaggctcttctcactcagttgctgagtgacccctgattgaccatgattacaaccactgactgatccagttctttctcctttgcaggctctttctcttcccaccaccccctatagataggtttttccttaggttcagacttcttgctgaacaatcaaccaggctaactcaactagccccacagcttcaatgatcatttctgtgtatgggcctctctccaatttcccattttcaaaagcacttctccacatacccctccaaatccactttttgttatcctattttcagttaatggcacatcatttcccagtttcccaggctttggactcatctttgttcccctttttgccctgtaaatccaatcaattgttaagctctgtttgcttctaccacttgcacctttgaagctccaggctgtccccactccaatttctcctatatacttctggcagaaaaatcttcctgagttattccccaggtaaaaaggctttgaaggttcattatgacctacaccaaaaatctaaactgttcaccctggcatcaccacctctgagccagtgtgcatgctgctttctcatggaatgcactcctttccctatctccttattaaaaccctacctatattttaaggccccagtcaaacaccatcttctccatgaagtcttctttaatatccatggacaatctgtcattcctttaagtccctacccctcttgccaatttctccccaaatgaagacagagactacatcataagcatatcatagctccctgtagagcctagcttaaagtagacacctactaaatctaatttggataaatgaactaacataagggactctgagtaaataaagtttacagctacatttctatgctgctcctcaatactaaatatagtcatgtgttacttaacaatggggatatgttctaagaaatgcatccttaggcaattttgtcatgacgcgaacatgatagaacatacttacaccaacctagatagtatagcttactacacacctaggctacatagtatagtctatcgttcctaggttacaaacctgtacagcatattactgtactgaatactgtaggcaattgtagcacaatgttaagtatttgtgtatctaaacatagaaaaggtaaactaaaaatacaatataaaaaattaaaaatggtacacttatatagggcacttactatgaatagagcttgcaggactagaagttgctgtgggtgagtcagtgagtgagtggtgagtgaatgtgaaggcctaggacattactatgcactactgaagactatataaacactatatacttaggctatagtaaaataatttaaaaattaagtaattctgctgctatgttatgatggccacagtgtcaccaggtgacaggaatttcttagctccattataatcttatgggactaccatcatatatgcagtctgtcattggccaaaatgttgttatgcagcatacaactgtacttacattgatgaaaacaaagatgtttggtgggtactaaaacaatcctggcattaactgttcatctgattgttttaaagcagtattaagcagtacttggataagtgatttgctgagaggaagggaatatatagaacataaaaattccgctagccttgtggggatgggggtggggagtagtgcctgtacttcaagagcaccatgctaagcccatcctcataataccaactccagtctctttaaaattgtaaccctcaacagtataaggttagagtcagcacacattttctatacagctgcttgaccctcatttagcctatattgccttcttctctcttcgccctgtacactctcttgtggctttgaaaaatacagttgtcgttcaagttagaaatacatacatccttaatgattccttctccttcaacacccagtaattgacccaactcctgtcaattctacctttaaagtatattctctaatatatcaatattcattgcagcattattcataatagccaaaagtgaaagcaacccaaatgtccatcagcagatgaatgaataaacaaaatgtggtatattgatccaatggagtattagtcagttttaaatggaaaaaagtactgatacatgccataacatggatgaaccctgaaaatatgctaaatgagaggagcccgactcaaaacaccatgtattatatgatttcacttgtatgaaataactagaataggcagtagattagtagaaactagatgagtggttgcctagtgctgggcaggggagaggttctggagaagtggggagtgactactaatggatacagggtttctttttggagtgatgaaactattctaaaattgactgcagtggtggttgtacaactctgaatatgctaaaagccactgaattgtatagtttaaatgggtgacttgtcgggggtggggaggacggggtttgaggcagtctcactctgtcacccaggctggagtgcagtggtgggatctctgctcactgcaacctctgcctcccaggctcaagcaatcctcccacctcagcctcccgagcagctgggactacaggcatacaccaccatgcctggctaatttttggagagacggggtttcaccatgttgcccaggctggtctcgaactcctgggctgaagccatctgcccactttggcctcccaaagcgctaggattacaggcacgcaccaccgcacccagcctaaatgggtgatattgtatggtttatgaattacatctgttataaaaacatttttattgcagtttaaaaatctatattctttcaatctccattgctactaacttagtccaagttaccatcctctgttattagagtaccacaaagccccccaaccagcctctttgcttctactctcaccttcttccaacccattctccagataataatcagagtaaccttttaaaagtttaaattaggccagacgtggtggctcacgcctgtaatcccagcactttgggaggccaaggcaggtggatcacgaggtcaggagatcaagaccatcctcgctaacacggtgaaaccctgtctctactaaaaatacaaaaaattagccgggcatggtggcacgtgcctgtagtcccagttacttgggaggctgagggaggacaatctcttgaacccgagaggcggatgttgcagtgagcctagattgtgccactgcactccagcctgggcgacagagcaagactccatttaaaaaaaaaaaagtttaaattagatgtgattttcctatctacaattcttcaaggacttcacattacacttaaggccaaacccatcctccttatcatggccttcaaggaaccatacactatggtctctgcctacttctccaaccttatcttaagccattctcttcctggctttaaatactccaaaggtcctcaaagaagccaagttctttctgagcatgagaccttgcatacgctccacctaagaggctcctcatcccactctttgcctggacttaatccttccggtctcagcttcaatagcacctcctaggagaggtctatcatgatcccccaattaattcaagaccctttattctaatagcaccactgacttttttccttcatagcacttcttcacaatttgtaactttatatttgtataatttgtttattgtcaatctcccctgctagacagctccacgaggataagtacagcaggtccttgaataacatcgttttgtccaatgtcgttttgttacagtaagtcctcacttaatgtcatcaataggttcttagaaactgcaactttaagcaaaatgacatgcaaaaggtctccaaataacattgttagttcaatgtcatttcattataattttttttttttttgagacaggggctcactttgttgcccaagctggagtgcagtggtgtgatcatggctcactgcagcctcaacctcctgggctcaagcaatcctcccaccttagcgtcctgagtagctgagactacaggcttatgccaccacaaccggctaattttttgtacagtcagcgtttcaccatgttgctcagattggtctcaaactcctgagctaaagcaatcctctcgcgtcggcctcccaaaatactggggttacatgcatgagccaccactcctggcctcattataatgttgatgagaaaaataaaatcacttccctgtacacattaggtgaattggtttgtctgaattgtcccagtctgagtgagtgtgggtgtgagtgtgggtgtgagtgtgccctgcaatgggatgccatcctatccaaggctggttcctaccttgtgccctgagctgctgggataggctctggccatctgagaccctgaactggaatcactgggtacataattgtcttacttgtttttatcagtctttctcaaatgtatgtatagctcacatttatttcaacgtttaattattagaagcgttttggtttttatttagaagtttggtgatgtttttgtgaccagaaatatgctataggaacttaattcttctttatatcaattagcctatagtaaaattggtttcattatatatacattattttgcttaaagttacagtttccaagaacctatcaatgacactgaggatttactgtattgcatttgtcttattcaacaccgtacatccagtgcttttcacttcataggcattcaatatctgttgaatgagtgaattttcacaaagaccttgttccaccctgctaccttcatttagaagatttggctaccactattcctatgagaggaacagccagcaatgatattggaattgaagtgggggattctctgtatcaaatgttttctggttaatttgaaaacatacttcttaccttctcatttttttgtttttcctgtaactcaagctgctccagcacagactgaaaatgattctgaaaaataaattgtataaatgatgaacactgagtctcaaagaaaaaaaaaaaaaccaagggaggcaaggagtttggcaaataattgtttttgtttttgtttttgaggcggaatcttcctctgtcacccaggctggagtgcagtggcgcaatcttggctcatgcaacctccgcctcccaggctcaagtgattctcatgtctcagcctcctgggtagctgggattacaggagcatgccaccaggcctggctaatttttgtatttttagtagagatgaggtttcatctctactaaaagatcccttactcagggatcatttactgtgatccctggcaagttacttaacctctttgagtttccattctttatctataaaatgggagtggtgacagtatttacgtttcaaggatgtgaggataaaatgtgataatatgtgtacacaattcttagccctttatgtgccttttacatagcaaatgctcaatattggcaatttttatctcatatcacctagtcccttccccaaaatgcttatattagatgatcaaaattactcaggtaaaaggaaacagggttatcttttattaggagtttctaagaggctgtttaggttcatgaatgaacaagaaccctgcacagagataacataagtggaaacacaaaggcaagatactgaaagtaagatatcaggatttctttatgccagccaagaatttaccttgagtgtcaggttttccactttcatgatgagatccttctgtctttgtgctttattctgaatcttatggagctttttctcctttttctcaatctgcttctgaatttccatgactaatagagaaacatagaactttatatattaaatatagcctaaatgaatggaccaagatccaaatcaagtaaaactctactacacatcgaagcgataacttcttgagcttagctttgagtctaatgtatgcttagagtcaactgttagcactgccacccaccctggtcccatccctttgttttttctgacttacctattgaactggtaccttcatttgccctatactggccagattcaataaactcggcctgcagctgcctttccagatactcttcagaacaatcttcctcctcctcttctttgtcttcatcttcatcctcatcctcatcctcatcctcatcttcatcatcctcatcctcatcatcatcattgttacttctagaatcactgaacatctcccgaagcatatcatattctactagttttaagcaagaagaaggtgaactatctaaaactctgcaaatgactcatactccagatataattatactcctttcacattccccaggcaaccagtgaattttataaatcattttttcatgcaggaagattattccctttataaaacaaggacagcaaatgcaaaacactgtaacattcattcatgtagtgaatgatcaagatatttagagactctaagggtcataggaagttaaaataccaggggtggatgggagattagaacactaatctaaaacccctaaactgccaagagaccaataagagggaagaagggctgggtgtggtggctcatgcctgtaatcccagcactttgggaggccaacgcgggcagaacacttgaagccaggagttggagaccagcctggccaacatggcaaaaccccatctctacttacaaaaaaaaaaaaaagaaaagaaaaaagaaaaattagcttggtgtggtggtacatgcctgtaatcccagctacttgggaggctgaggcacaagaactacttgaacctgggaggcagaggttgcagtgagccgagatcgcaccactacactccagtttgggcgacagagcgagactctgtctcaaaaaaaaaaaaaaaaaaaaaaaaaggccaggcacagtggctcatgcctgtaattcaagcactttgggaggccgaggcaggcagatcacttgaggtctggaattcaagaccagcctggccaacatggtgaaaccccgacgctagtaaaaaattagctgggcatggtggtgaacacctgtaatcccagctacctgggaggccgaggcaggagaatcacttgaactcatgaggcagaggttgtagtgagccgagatcacgccactgcactccagcctgggcgacagagcaagactccatctcaaaaaaaaaaaaaaaaaaagagggaaggacgaaaccatcctttttttctgggtttttttttttttggattggcctatgaatttatggaaaatgatctgatacccagtcaatacctgccctatctgaaactcctgctttgcctttactaaagtacctgacgaggtatgaccctgcttgtggctgctcattcccgaggatatcaaaaatcctgggatggagccttgactttctatttccttggttccatcttcagcaatgacttcccaacctgaaaggagtgggtagtcaaggaaaacacagaaggaaacaaaaaggcacagctgaaagggaaggggctctttggctaacagtgctatttaatttagtccaactttaggccatttgtattggaattcctagtttggagaagtgcctcatattgaattacacaataaataattttctattacatgaatttactgttcctagctagaacatttcaaagaatcttaagttccacacatcaagactggcacacaaacaccagaggtgaggcttcgtcagcatgtacaaatggggcagaacagactatgcagaaaatatttgtataaaggatacgggtacttacggcttcagcatccgaacgcagcagtctctttacttcattttccacgtctggagattcaatgtactgaagcaaagttggggattagagggggataccaatactgtcatttaacaccctgtgtgttgcaggagtgccctcctacgtaccaacgaattcaaatgttaggcctctttaaattctgatccaaccaaatttctactttaagtagtgctatttataaaggaatctttagccagggtctagaattttgtacagtaaacttacttttttcctaattaaacaaattacttgagacatttaatcttttcaatctgcagctctatggtaaagccctctctcagaggtgcaacccttaggtctcagttataaattatttctcctgatttatattggcaaagaactataattccttattagttatttagaaataatttggtttaaagatccaaattcccagatttcacttccccacatctttattattagagacgttcctataaaaactggatcttagctgcatgttctcccttgaatccagttttacataattatctccacagcaaccaatttgttgtgccacaaatagaaattaggattttgatggggaataagcaattgcaaacaactgctgttaaaagtgagctctggctcccaaggaatggcttttgaaataaatatcagaataaaaagagcagattagaatacacggggtcactggccaaattgtatcttttcctctagcagttatcaaacatcaaacaatgaattcattttttagtgaatcaaacccagtgtatgtgtttaggatgagggttagaggtgagaaggaaggctcaaaagtagcttctgtggtttatttgattcatttgaaactaatgagctattaaataaaacacattaagggtaaaaatgaagttatattatgattgctctacctcagtaaagctgcttttttccatttctttgacatcagggacctatgaaataaaacacaataaacaagttatattatgatacctatatttcagtaaagcttaaagagctctacaactatccttaacttagttttacatttagtaggcactcaataaatgttgatttacagagtataaaagccaaggcaactgtgttcatggattggaagactcaatatagtaaaaatgtcagttctccccaaattgatctacaagtttaatgtaattcctgccaaaattctagcaaggttttctatagctatagacaagcttattctaaaatttatattaaaagatacaggcttttggccaggcgtggtggctcatgcctgtaatctcagcactttgggaggccaaggcgggcggatcacgtgaggtcaggagttcgagaccagcctggccaacatggtgaaacccgtctctactaaaaatacaaaaattagccgggcatggtggcccatgcctgtaatcctggctacttgggaggctgaggcatgagagtcgcttgaacccgggaggcagagactgcagtgagcagagatcgtgccattgcactccagcctgggcaacagagcgagactccatctcaaaaaataaataaataaataaataaataaagatatggactctagaatggctaaacaatattgacaaagaaaagtaaagtcagagcaatcagccttctaatttcaggaccaattatatagcgacactgtgatattggtggagggattgacagatggatcagtggaggagaatggagaacccagaaacagacccataaaaccaagcccaactgatatttcacaaaggtgcaaaagcaatacaacagaggaagaatagccttttcaacaaatagtgcgagagcaattagacatcctttggcaagaaaagcaaaaacaaacaaacaaacaaaaacaaaacaacaacaacaacaaaaaaaaaaccttgaactaaacctcatagcttttacaaaaattaagtcgaaaatgggcatcaggcttaaaaagatgtaaaaaaaaaaaaaaagcaggagaaaatcttcaggatctgggctaggcaaagagttcttagatttactataaaaagcaagatcgttttcaaaaaaatcaatatattgtacttcatcaaaactaaaaacttttgctctctgaaagaccctacgaagaggatggaaagacaagctacagactgggagaatatatttgcaaactacatatctgataaaacactggtagtatttaaaatataaaaagaactctcaaaattcaataataaaaaatcaatttagaaaataggcaaaaggcatgagcagacatttcgctgaagtggaatagatggcacatgagatgctcaaccccgttaaccatcagggaaatgtaaattaatactacaatgggatcactatgcacctatcagaatggctaaaatgaaaaatagtgacaacacctaatgctggtgaggaggtggagaaactggatcattcatacattattggcaggaatataaaatggtacagtcactctggaaaacaggtcatttcttacaaaactaaacatgtgactaccatatgacccagcaattatactcctggacatttattccaaagaaatgaatacttatattcacacaaaaacctgttcacagctttatttataatagtcaaaacctgtaaacaacccagatgtccttcaaagggagaacagttatgtaatgtggtacattcataccatggaatactactcagcaataaaaaataaactattgatgctacaaaaacttatatggatcttaagtgaattatgctgaatgaaaaaataagctagtctctgatgttatatactatataattccattaatattaaatttttgaaatgacaaaattacagagatagagatcagattagtgattaccaagtgtcagagactggggtgtgaggtggaagggaagtgggcatggttatataaaagcaaaatgagggatccttgtgatgaaactgttttgtattttgactgtgtagacagatacatgaacttacacatgggataaaactgcatagaactaaacacatgcacaaaaatacacgagtacaagtaaaactggagaaattggaataagattgcagaattctaatcatgtcaattacctgtttgtggtattgtactatagttttgcaaaatggggaaaatggcgaaagggtacacgatatctctcttttatttcttacaactgtatatgaatttacaattatttcaaaataacatgtttaattttaaacaaaagaagaagccaagccacaatactcctgtagtttgcccaagattctacaagcctgaaataacattaggaatataaccacaattcccaattttcaggttctggatgggttcactttaaaactagatcttgcaatagaaaactgaaagcattaacagaagtttcaaatgtatgattcttccagaccccaaatgactagcctataacctcaaggatcaggtctttttattcactgctatattccctactgctagcatacagtgcctggcatttagttcacattcaataaatgtttattgaacatataaatgaattaaaaattaattcccaactgactttttctcttttcttctggcccatgatcctcttctaatcggcccggcagacacacaaatagcatgtaactaacctttttttgtgttttccggaaccttttctttctgacattcttaagtggtggcgtaactaaaataaatacaacacagtgaaacgttatatgactgatggtagtcacatagctgaatttgataaagacaaagatcatgctataaaccaaagggtcatgacatcactccttttttttttttttttttgagatcgagtcccactctgttgcccaggctggagtgcagtggtgcgagctcagcttactgcaaccacctcctcctaggttcaagcgattctcctgcctcagcctcccgagtagctgggattacaggtgcccgccaccacacccaactaatttttgtatttttagtaaagacagagtttcaccatgttggccaagctggtctcgaactcctgacctcaggtgatccacccgcctcggcctcccaaagtgctgggattacaagcgtgagccaccgcgcccagctgacgtgactcctcttaaagagtatctgagaacctaatgaaccaaacacctaagtgtggtaagacgtccctgtttcacaaggaattaggattcagcaaataaattttagtcagcaggaatgagcaaggggctggtgacttactgccatgcttccagacacatttttcttctctccccctttcttttttcctgactatattaggatcagtagaggcagctggttcttctggagaaaggtggatatcaccatcagcagtgcacacaagcatctacatttaacaaagacaaagaagttgactatgaccacgaattttgggttagcaatcataatcattcttaccactagaaatgcacagaagagactgatacttgccatttccagaaaaccaagtattttgtaatgtacatttatattctctcatttttgcagtctctctctctccctctcctccccaccaccagccaccagcagcactacatatgaactctgaaggtgctttgttttgtttttttttttccacgagagtgtttaccactacagagggaatatattggaaacagatcttggaacttagcttaggttttttgttttgtttttagacaaagtcttgctctgtcatacaggctggagtgcagtggtacgtgatcatggctcactgcaccctcgacctcctgggctcaagtgatcctcccacctcaatctctagaatagctgggactacaggtgtgtgccaccacacctggctaatcttgtttttgtagagatgaggtctcactatgttgcccaggttggtctcaaactcctgggctcaggtgatcctcccacctcagcctcccaaagtgtagggattataggcatgagccattgtgtctggcctatctcagcattttgatttagagaggaaataagaaatcaacagcagagatgatgaataagaaccaatttaaacctccagagttaacaacatactgttttaatacaaagttcagaagatcccagcagctcatatgtttcaattaatgaaaagtcactataagtggcaaatgggactctctataggctatttggtcaaaatacaatactgaaagctaaggatcaaacaccaaacgagaacatgacatttcattcctgtgcagtcaatctggaaattagaaatgccaagcagccattcaccaagtggaaaggagtactgaaagaaagaaaaataggaagagaaaagaattccttgaaggatgtgaggctagtaaagaaaactagtccatacctgagaaatgtctgctgttttataaaaggtttttttatcaagcgttctcaggctttcaataacacaaggcaagtcaaccagcttagcagctagtgggacatcttctacttcaacaactgcatggcgcccatcagctgaagagaagtaaagattaaagttgatatcttcccagtgaactcttaaacttcctaaggtttgaataatgaagacttatgtgggacagattagtctttccaagaaacctactatctctcataatgctagaattgtgtacacaattaatagcttcctaaagaaaagaaatggaaagtatatggagctcttttttcctagtttacgtcacttgtgcaaaagtagctaagtttcttgttaatggatgtgaactaaatataggtgaagtaataaatgtttcattctcatcctgaaaagcaaattccattcattaaaaccaattcctttttttttttttttagaagcattcaatcgtgtcattgtacatgtgtgttttcaaagggctgggtgagggaagggttgactgaccctagaatggtgctaataaatctcaagttaaatctctaattagcttcataaagataaaattctatacaacagccatatactaaactctgaatattgctgctcagatgtcccaaacataaatgtcttttgacacaagaggattcaggtataatcttctagtattatgtgaaaaaagaaagatacaaaacaatgtttatcattttgtgtgaattaactctaaaaatagagagattgcttcaattctagtattatgcataagagttttgtcaataaggaagtaacaagaaacagtatcagttatctgtggtattgaggttggggcaccataaggaagaagagttttatttctcctttcgaacttttctttttcatttgatttttttatttttctttgagaaggagtctcactctgtcacccaggctggagtgcagtggcataatctctgctcactgcaatctccgccccctgggttcaagcaattatcatgcctcagcctcccaaatagctaggattacaggtgtgcaccaccatgcccggctaatttttgcatttttagtagagacggggtttcgccatgttggccaggctggtctggaactcctgacctcaagtgatccgcccgcctcagcctcccaaagagctgggattacaggcatgagccatcacacccagcctgttttatttgaattttctaactatgaacttatattatcttttttaaaaaatgtcagtaagtgttaactaactggtgagattatgagccactttttgttttctcctttatatgcttctctgtattaaaaaaaaaaactagcaaaatttatttatttttggttgtgtgttttttaggcagataaacttgtgtggaaacatttatttatttatttacttatttacttatttatttacacatgctcttggtgcaaatggcctctagattcatccatggtgtcccaaatgacagaattttgttctttttaaaaggctgagtagtatagcattgtgtatacgtatcacatttacacttaggttgattccatatcttggctattgtgaataatgctacaatgaatatgggagtgcagagagatatgccttcaacatgttgatatcaattccttctgtgaatatattcacagaagtggggttgctggatcacatggttgttctatttttagttttctgaggaacctccataccatttaaaaaaaataatggctgtaggccaggcacagtagctcacgcctgtaatcccagcactttgggaggctgaggtgggtggatcactcgaggtcaggagttcaagaccagcctggtcaacatggtgaaaccccatctctaccaaaaatacaaaaaaattagccaggtgtggtggcgcatgcctgtagtcccagctactcggaaggctgaggcaggagaattgcttgaacccaggaggtggaggttccagtgagccaagatcgcgccactgcactccagcctgggtgacacagcaagactccatctcaaaaaaaaaaaaaaaaaaaaaaggctgtattaatttacattaccaccaatagggtacaaagtttcccttttctcctcatcctcattaacagttgttattgttctttttttttttttaataaaagccattctaacaggtatgaggtgatatctcgctgttgttttaatttgcattcccctaatgattagtgatgctgagcattttttcatgaaccttttggctacttgtatgtcttcttttgagaaatatctgttcagatcctttgcccattttaaaatcaggttatttgttttcttgctattgagttgtttgagttccttatatatttggatattaaccactttattggatgtacaatttgccaatataacaaatattatttaaaagaaaaatatatgtcactggccaggcacggtggctcacgcctgtaatcccagcactttgggaggccaaggcaggcggatcacaaggtcaggagtttgagactagcctgaccaacatggtgaaaccacgtctctactaaaaatacaaaacttagccgggcatggtggcatgtgcctgtaatcccagctacttgggaggctgaggcagaagaatcacttgaacccaggaggtagaggttgcagtgaaccaagattgcgccactgcactccagcctgggcgacagagcgagactccatctcaaaaaaaaaaaaaaagaaagaaagaaagaaagaaagaaagaaatacatgtcacctttataaacaaagaatggcatatccatttgtcattcccttggatgttcagaaatcataaagtttatatatgggaggctaccagcagtataaaaaccccacagttgacccccaagtttccttaaacacactatgataatcactcaactcaaggtgcaatattcctacttcctttcctcttaaaagaagaggacttaagcctctctaaagcatgagtccatcaagtcagagaccatattctatcatttttcacatccttagtaccaagtacagtgtatggcacatagcaatcccttaataaattattgttcaatgtatagtgaatggatattaactacttacgcaataagtcaatttttagtttatccttcatcttgacactttgagaacgtgctaggttcctgacagtacaagcatgttcctaaaaaggaggtaaattgaaaaatcagaagaactaaacatctacttggcagctaacagaatagatatatcaaagaaagccctcccttaaataaaactttacacctcccaaatgttactaacaagaccatgtaccatgagatactgtgcactgtataagtcaagttaggatgaagctgactctaaactcataattgtctcttagtagctacagttaatgctttctcctagctctacaatcctgcctctcactgctacccttctgttgtagttgctaaagaaaggcttacctagttgcagtttgcttggtatattaagtaaccctaattagggaaataggtttctgaaccccatccttaatatagctgcctagactaagtaattgcttgaatacaggtatcagtgtgggggaagagagccaaatacttgttgagatgagctttaaaagtcttgcatggtggtgaataatgctggcccttctcactgccccttttgaggtgacagaaaggatttcagaggagccgtatcttggctgtccagggaacaggctgttagtattggtggtaagtgaatgggtccatcattgtcacagctgttttgccaggaaatcaacctgcatgataggtggtattgtacaggaggaaaaaatgctgccaaaaaagtacacgctatgataggactgcttaacagaacatgattcctgggaaacaaatgttctgagtttttatagcctacctgaaatagaaatgtcagaatccaagtagaactataattataattaaactataattatgaagatatttgttctgagatacaagttcttaccagaggcagacgcaatataaactggttctcaacttcatcaggaacttcatcctggctttcactcatgtcttgattttgagttcatgaaagcaaaaagaaaaccatcactaaaaactcctcttgctccctctcctgaccacttctggtagtactggctaaattatacaagatcttgcccataatcctcactagaatgatgtgtgtacagttagacaataccttatttgacataacttaattatttctagacgttaccttagctcctctccaatatgtgtagattttccaaagtcaatccaaattacatgatgtaatttgatgaacaaatgaaataagagctgttatgaaacatgatttcgtcttcttaatcatattcttagactctcaggtaaaagactacaattcaacaacacgttggtggctacctaagcaaactaacctctgtagggaagaatgcaaaccaaaagctgaaattcgcctagaaaccacttgcataaatgttctgtgatgatttgaagtaaacaagggcttgattttcaatatttcacctacattaatggattagtagaaattaagcagtccatgggagaccaggcagttttttatgactctagagccagcaacaacagctttgagctaccctggggaaaagttaggagtccagttcttttttttttttttcaagacagagtctcgctctgtcgcccaggctggagtgcagtggtgcgatctcggctcactgcaacctccgcctcccaggttcaagccattctcctgcctcagtctcccaagtagttgggactacaggcatgcaccaccacacctggctaatttttgtattttttagtagagacaggatttcaccatgtcggctaggctggtcttaagctcctgaccccaagtgatccgcccacctcagcctcccaaagtgctgggattacaggcctgagccaccgcgcccagcatggaatccagttctttttttttttttgagacggagtctcttttttttttctttttgagatggagttttatggagaacataaaatctgatttgatttattcgttactaccctttcattcattactaccctttattgtgtgcattctgtatgcccagtactacattgagtgcattaggtctatcatttcatataatcctcacaatcaccacttacttcgaatgcccccaaaagctatttaaaagaactcctaagatggatctttttatttaaaatatatatatatacctttggtgaagtgaatactttcttccaagttaatctttttttgacaaattataatcatatataattatggggtacacaatgatgttatgatatagtgtgaaatgactgaatcaatctaatgagcacatccatcaccttaaatacttatcagttattccccctaactgcaactttcattttttttaattttaaaagccaaatttggaagtgggagattgtataccaactttagtggcattaatgttaataagttgtgataatatcccactactattggaccagcctaactgaaattttctgttctttgatcaacatctcctcaatgcccctcccgctactccagcctgtaataaccaacactactctctgcttctatgagttcaattattttagattccacatataagtgagaatatgtgatttttgtctttttctgcctggcttatttcacttaatataatatcctccagattcatccacgttgttgcaaatgacagaatttccttctttttaaaggctgaatagtattcagctgggtacacataccacatatttatccattcacttgttggatacctagattgatttcataacttagctattgtaatgctgcagtgaacatgtgtgtgcggatatttctttgacacactgatctcaagtttttaggatatacatctagacgtgggattgctggatcccaagtttttattttattattttttattgttttcattatttgtttttcaattttatgttcttacaatgaaccaagactttatttctaatcttattttccatgtatttgggatgtatttgtagagccctgcattttgggtattagggcccacacttttgttttgttttgttttgagacagagttttgctcttgttgaccccaggctggagtgcaatggcacgcatctcagctcactgcaacctctgctgcccgggttcaagtgattctcccatctcagcctcctgagtagctggcattacaggtacctgccaccacacccggctaaattttttttttgtatatttagtagagacagggtttcaccatgttggccaggctggtctcgagctcctgacctcaggtgatccacccgccttggcctcccaaagtgttgggattgtgggcatgagccactgtgcccagccaggcccacacttctgaggaagatttttctcaaaggtggaaagacagctgggcgctgtggctcacacctgtaatctcagcactttgggaggctgaggcaggtggatcacctgaggtcaggagttccagaccagcctggccaacatagtgaaaccccatctctactaaagatacaaaaattagctgtatctttacagctagttgggaggctgaggcaggagaattgcttgaacccaggagatggaggctgcaatgagccgagatggcgccactgcactccagcttgggtgacagagtgagactccttctcaaaaacaaaacaaaacaaaacaaaacaaaaaaagtcagcagtagaaaagcagacacccaggatgggagagggaaagatgcattatttgtgattgtaatttcttctcttcttgtttcatacagatatatatgtatatatatgcatatataaatacaaaagagaaatgtaaatgcaagaagagagttgatcgaaataaataaaaaatctgggggctgagcacattccctaacagaacatagtaacaattaaggctgggagcaggaacagattatttgaagaactagctgctaagcaagattttatcagatcagtagtaacttttagatttctcagcagaactaaaactggggcattttgttcatttccaagcctttttggtaattcctcttttatggaagaaagaatgtaagaactgaaactatttcaatgtatttgtttgataaacagacctaataaaaagtctggtgggagaaaagttagacaatcctggttgaactgggttttaattattttttaaatttacttgcatttacctaaaagactagttgtacggtattcactttaagaaaaagcatccacttttttccagcaagcactctttgatgcctgattaaattaacaggaccccttactaccattcacctctagttccatctcgctttagcagaattacaattggaattataattggctggagggcgcctggcagcatgctccaggccatgcaagtcagtacacgcctaaatgggtgttttttcaagttcgcagtctccggctgcagtttaagagactgacctccatccttatccccggggcactaagctttcaaagagaaagtttgacccctaggctttgatccactttcccttgaaaacttctcgcgaggcccaacaggtcgcaacgggtcccagccttcgcgcctcgctgtgcaggctggctggggagggctgcggggtgcaccgcggcggggtgcacactggcggggcgctgacccggtcccggccgcccggtcggccgcccgactcacccgctcctccgggaactggcgccgacaccgaaaaggctgggacctgcgtctctggtctgtgggttccggacgaaccgcgcgtgggctcccgcgcggaacgtagaggcgaacgctgggctgccggcgcctggacagtaaaagcggcgcgcgccggcccctccccgcctcgccacgcctccgcggccgcgctgcccagcggactggagcacgacttcgaggcagtggcccgctcaccgcgtgctgggcgggaaggctcgaaaggcgcggagcgccgaggggagcgccgaggggagggctgagggggacgcgactgctcagggacctcgcgaagcaagaccgaggcttcaaaacaagttaccttggccaggcgcggtggctcacgactgtaatcccagtactttgggaggccaaggcgggcagatctcaaggtcaaaagatcgagaccatcctggccaacatgatgaaacccccgtctctactaaaaatacaaaaattagctgggcgtggttgcgcgcgcctgtagtcccagctgctcagtaggctgaggcaggagaatcgcttgaacccgggaggtggagattgcagtgagccgagattgcgccactgcactccagcctggcgacagagtgagactctgtccgaaaaaaaaaaaattacctttacacaggggcaaccttcagggcgccagaagatttttaccaggggacagtgatactcctaagaggcgagttgggccgggcgcggtggctcacgcctgtaatcccagcactttgggaggccgagtcgggtggatcacctgaggtcaggagttcgagatcagcctggccaacatgttgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaataaataaaaaaaataaataaaaataataataataataattagccaggcatgatggcaggcgcctgtaatctcagctacttgggcagctgaggcaggagaatctcttgaacccaggaggtggaggttatagtgagccgagatcgtgccactgcactccagcctgggcaacaagagcgaaactccgtcaaaaaaaaaaaaaaaaaaaaaaagcgagttgctcgcttttggttgctcctcgactccattaggtcggacggtttgtccctaggcacggtgacctcgcctagtgacaaacacgccaccgtgcaaacccactgaacaactagaatctgtgcccaaagccctctaacacgatcggttgctcccctctcctcaacagagtcaacattttacatcctctggagagggacacaggttacgtcgcccattgctcctcaagggggccgcaattcaaacaaattttgaatcgaactaaaagcagtttgtttctccgaaagaaggtcctcggctgggggaacaagcttaaaaaaccacctacctttcccttcctggaagttttctggggcctgggcagcagcctgggcgctgctgtccgcatccgtttgagtgtcctcgtcggcaggaatctgggtgccttcgtcgccagcaatgtcggcgctgctttcataggtggtttcagacccacggtcgacaagaatttggggttcttgttggctagttacttccgatgttgaaactgttggtgttgaatcattttctgaagaaatggggagctgtccctcggggcactccatggcccacctcgttggggttgtaaaat

SEQ ID NO: 1454 - DNA, 35280 bp, Homo sapiens
taaaatgaggaaccggtttattgaacagcttaaggagagcaaaaatagtggctttagctacattttttacacactgagcaggaaagtctaaaccatcccgttcccctgtaccccaaagagaacagggcttgctggaggccagtgccaagggcggagtcgtgctcgcagcagacttgaattaaccccatgtaggccggcgagcagttgcccgcgtgaaaacaccaccctcttctcctggctgagaagatcaaagctctttttttaccctcttttcagcaaaggacctatttgttttcaggcaggaggatgttaaacttgcagcctctgacacacggtggaacctgcagtgcttggagaaacggcacgcacacgtgaaaacatcatgcctactccaaagccttcttgttgctggcaggagggaagcttgagactttcccacgcatagtcgtgacccgcgtggccgtttctgctctcagcaacattctctagtgttccggcttcaagcagcgcttgtcaggtttgaagctagccactattctgagaacgtcagaaaagcatggaccatctcttgcttggtgttgccgttgtggcagtagcagctactacgtacctgcacgagttccagggcagaagtggcaatgtcccatgaaggcgtggcaccccacggggggggggggggagtgtgccacgggcgtccacttctgcagcagaaggcatgtgcctacagcacaagcttgtaaaaaaatacttgaacagaatatgctgtacagaactaggggttaacaccgcatatgaagatgctaaaacatttgtataaatactctgtatacaagcatggagtcactcccgtagaaagggctcatccgtgaggctatgaaaaactgctgtcagcatgcccaaagagaaactacttccacagtaggaacagaaaaaaggactgtgctgtgtctaaacacgtggtgcatcagagacatagttacagttcctactgactgccccagccacgacctgggagtgctgaggacctgggagtgctcagcgagctgcaggaggtcagccctgtggagaaatacatttctaaacaatacttttgattgggatttcagcaccgtatagacagatgttccttctgggggcctggcaagcagccatctcccagtgggtctgacggggaagaggggtacctggagcccctcccagacagacggtaatcccacccctgttctcacactcttcctggcatccgcatctgctggcacacacccccgtcacctgccacttccgcgtcccgtcgtggtgagtggctgataggcgctggatgcaaacaaggcatgagatggacgtacctggagacccagctccagtactggttctggtctgcggggtgaacgagggggcagaggaaggcggagagagtgcgtcccagtccacttaagctctgtccccggaagtggcatctaatctggcatttcgatatttaatttgggaggtgggagcacatacttcccagggctctgggtaatgaccaccctggccttctttcgaaacatgggtgcgattttagggggctccggaactggggtctcttcggtttcttcattatcttcgtgatggagatcataggaaatgtttccatattctcgtagaaatgggaagatttcaagcagaaactgacagaaatctttgcggataccaaaccaccctgaaaaataagaattttttatttcacacacgaggctcaactgaccttcctgttaactttctttccgtaacaagaagtttcactcctacaatgtcataacatactttatccagactcctgagtcacaaagcctgaacagggcttgagtacccaaaatggggaagaagtgcaaatgctagctctgtggtgcttggagtggggttcccggaccggcagggacagcgtccacggggcctagttagggatgccattctcgggccccagcccagacctccagaaactgagtcgggctagggtgggctccagcggtccccttttcctggcccttttgggattctgctggatgcccaaatttgagaactactgctccagtgagtctcaaaatatctgtggtgcgcagactacggtgtcttccgctaatcttctccagccaggataaactcatggatgacagtgccacccaagaacaagatttctgtcaccctctggaatccgtgagggcggtagtcatgcacgggttggccaggagggggcctgaactcatggagccaccttaaagccactttcccagtcccactactcctctctgtaggctactggagtgtcagctcggtgcaagccctccctgctcccgggtgcggggtagggggcagaggcacaaacagcaagcacagcccgggctgctgggctgcagtgaggccctgcccccaaacccactggctttccgaagggcaatgctctgggcttccgtgccatggagcccacagccttgccaggaaggcaccctctgcagagatcgttttggaagtgtctgcctcagcaagcaggtggaggggaatagagtgttagcaaggcaagacaggcaagactcgggtgatggcagcaaggatatgggggaggcagagcggccaacagggacctaggatgaatcccaggtttgggtgggagatgtggattttccatcaaaccctcccgggcctgggaagaatctgtcttgatccccattttgcagaggagggaacgggatctctgagaggttgcctgccgtgtctggttctacctcaaatggcagcgtgcactgcgagaaaagtcccggtgcaggccagcagaacaccagagttacggcatgcccttcccttagaaggtcccagaatttcctcagccctcactttcccacacaagcttctaaattggggccctcggggactcatcccttcctagacttctatccgccaccccccaccccctggtccccccccagacacacaccaaggacttctgaaatgctgagtacatacagtggtttcctcccttctgtccaaatgtggttgccatcagcgtgatcaacgagagccaaagggggacaaagatcgggatgcaggagaaggcgttgtggccatccagtttgtgaaccagcagaatctaaagaaagagacatagtcccggttgatgccagcaccgaaaatgggcagaggcggaagccagacttcattaggcagttcctccccaccaccccacccccgcgtgagctcccacaagagggaacatcagcaccgccagaaaaaggcaggaaaccacctatccctggggaaagctcgaaatgagcttttatgtccctcttcagagctcggcaatagcctatccacttgaaaagttcccagtgccagcagttttatggcaaactcctccgggtgtttgttctaaggagtcaacagctcccattctagaattctccacgtgactccaatacacaaatctgacatcccactctgctttccccagagtggaaactggagccatacagaggcaccatggctaaaaaggtgcactcttctccctgccagccccacgtgctgcccccaagagaaaggaaggatgctctcctttcaccgaagctccctctcggagatggctgtgttctctcccctctcctggagtgggctcactgtgagctcgagggacagaggctgcctttctaggggtgcagaatcctgtcaggggaagcgcaagcttcaggggctgaagaggcttcccgtggaacgcttacctcaaatgtaagaaggggcacgacgatggtcatccagctcagggccatggttatgtgtgtcctgcgctgctccgcaatcacatccatagagcgcaagaacaagacggaccacacaatgtagtagaggaccaccaggcacagaaaggacatgagaatccacagcgggacacacacaacctgggggtgggtgagagaacagcaagagaagtctctttagagcttccaacctggcctctgatggaaggcatctttagcaccttgctgtgtctgtccagttaaggcggtccttcctgtgagccgaataaggaccgttccatctcccaggactgctgggagcatcgctcaggacagaaaaggtatggtatgttcactatggggcctgctgccaccaggggacacacacgctcagtgagtcatcagtccctcttcctttgggtgacagacagccctgcacctggctccgcagcctctactcttccagaggcccactctcccacactctctcaggctcctctaggttctgctgccatcacagcttcccgggaaatgggacacaactgtcaccctgtgcacacacacaagatctcaccccaacagactctcttcacaggcaacattcccacaacctgctgggggtactttggcaacacaaatgggaatgggctccccagaaagtctggctgcctgggctcctaaggatccctaacctcacccctaccaagttagtgaacttggcgggttgatgctggatacaggttgatgctggatacgtagcgctgccgggtccccgcctccacggcaagggcgcattcccagtatgtccctgtcgtaccaggtagaccttgtctcatccacacacaagcccagaggacgagttccgggggcgccacttggccaggctcccctgtgacacgtcttcgccctcctgccctgcctcctgggacgacactcctccgttctccctttttattaattatctatcatacagtaggaaaagtgaccgtcttcctttggtgtgagttccctgagtcttcacacaagtagattcacacagccgttggcaggatgcagaagaggtctgtcaccctgcaaaactctccgtgctgtcccttcactatcacaccgtccccaccattagccccggcaaacactgatctgttctctcactgtacttttgtctctgctggaactttatgtagatggcatcgcgagacaagtaacctgttgagactggcttcccgccatccacataatgtctctaatgagattcatccaagttgttccctccctgtatccacaggtcgttccctctcagatctgagtggtattccattgtatggatgcctacagtttatctgactgtccgctgagggtggtttgtgaaaaccaaacaaggccgctatccaaaatgcaaacaagactgctacaaacactggtgtgtgggtttctacaaggctgcgcgctttcacttctctgggggtaaatcttatacccaggagtggggcagccaagtcccacgggaagtgcgcttttaactgcatcagagatggccaaaccattttctacagtgcccgtaccacctgccttcccgccagtaacactggagtgtcccagttcctctgcatcctcccaggcacgtggcctcgtcagtgttgctgagtttcaccattctgaagccatgtgtttcgggccctcatcctggttgtagtttgtcttccctaacctgtaatggcgttgagcatcttttcctgtgctttttcgccatgtgtatatccccttcgcaaattgtcaactcttttgccaatttttaggtgtttctttttgcagttttgagtttttaagagttctctgtatgttctgggtgcaagtcagtgttttgatgtgtgctttgcaaatattttctcccagtctgtggcctgtcttcatttcattttaattttgaggaagtccaaatttatgatttctctctcgtatggaccatattaacagtgccatttctaagtactctctgcctaattgcaaaccccaaagattctgtcctatgttatttcctaacagatctatagttttacattttcttttagatctatgatttgagttggcatacgaattttacttctcctgaccagttcttgattgtaggtttctctgcagagtctatgcacagcctttcttccccgttccccattctgtgatgagattctcctttttactgaagttcccttcatgggtggaatgttagatctcaataggcttccttgttttctcttgctcactatgggaaacatgtactcagactgcttcatcaactgggatctacagaggatgaagggcagaaaaaatctttcttctcatttgtggaaagctctcaaaattactaatcttttttttccctgacagtatcttatacgaaaaaatttggtcttgtttagatatgtttccttcacgtcacaacagaaacagttttgaacccaatgaccattctccagatacagcactgtgaagttgtaggatgagtgactgaatattttttattatgaatgttttatcaaagactttgggcagaagtgattattcccatctttaaatatggagtatacttaggttcccttcatttcttctctgctcccaattctttactatacttttcactttttaagggtagctatatttaatacataaaatatattgtatgcaaaattatacatcaaacaacagagaaaataaaaccgaacaaaaacactagcatgaccttacctcccagtggcaatggaactcttctgcctttagtctccatcttttttccatgcatttaatagtggaatctatactgtgttctctaatttctaccttgccacttatctttctatctctgcatccatctacccatttattcacagttaatttcaaccaaatgcccagtaactgaagtcacagtttagaagcatgacatagatgccaccaccagcaagagtgtaaatgggtatggctttttttttttttcttttgagacagggtcttgctacattgcacaggttggtctcgaactcctgagctcaagtgatcagctcacctcggcctcccaaagtgctgggactgtaagtgtaagccactgcgcctggccaggtatggcttttggaaaagcaagttggcagtgcagtatacgtatataggaatctcaaatagttcccaacctctagctcagtaacactatttctggactatttcctaagaaaacaaccaaaaaacaaaaggcaaaaattttaatgcataaacatatatactgcagtatgatttaaaatcattcaacactggcaacaatggaaataccatattttagaaataagaggatggtctgatacatgcacttgaagaatattttgtatcaattaaactttagaagtcatgtttataaagaccttttattaacatgataaaatgtttatgatacaacattaaaacaaaaaaatcaggatacaaaatggtgcacacagttatatccaaactgtttgtataaaacacagacataaaaacactaaccatgttatctccccatggtgggattatgggtgactattaggctattacttctgcttgtccgtcttttccaagctttgtacagtgaatatgaattacttttataataaaaaagaagtttatttaaggattttaaaagttacatacaagccagggccagtggatgatcttgtccagtcttaaggcaatgaatataaactggagaatgttgacagaacacaggatttctaactaaaaatgaagagaagaatcagttaaacaaagtataatttgcatttaatactgcagtaatttggttaacacactaaaagacaatacacattataatacagtgtaacttgtataatattatattgcactggaaactcctgattttcggtaccagaggggcacagcagtattatggcaaggggaaatggggctcagcctgctgccttgcccctctgctgccttgccctttctggcctgaggcctgagcacagatgagaaccttgtttccaggttcactgggaacacaggctagctgcaatagaccactaaacttccttcatgtccctaccaacaatactgtctactcgaaaccatccttgtgcatccttcttctcatacctcggttttgcccttggaccccaccccttcctttcaggctccttgaggaccttgtcacatcaagccatcaactgtagattccgtactgtatctttaaccccacctattccattgatccctcctagcagcacagaaatgactccttctcattaaaaacaaaagccccgaaaccagataaacccaccccatcctttgatccaagacccctcttagcctcaggtttctctctgcgagacagtaatgaatatgcaagcccctactatctcatctaccattcccagcttccttgtgatctggcctccacccccatgaccaccagaagacagctttcatcaaagtcaccgataaccgggaggcagcaaaaacacttcaactggcatcctactgatactgtggatgactctttcctttttgctcccctcctcctggccatctagatcccaccatacagtcttggagccctctggagtgttctggtaattccttctgtctccttttccccctccttaaatggtgatgctccgcagagccacaaactcagtcttctctcccgactaggaagacagacacacaaacacacatattttcactcacccgctgcaccctggactgggggagaagaaatttcaaccagacccttggtctgcattattacctccttcatggttagttctcacatctgtctccaacttagccttcctgctgcatagcagacccagctgtgcataggccactcggctctcctaaaggcacctcaaatgaagccagtcccaaatagagatcattatcgcctgcacttagaaccttgtatctcctctttctatagcctcccatgtcactttctatggcctcccatgtcactatggcctcccatgtcactttctatggcctcccatgtcactttctatggcctcccatgtcactttctatggcctcccatgtcactttctatagcctcccatgtcactttctatagcctcccatgtcactttctatggcctcccatgtcactatggcctcccatgtcactttctatggcctcccttgtcactttctatggcctcccatgtcactttctatggcctcccatgtcactttctatggcctcccatgtcactttctatagcctcccatgtcactttctatagcctcccatgtcacttggaggcacaacagtggtctcatttctcaagccatgagcccgggaatcaccctgcattctttttcccacactgtcacgttcagtcaccacatcctgtccactgtaaagtccagatttctcctgaatcccgtgcccacttcctatcctgatgatgactgcctagtgaggccttcttcggcaccatccgcctaccacttcagcaaccccttactaacctcccgcctccagcccaaacgccctgcaggctgctcctcactctggtaaagtacattcttgcccacaaaattgaaatctgggaccaggcccagagcttcccaaaagttctcagtacataggtacatggggaatttagtaattcctccatagacctctaggccaaaagaaatccctaatgtggctgggaatgccaacagttgcactgatttaagtaattacatctaacttagtaagtatttctaagtagccactagaaaaaataattcatataaatctaaagaaaaatgttaatattattcttaaataaccaaaactaattcccagtgggatgcgtgtgcctgtcaggtagctcaccatttcccacgccttggaatcagacaaggtgctcccactcgttacctgttcttcacccggattttcacacagcattagccttttttgttttcacagcaactgctgaaaacccagcttcttaaagatacgacgtcactgaaaggaatgcagtgtggcctaaaaataaacctgtaaactatttcaagctagtagtttgtatggtgtcccaacaaatgtcaggtattactgttttcctcaaaatgtccactatcccctggtgccctgtgagtgcactggggtgcctggggcacttcagcacatgctctgtgggctgaggacgtggcccctatttgccccaatccctctgtagaggctccctctcttctcaactcccacagttccttcctttccaccttgtgctcccgtcggatctgaatcgccacagtccactcagctgatggagtgtttcctgcctctaggcttcaatgtgtcccaaaaatgccatcccttccctcccaacacagggcttcctggcagaccctcaactcctccttcccatctctgtatgagcctactccagaccaccccctcaccaacataggtactgttcttgcatcacaggaggagggagctcagctcctggtatgttgtttcttccaagggcaggaatgcctagagtgtgaatatatgaaagacttactttctgtaattcaggcccaatgcagtcctagtccttgtatagttgtccctcagtatctgtgggggattggttccaggaccccctgtggataccaaaatccatggatgctcaagtccctgatataaactgggaattgtagggagggtgaaagtggaccatcagatactctccctccacggctcactcctacctaccactatacccatgctgtggcctttccaccagcatgaaaatcagggaatagctccccttgttcaaggccaaacccttcctggtgctctaggtcccattctccctgagtcccacagggccttgctccatcaccgtccctctgtctacataccttcccctcacgcccatacctggggtctaggcttatatgcctgacccaccctacagctgctatgtttacttcctaagccaactgcagtcttctcccttcactcttcatccacacggctcaaaaccaggcatctacagcctctagttctcccctcaacccatcagtattcagctttgggccctcagcttctatgcagttatgtagttatgtgcccgggctttagagtcgggctgactcaaacggaatcctggtcctgccccttcacatgtggccatgaacaaatgacttatcttctctggacctacctcacagagttagttagtaagaaaactaccacatgtaatgtgcctcgcacaatgcctggcacacagtaagtgctcaataaacgttatctgcaattactttcattactattattactagtcctggtattttattcatctgcatatcctctatgcttagggaaaaagggcttggcatctagtaaatacttgataaatgtttattgaatgaataaacaaacacaggggcacatcaggataagctaaccagacagcaggggaggtgctaaatcatggggtctgaggtggggagatggtcagttttgagtgtcaacttggctgggctatagtacccagttatttaatcaaacactaagcttgctgttgcagtgaaggtactgactttgaataaaggagactaccctccatagcatgggtgggcctcatgcaatcaggtgaaggccttaaaagcaaaaactgtggtttcctggagaggaaaaaattctgtgccaggactgcagtgtcaactcctcctaggtctccagcctgttcacctgccctggagatttcagacttgccagccccacagtaatgtgagccagttccttaactctctttatacatatatctgtatctaacctatcagttctgtttctgtctgattgatacaggatgtgaagctgggagaaggctgatgtcctgggtgaaaagctagtgttctaagtgaagaaagaaaaattgttatttccatcatcttttgttgccttgttgtctcatgatgtagagttggtaatgatcaagctcttcctaacaaagggtaagaaattgacatctgaataactgagcaaaatattttacttttgaaaacattctttttttttttttttaagacggagtttcattctgtcacccaggctggagtgcaatggttcaatcttggctcactgcaacctccgcctcctgggttcaagagattctcccgcctcagcctccggagaagctgggattactggcgcatgccaccacacccggctaatttttgtattattagtagagatggggtttcaccatgttggccaggctggtctcaaactcctgacctcaagtgatccacctgccttgacctcccaaagtggaaaacattcttaaatatatgaaatctcacctctagtgacctgtcatgtcgaaagccccaaacgcaagctgcaacagacaccggggaaacaaagaacagcggcatgaagaccaggagccagaaatggcttcctctctcgattctgtcacagaccagaacttcaaacatcaacaagagcaagtggatgcccactgcaatcaacatggctttaaactccacacacgtttctccttctgctctaaaaaagggagagaagaagaaaacaccctcagttcagaatctccactataagcaagcagttcagggcaaataccaacttatatttatactttgaattttacttgaaaatttgacaaaagcaaagggaaatcaggtagaaagctaacttaaacctaagctttggtaggcaatctctgaaacatcgaagaactactacataatacaaaatgaacattacaaccaaaccagaatttaatgttttaaccgtataaggatattctcaaaagtaatagccagttcttatttccctgacaatgtacataaacacttctgttcacatctttaaattcaacaacaagagttacttccaagattattcaagctgatttgcttctgctgctaaaaccaggcaaataccccttaagtctcatgatcctcatttttcaagaaaccatgtaaaccacccttcacacaatattataaaaataactctagttctatgaacaagtgccagttatatttcaagatagtagtaactattgttaggtgctatttttaaatgcaaataaaacgtataaatgattttcattttcctttctattccattaagataaattaacacctgcacatgaaagagaaagaagaacaagagttaaaactgttctcaaacaaaatcagtttaattagctaagtatcatgcacaataaccttaacagatctacaattgagcaatggtaaggccgctaatcaggaaaaggctctataatgcatctgaaaggcctacaatgtttattcaaaatacagatgaacatttatgatatacatgtattgtgggtgacaaatacaccggaagttagatcatagagaaaatgctatcagaggttattcctgtaggacccaaccatgttccactggttaatgttaacatgagaatgaccacgcctgtacattccttacattcaaccccacatacacaattcctttccttgctcaaaacatcttaaataagaccaacaaagagaagtttgaatatattctaaatatcaattagtagaacctaaatgtttatttaactttgcattctttgagaagcaattaatattagatatctgaaaatatctcataaaaaaataaaacacatacagccacacaggtcatcaatctttcaaaaaaaatctaagaactctgaaacagctatacatgaatgtccctcacctgccaaggctctctgtgtaactgttttacagttcttagacatgtatgtgatatgtaatttacacaatctgaatcattttcatatttagtaaacaaaaatttaaaaagttgatgtagtggccggacgtggtggctcacacctgtaatcccagcacttcaggaggccaaggcgggtggatcacctgatgtcaggagttcaaaactagcctggcatggtgaaaccctatctctactaaaaatacaaaaaattagctgggcatggtggcaggtgcctgtaatcccagctactcaggaggccgaggcaggagaatcacttgaacccgggatgtggaggctgcagtgggccgagatcacaccattgcactccagcctgggcaacaagagcgaaactctgtctcaaaaaaaaaaaaaaaaaaaaaaaaaaaaaaaggtgcggtagtttcaactttacacttttcccacatgagcagctgccttctgggaattcctgtactcctcattttcccagtggaggttcataatagcctcccagtcttaagtccccctttttccctttatgtagttacagtctctgtggcagagaagggaaagactctcgcaggtcccagcaacaagcaggttgcatgctggcgtgagccaactcccaggaatttgggccagcggaggcatccaagagcagggagggcaagagttggaaacggtaaagggtacccctctcccctgcccccaaaggctctgctttccttctcggcatccaatctttgactttcctcattccccagctgctgtctcagggactcatggtctcctggtcaagccacctcccctacactgctaatagtcctaaagctctgggactaggagggtgggacaaggggagccccagttccaaaactgtattggagaaagatctttcatgaccaaacataatatgagtgtcttttcctaaaaacagggtggtttcatgctgcttagtctagtatggcataccagttctgtattttgggtgcattttggattatataggcatctgtgagctggctggcaacttacccccaaatggcactgcttttgtaagaaaatacataccaaagactaaattttcaaaaacacagaagagatctgttagcttatactatagttctaagaccccagataggtagaaaataaaatggtccttacttcatcaaaagtgagaaaagtcaagatattgctccctcatgctagagaccaatgggttgtataaagcagtattaccgatattgaggatttcgtgcccagactccagttccaactgaggctccaacaatgaccattaacttccacagccatattggagcaaagacagcccagtaactccactgtatgatgccatccaaacgaagggccagcagcacagagaacagcagcagacaggcatagatgaggaatttactaggagaaaagtaaaacgattaagaaggattcacttttacaaatatgtgatactgaaatggggagtaataagagccacatttgtcagcatgtaaaaggagtcactaactcaataatcatttattgaaaaggtctatggggcagacataatgtgttgggaataaaagaaacataaagaagactaaaataagtctcctgctttccaaggcttcctcatagaaggaagaccacacagaaacatataatacagcacaatgtttgtgatgagagcttggaagaggaaatacagactgtgtctgaggaggcactcagaagcagagatgtggtgaccctagagctggttccagagggcaagtaggaagctgccaggcaggaaagcaagtgagatgaggaagtattccaggcagaaggaactagctataccaagacacagagactggaaaaggctgacatgctctgaaaatggtcaagttctatcactaactgattctatttctaaaaaggcagccatctgtcatattcatatggcatgaacattttagtgtatgtattatactttccatgaatgaataaattacacatacacacatgctcacgtctcatataaaagggaattgctacagaggatgtccttgaaataattagaaattatactcttgaggacctctatttccagccttgacttaataataggaatataatttaccttcccgcctaaataagaagcttgatacagtctacaaaagaacagttttcagacattgacaacaggcagtggagaacaggtgagaaggaggaaataaaggaggtaaaccctactattgccccagtttgcagatcagaggcagtttccaggctgcagcaagaaaacagttaaaactcaaccctgtcaataactatattaaatataaatggccaactgaaagacaaagatgatcagattggataagtaagcaagacaactatatgctgtctgtaagaatcccactttatctatctataaagacacagatagattaaaagcaaaaggaaagaaaaagttataccaaataaacactaaccaaaagaaagctggaatgactatattaatatctgtttagtcttccattgctgctgtaacaaattaccacaaacttagcagcttaaaacaacgtaaatttattatctcacagttctatatgacaaaaggcgagacgggcttggttggtttctctactcagaatctcacaaggctgaaataaagatgtctgttggtggaatgcttatcaggggactctggcagaatctacttctaagctcattcaggttgttggcagaatccagtttcttgtggttgtaggactgaggtatgtgtctctttgcttgctgtcacgcagcagctgatcttgcgatagtaggggcctctcctgggtccttgtaaataggcccctacatctcaaagccagtaacaagctatagcatattcaatctttctcatgcttgggatgttttctcactacttctgccatatcgcttctgcttccactgagagaaagttctccgcttttaagagttcatgtgatgaaactgagtccacctggttaagccaggctactctccctattttaaggtccataactgtggttggtaggcagaattctaaagaagtttcccaggattcctgtcccctgattattcaatcaaacactaatctgagtaatactgtgaagggactttgcagatggaattaaggttactaatcagctaactttacaataggaagattatactggattatccaggtgtgcccagtgtaatcacataagcccttaagaaagcagaagagtaagtcagagaaatgtggtggaagagagatgaggcagaagtcagagagattccagacttgagaaggattcagcctgttacttctggctttgaacatggaggtaaggaaccatgagccaaggaatgcaggcaggcttcagaagctgagaataactcgcagctgacagccagcaaggtaaatgggacctcagccctacaaccccaaggaactaaattctgacaatagcccaaatgtgcttgaaagcagattaatccctggaggctccagaaaggaatagagccctcctgacactttgattttgaccctgtgaaactaggcagaagacccatctgagttgtgctgtacccggacttctgacctaaagaactgagagtaatttgtcatggtaacagcagaaacgaatgctaataaatatagcttcaaagtcccctttgccatgtaaaataataacatattcacaggtttcagggcttagggcctgggtatctgtgtatttgtgggggtggggcattctgcctaccacaacataagacacagtatatttttgaacaaggactatttccagggacaaatagaggtagttcataatgataaaggggtcaatttgtcatatgcctaataacaaagtttcacaatacatgtagaaagtactgatcaatctaaaaggagaaataaaaaaatcaaactgttataaatggaaattaacattcctttcttagtaactaatagaacacataaacagaaaattactaaggatatatatgattgtagcaacactatcaaccaacttgacctaattaatattaatgagttcctcccaacaaaagcaaaatacagattcctttcaaacacacacggaacattcaccaagatagattgaattctgggccataaaacaaagctcaacaaatttaaaaggactgaaatcatacaaagtaaacaagcacaatggagtcaaactagaaatcaacaatagaaaaatatctggaaaattctcaaaatacttgaaaattaaatgccacactgcgaaataatccataggtcaaagactatgaagaaaattgaaaaatattttggactaaaggcaaaaacacaatataccaaaatttgtgagatacactaaagcagtacttaagggaaattttagcatcaaatacttacattagaaaagatatcaagtcaataatctaagattctatcttatgaaactagaaagaacatggaggtaaggaacctccatgtaagaaacggaaggaaatttgtaaaaagtaaatggaaagaagaaaatgataaatgtaagcacattaatcaataaaatacagtaaaaagggattagagaaaaaaatcaatgaaactaaaagcagtttctttgagaaagtaagaaaattggtaaatctacagccagaataatcagtaaaaaagagtaggctcaaattactaatatcaagaatgaaaacagggatatcactacaaatcctaataatactaaagggataagtaggggatattataaacaactttatgccaggaaatttcttgaaacaaagacatggaaactgcaattctagttaaaacctttttcagaaagaaaatgtcaggccatggcaaaatctaccaaacatttaatgaggaaataccaccaattcttcacaaactcttgcaaaaaagatgaggggggaacatttcccaatttattttatgaagccagcattaccctgataacaaaactgacaaagaaagaaaactacagaccaatatctctcatgaacagagatgcaaaaatcctgaaaagattttagccaactgaattcagcaatatataaggatactacattacgactaggtgtggtttagctaggattgcaagattgcaatcttggattaacatttgaaaatcagttagcaaccttcgtggtattagcaggctgaaaaagaaaaatcatatgatcatctcaatagttgtgtaaaaagcatttgacgtaatttgctacccattcaagttaaaagcgttaaacaaattaggaaaagaagagcatctatgaaaaacctgcagttataatgcttaatggtgagagactcaatactttccccttaagacaggaaacacagcaagtatgtccacttcaacacatctattcaacattgtactaaaggtcctagccacaacaataagatgataaaaagaaattaaaagaatatagttttaaaagaaagaagtaaacctgtcattatctataggcaacatgatattccgtgtaggaaatcctaagtaatctaaaaaaaagctagtagatctagtaagtgaatttaacaaaattgaaggacacaaggtaaatttacaaaaattattgcatttctatatagtagctatcacaaattggaaacagaaatttaaaaatatgtatcatttactgcaactttcctataaatttataactattcaaaaattaaaagtttatgaaaaaatccaccatttacaatagcatcacaaatataaaacacttagggataaatgtaacaacatatatgcaaaacctatatactgaaacctacaaaacactggtaggactgtggggaagctaataaacaacagaaatttattcctcacagttccagaggctggaagttggagatcaggatgccagcatggctgggttctggcgagggctgccttctgggtggcagatggcagacttctcaatacccttcacatggtgaaaagagagtgagttagctctctggtctctttttataagggcactagttccaaccatgagggttccaccctcataacctaatcacctcccaaatgccccacctccaaataccatcacactggggactagagtcaacttgtgatttttaaagggacacattcagttcataactgccaagaaaaattaaagatctaaataaatggagacatatactgtgttcatagaacactcaatactgttaagatttacatcctctgtgtattagtttcctatgggtgctgtaacaaactaccacaaaattggtgacttaaaatggcacacatttattatcctgaggccagaggtccaaaaagggtttcactgggctaaaaccaagatgtcagcaggacctactccttctggagactctatgggagaatctattacttgtttttttccagtttccagagctgtattcccttggctcatggcccctttctctatcatcaaaaccagctgcataaaatcttcaaatctctgtctctgtttccaccacactgccttctcctcttaatattatctccctcttttaagggaacctgtgattgattgcatttattgccccacttggataaccccatcatctcaagatctttaacaggttccatggaagtgggtatctttgtgggtcatgatttagcctaccacacacaccaaattaaccaaattattttaaagaatcaatgcaatcccagcgaaaattgggagccagcaggttcttctgtagaaattgacatactgactttaaaagtcatatgacagtgcaaaggacctagaatgggcaaaacaattctgaaaaagaacaaagttggacaatttatactacatgctttcaaagcttactataaagctacagtaataaacacaatgtagtactggcataagaatagatatatagaacgtactagagagttggaaaacagacccatacatatagagtcagttaattttccacaaaggtgccaaaacaactcaatggagaaataattatgtttcaataaatggtggtacaactggataaatgaggaaagtacaccttgactcttaaccttataacatatacaaaaatttatgtgacatggatcatagacctaaatgtcatacacaaaactataaaatgtccaaaacacatatgaaaaaaaaatacttgcaacctacggttaggcaaacatttcttagatgggatatgaaattggacttctccaaaatgaaaaactcttactctccaaaagatacctatcattaacaaaatgacagccaagccacaaactgggagaccatactctgaaaacacgtatctgacaaagtaacctgtatccagtatataaaaaggacttttacaactaaaaaaataagtgaacaacccgatttaaaatggccaaaaaattcagagacatcccatcaaagaaggcatacaaaaagcaaataagcacacaaaaaatactcagtattttcagatgttaggacaatgcaaactaaaacgacaatgagataagattacacacacactagatctcttatatatgctggtgggaatgcaaaatagtacagccactttagaaaacattttggaagtttcttatacagttaagtgtatacttattctatggcccagcaatcccacacctaggtattttactcaagaaaaaggaaaacgtatgtccacacaaaggcctgtattcaaatattccaagaagctttattcataattgccactggtaacaactcacacatccataaactggtgaatggttaactgaattttgatatatccgttcaatggaatactaatcagcagtaaaaagtaacaaactatggatgacaacaacaacattgatgaatctaaaatgcactataagtaaaataattcagatggaaaacacaagatagtgtacaatgctacttatttgacattctggaaagggcaaaactctagacacagaaaaacagatcagtgcggttacagataaggaacagaaagctcagatgttaaataacttgtctaagagctcagagttgggagtcaaaccatttgactccaaaatccttctaattgagtattatactataccggctttacactgataaatgaacatgtttagaaaagcatctgtataaatatctgctgagcagctaacaggtctccactcgggaagattaaggatagtctttatactcttttgcttatgatatctgagttttctgtaaggtacgtgtactgtttttgtactatgaaaaataacataagaaacttcgattggaaaaaagggaggagggttgtaagaagactggacctacaaaattaaacttggaagcaagcctcccagagagaaaactacgctgggaagatcatgagattcagaggggttgctaaaaaaatatacatagcatcattgtgtcatggtattcttacccataaagttagggcaataatatgtacctcataaggtggctacgaatataagataatgagtataacaagtgctttgtataaagcactaaatcagtggctctcaaagtttttagtatcaaaaattttgacgtttaactcttaaaaagaactccttttcagttctaacacttactgaggatcccaaagagctctggttgatatgggttatccctattggtatttaatatttacgatacagttgttattcaaaaaatatctactcttcgaaggtaataataaacacattacatactaacataaataacattatttaaaaacatttccaaaaccaacacaaatttagtgagagtagcgacactgtttctacagtttagcaaaatttttaatgtatgatatcatagaagacacctagattctaatatctatatttacattcattctgttgcaatacattgttttggttcaagtatacaaagaaaatctggcctcacagagatctgtagttagaaaagaactattttaatagctctttcagataatggtagacgttcttcaacaggacactaaaactcaacaagtggtagtttcttaaaggttaactatgatgtggaatctgaaatcgtatcaatgacctttttgtactctgctacactgaaatccactggtctctcttatactttcaatgaatcttttatcccagcattattgtataatgcaatgtaggtcgactggaaaatattggtttactgagttataaagatctttcaaatgttgacacatttcatatacaatagcaaaaaaaatcacattacttactatcttcaccaacttcatcagaaatattttaattactgggaggttgtcaagctcatggtagcagatacaacttttcaaaaattctggttttcccatgaaagatcaaattttaccatttacaaaaaataccatgagttgttttccttgaagttttgcttcctgcactttctttttttgtgtgtgtgatagaagcatcttttattatagtatttttgtctttttttttcttttttttattattattatactttaagatttagggtacatgtgcacaatgtgcaggttagttacatatgtatacatgtgccatgctggtgtgctgcacccattaactcgtcacttagcattaggtatatctcctaatgctatccctccccccaacccccaccccacaacagtccccagagtgtgatgttccccttcctgtgtccatgtgttctcattgttcaattcccatctatgagtgagaacatgtggtgtttggttttttgtccttgcaatagtttactgagaatgatgatttccaatttcacccatgtccctacaaaggacatgaactcatcattttttatggctgtatagtattccatggtgtatatgtgccacattttcttgatccagtctatcattgttggacatttgggttggttccaaatctttgctattgtgaatagtgccagttagaatgtcaatcattaaaaagtcaggaaacaacaggtgctggagaggatgtggagaaataggaacacttttacactgttggtgggactgtaaactagttcaaccgttgtggaagtcagtgtggcgattcctcagggatctagaactagaaataccatttgacccagccatcccattactgggtatatacccaaaggactataaatcatgctgctataaagacacatgcacacgtatgtttattgtggcttcctgcattttcaagaaaatgtctgccaaacaccataacacaaataaccacagtcttgtctgtcagttgtccttccaaataaaaatgatactccatgaaaacagcagcttgtaactcaggcacacacgtttttccttgagtcaaccattgcacttcagcatacaacaggcctttatgcattcttcccatttcatcacatggaatattaaactagatgtgcattcaggggtcaagattaaatgagattaatatttttctgctttatcaaggacattcgtaagtgaagctggcattttttttttaactgcaagtccagcacgtggtggtgaagaatccagtgacagaagactagtgcagctggtgccactgtcctgatttgtgctccagcaccagctgtttgatgcactacttttgtaccaccagtgccaatgtcgaccaaggcaaagaatgtcttagtattataattttgactttgcagatacctggaaagggtctcaaggcccactcccaaggtctgtgggaaacagtctgataaccagcgtactcaatacacattagctaataatattaatactcgaaaacaaaaacaggcttttataagctgctacaaagaaagaacatttaaagaaaccaagataaaaatgacttcatcccttagactttggacaagaagagagcctgtgtcaaggtgattcacaagttaatagaaatggagttatcaccacaattacagtacacaattagtagaggcagaagttttctctcttaaagcagagggaaatattccaaaatctaaaaaaatcagaaccaatttgtcaactaaagcctgtggctacaaatataattaccagaaacaatggacttgaaaacagactatttaaaaaagaaattagtggattcaaacattaacaaatgctaagataatgacgacacaggattcatatgtaaattagataacatgtacaggtaatttttatcctaaaggattttcagactataaataaaaagtaaattggtgggggggggtggtaaatgctgtaagctaacttcattatcctctgtaaaacagtttccttatttaataaaaaaagagagtagtggaactaaagaaaagagaagtaccaaaatgttttaaatgttggaaaagggattattttatgtggtttttgacataatttaaaggaaacttaaaattttatgtctattacatgaaaaatagaaaacaagataaacttacaaaaggacccacaaaatataattcatgattcaaatactagggttagaaaaatatacatgagctgaatgttctcttattaatttcctattgctgccattcaaaactgccacaaacctagtggtttaaaaagcataaacctagtggtttaaaaggcataacccttacaattctggaggtcagagtccaatatgggtctcgctgggctaaacttgaggtgtcagcaggactatgctactgaaggctctaggagagaatgtttctttgccttttctagctctagaggctgccacattccttagctcatggccccttcctccatcttcaaagtcaacaatggagaatgcagttcttctcatactgaatcactctgacctccttttctgtctccctcttctatatttaagggccctgtaattacattgggctcagccagagaatccagaataatctattttaaggtcagctgatgagcaaacttaattccatctgctaccttaattcccctttgccatgtaacagaacatattccctggttccacggattaggatgtggacatacttgggggcgtcattattctgcctaccacagctctgtaaaaagaaaggttgcttcctagattaagaaagtaaacctgttacattcaagagttacgcttggaaccaaagtcaaaagtcgaaccaactatcagaaatcagatgacagaggtttagcacgcctggatgaagacaagagcaacaatttactatctttaaaattagataaattagatttcaaagccgaaagtattaaaatgctaaaaggactaataaggaaaacctaaataacaaaaacctaacatgaccatggaatatggaaataattttacaatttttcttttttaaggatacacagaaatattttaattgtgggcttcctcatgctactcttaaatcatgacagataaaacagacaaagttcctaaggaaaatacggaaatgaacacaagagtagatttaaaaaacagcaaggttatatgaagagaattaagtagcagaacgagaaaatttaaaaaacagcaagcttatatgaagataattacgtagcagaacaagaaaacatacttgctttacatatatatagtttttccagggagaaaaaaaggatcatggggcagcaatacacaataaacacacatctaatttacaattgttaaaaatatttgagtgcctgaaatgtgtgagatacataaaaaggagcaacaatgcgttcgctcaagatgctcagactaataggaacagagggagatgatgtatcaacaagtaactacatatggtaaactaggggacttggaagattaatttccctgagagagatgggaagagaagtggaatctgggcaacaagttgggaataaggaattccagacaaagggaataagatgttttccaattttttaaaaattatttttatttattatggatacaaaacagttgtgcctatttatggggtacacgtgatactgtgatgcaagcatacaatgtgtaatgatcaaatcagagtaactgggatatccatcacctcaagcactgatcacttacttgtgttaggcacatttcaattccactcttttagttatttgcaaatatacattattaactatatttgccctcttgtgctaccaaacactagatttattatttctatctaactgtattattgtacccattgctcatcccctctttatcctcccctctccaattccagcagactggaacacacagaatactttctataaatcgtggtgggtagggtgctgcagagacaggagaaagggtactggggggaataagccagaagttggctgtggtaacatggtaggggaatgtgaatatcaaggtaaagtccttggaatttattaataggtaatatggggccactgcagattttctcaacaagagtgacagaagatacatatgagtgtgtaaggtagattgtaatcagtagagaccagaggtagacattttatacaattcataaaaacactgacaaaaaatggatcattttcaatactgatttgttaagcagtttagtagagttactaaaatacaattgaaacataaaaatacctgggcagctgccaaaacaaaactcaagagaaaatgtgttcatttaaaatgtttaagtaaaagtagaaaacaaagaaaaaaaaaaagaggcaaaagaaaactagtaaactgagtttctaagaaatttggggaaaaagccaaaacatgaaaataataaaactaaaagtagaaatatagatataaaaatgaaactgatcagtaatcccaacagctagctttttaaaaaaattaaactacaaagttgatcaagtaaaacaaagtaatacaatcagtaagttcaaaagatgtaattcatacacactcctagttggggaaagaaagaatagtatcttaactatatcaatatatttgcaagcaaagtctaaaaggtgactgcatagccaaaaggaaatatcaagcctgatttgcaaaagaatacacaataatatgcaataatacagtgataagaaaatgtatttacaaaaataacttatggtcatagcctaaactactttgagttacttttcaagaaacattcagaccagattccaagtataaaaatagactgcttaattctccacaaacctgggagaaatgggaggttctggtttaacattaatcactacttcttaaaattcacttttccagttacacctttagaatggatttattccactctcatttgaatctgtagtgttagtatacgatgaatcactaagtagtgctacctgggccaaagctagtatcctctctgaaatttacatggagctttctgctcaggctcaaattccctctctccactttgcagggttgggagaatagggagggagaaaaggaagaagggagggagagagagaatatacttagcaaaggaatgatgactctgaatgtaaaagttctagtatctgttttctgcatatcataagaatgcagctggactctttttagacctatcagtttttttccagtggaagctgctggcttcactggagcacatacacgcgcattaacacatgcctgcatgcacgtacacacgcacaagcacatacacacacacaaactttggatggcacatcccagtctaaagcttgacagaatggctccaaatgacaacctgacatactcacaaactatcaagggaactgcccctcttacaccttattaaccaaatttaaagtcttttagtggagactttagctggttttattaagataaaaaatgtttaagagcatttaaccagtagatacaaaaaagcacaaaagccaaataaaagcagagcccaggccagtaggaagatctgcatttaagttcctcaactgccattcatcagcggtgtggtcttgggtgagttattttcccccaggtctgtctcctcatctgattcctcatatactgattcattaagacaagggtatgtgaaagcactgtgtaaatgatacattttacccattctagctttagcagtattatgaaagacaaaagttctgccacattgtaggtaataatctcatttagcaatcattgttgtcactattaggttggagctgacaaagtatgagtctccacttataaagcatctatctccagagttcgaggcttttgtcttaaattccagtcatcttgtacaggcatgacatatcaggcaaaatgattagaaaactcaagctccatattaaaaagcttaacttctggagtcctaggaaactatctaaaactccttcaatccacggtctctcctgtacaacaaagacttcccagtggtagatgtctatttgtacccaacatccactcattcagcacgtaattcagcacctccaaatcctggccctcaaagaacacagctaagaacaatgtgtgtgtaattatcaagtaataggaatgatacttttaaaactggaaattatacattcaaatgagatttctctcctttaaccagtccccttgggaggcaatgcagtaattccaatggtacttcattactcaaatcatctttgaagctttcttcttggaagcaccttgagaacctgcagtctgatcttctgactatcccaaatggtgctaaattttcactgagggtggattcaaattttggaaatggcaaacagtcagtcagagccaaggttagtgaataagatgtgtgatcaaactaggtggaactattttggttgaaaatgatagatgatcataaagcaatgagatggatcttcttatgtgatatgtaaactgactttaaagggaattccagatgagtaacaaggagtatgaacaatggaataggtgtatacattctctttccccaagtaacctctttgaataacaacactcatttggatgtataagcgccactaacaggtttgttttgtttaatcacttacaatttgtaaatagagggttccttagcatactggatctacaatgtcatggaggaaaggagttgtcacttaactagaactatggcatggcacgcaggaaagagcacaggcttcatgagactgacgtggattcgaatgttgacttagattcttcctgcctatgcaacttcagggaagtcacaagctgtcaagactttaaaataaggctgatacctaattttgcagggttgttgtaaagatcatggataatggatgcaaagcccctacattgggcctggcatgtggtgggtactcaagaagtcacagctattattaacagcaacatcagtaaaatcaagaccattttctgactgtaggtggcttgagaggacagaacaacagataagcagtcacttgagtggtaagtagttcattgacagtactgacagtacactcgtgcattagatactgctttcttaaaaacaataacctgtaaaaactatttgcagtaactatgtatttttaattcatacgacacatatcatctgcagtgctcataccacatggacctcttcactacctgaacataccaggcactatcatgaccccatgcctttgtgtactttgtcccttctgagatactgaaaggggccagcccctccacacctgtgggtatttctcgtcaggtgggacgagactgagaaaagaaataagacacagaaacaaagtatagagaaagaacagtgggcccaggggaccggcactcagcatacggaggacccgcaccagcgctagcctctgagttacctcagtatttactgatcattatttttactatcttagcgaggggagtgtagcagggcaacaggtggggagaaggtcagcagggaaacgtgagcaaaggaatctgtatcatgaataagttcaaggaaaggtactgtgcctggatgtgcacgcaggctagatttatgtttctctttacccaaacaactcagtgtagcaaagagtaacagagcagtattgctgccagcatacttcgcctccagccacagggtggttttctcctatctcagaatagaacgaatgggaatggtcagctttacacagagacattccattcccagggatgagcaggagacagaagccttcctcttatctcaactgcaaagaggccccgctctttcactactcctcctcagcacagacactttacgggtgtcgggctggggggtggtaaggtctttcctttcccacaaggccatatctcaggctgtctcagtggggggaaaccttggacaatacccaggctttcttgggcagatgtccctgcggccttccgcagtgcactgtgtccctggttaatcgagaatggagaatggcgatgacttttaccaagcatactgcctgcaaacatattgttaacaaggtacatcctgcacagccctaaatccattaaaccttgattcattacagcacaggtttctgtgagcacagggttgggactaaagttacaggttaacagcatctcaaagcagaaacaatttttcttagtacagatcaaaatggagtttcttatgtcttccttttctacatagacacagtaacaatctgatctctctctctcttcctcacaaggtacccttcctactctctggtctgatgacaaccctacaattctagctcaaaagtctggctcaaaagactagctcaattcaaaatctagctcaaaagtcatttccactatagactcttccctgcctgctcgagacagaattagtagctctgccatttgtacttctaagacatttggtttctttcactgtaatgcctcatactctattgaattcttatttccctttcatttctgcttcttccactaggcttacgcattgagaggaggactatattcctttatttttgtacttagagcacctagtacatcacttggcacgagataggaatctagatgtttgaggaatcaatgttataatatactttgcaaataactgttagaggccaggtagctgactttagtgaactatattaccagcaatcgcattcctttttcctgcttcaaacaagagacaagataacttatatggactccagaatgtcttctgaagatggagcatacagaagtctccaaacactactgatctcatcagtaccccatgcccacaagttggaacccccagagcaacacttctcagcctttgttccagtctagcacacctgagggatacaccacactcccatcaggagctcacaacagatgactaagaaggcccagcagagttttcacagccttccagtgccacatggctaccagggtggaagggccttctctgaaccagcaactcccccaaagtagcagaaaatttcaaggctccatggtgagtgccgggagcccacctaatgctacctactaccagatccctaccacctacaatgcctcagaatcagtttgcctactctaagaacagggctctttcactgttaggaagcctcaggcattcaaggaaggacttgtttgtgggtccggtacatctgtttcggcatgtcttaacctgcataactaaaaagcaattatgaaaagaagttcatgatcaaccagttcagtgccagatggaaataggtagagtgggtcagctggcagccctgtacatctgagtgttgacacttgtgaatcattctctgtcactatagtttccagagccttgccaacgcagcagtgggttcagacttaccaagatccaaaaggctggaaaggggatctggagccatgacccatgccttgggacccaccaaaccatgacagtgactatttctatgacaaagacatgctcttcaaagtaaatatagccatattctgccttagtgccatgttctctcccatctctccaaagcaatggctgcactctgaaggtgggaagagtgtgagaagaaagagaaccaggccacagaccaccaggaaagcagtgattgaaagcagcagctctagatttatcttataggctctggagagttattcagttatttactccacaaatatttattgagccaggtactattccaagtatgcaggctacgatactgacacagtcacggccttgaccccatggagcttaaagtttagtgggggaggcaggtattaatcaaataagcatccagacagacacaagggtacaaatatgcactatgatggaggagtagtaaatactacaggaactgtagaaacagggagcagtaaatctggtcagggaagtcaggaatgcttcccttagcaagtgccaagtgaggataaataggagttcactaggtctggaggagaggaaaagagagggaaacattcctggtaaagagaacagtgtgtgacaaggtcctggggtaggagggagatgttgaattggttcaaaaatagaggcagggagcaaagcagtagcatcaaggtttgagtccccagcataaggtaacttcctgtgtacacccctcagttttctttctcctatagagaaggccttcctcagcatggaaggagactaaagcacactgtcaaaaactaggagtgctcaggagaggtgaaacactaccagctaaaaaaacaaatctgatttaccaataatacctggccaatgtcctcttgaaatatctgtaaaattaaggaactcactacctctggcaacaatgaatcaggaaaatggcacagtataaaagacctttaaacttttcaggtagaaatacattttaatgcaggtagaattaagagattgatgaatatgttgagaattactataaatctgcttagataccaggtatttcactgtaatttcatatactaatttttttggggggaaaagggctaaaggaaaaaacggttaaaggtagtatcagtgcagcactattttgctttggcaactccgttagcctgtttgatcacttaaggcagtttcttgaggcttctgaattctctgtcaccttgcaaacaagtcactgtagctttctatttgtaaggcactttgtaatcaatccttaattggcctccctaccccactgagagattatactcattctacagataaaacaatagataagtgagttgcccaagggcacaaaacaattcagtttttacttaactttcttatcaccatctccaaatagaagacatacagggcttgtccagccacagcaccaaccctactaccctgcagaccaatcttaaccccctgatgcagcagaggaagggactgcagttagttctgttacctcctctatgccttcgaagccaacaatgataatgtctgcaccgtgttagagacactggcactcctaaccagaacatgaactcaaagtggaataagggcacatacaaagtcacaatgactcacaagttaaaatgtcaccatccctagggagactgcaccctcaacatacaaatactcccctaaaacttcctttcatcctcaacaagcagccaaggcataggtccccagagttggcccccgcagtacagcactgcacagtactgtaaggcatcttaagtgtacaagcccttcttcaccccatgctgagaccgccagcatctaaagcacctaacataggttacagcacacaaatatttactgagcacgtcttcccaactggcaaataagggaaacggatactcctttcggagagtagtgcatttaagagatcagttaggccaactcctcattttacagaagggccaaagaagggcagagaatcacccagttacatatggcctcgtctccaatccaagtctttgggctcagtttagttccacaaacattttatatgtgcctactatgtgccagatacggtgggtgggaggcgctggggacactgagatgagcaggagatggtctcagcttcagggagctcacagcctggggtaaagaacagttacaaaacagtcgggcaagtgcaaggacaggcgcttgagtgcttagccagtgttttctccacactgtccactgggtgttccccatctggaaaagaaggacagcaatatctacttcctgcaaataaacttgtagtgaagactgatgagaaaatgagtatggaaaatgatcaggctcacccagaaatgcattatataaggtattgccataccccgacactgactccaaggattcaacagtgtttcaggtatccgttcaacaaagaagcaaacaagagagggatgggcataaacccaaggaaaaccccaaggactgcgaggaactggaggaaacagctggggtgggggtaggggtgttgggtcgagtgagacggccctgacgcggagaatggagggcccgcagcggcgcagaagaggatggaaccgagacgaagaagttgggacaccaatgagggacagcaagcagaaaagaatggggttcccttggggcaggacggggctcgcggccgggcccttccggccgtggccgggcaggggctgaaagcaccgggcacgggaggaggaagcgggcgggcgccgaggccgactgttttgcctggggaccgcttgcacccgcagggaggctcgggcaggcgcccgggtcctcgggctgcagcatctcgcccgccgtgcctccccggagccgaacaccagcccgcgcccgagcccgcagcgcggactcccgggggcgccaacgacgccgcctcacctcgggttgaagtcctggaagaggcccctcaggttcatggcggagaacttcaccgcggcgtcctcctcctcctcccccgcaccccgtgctgcacagcctgcgccttacagcgggttcatggcgccagcgccagccgcgtccacgctgctgctcccgctactgctgccgtccccgctgccgtcgccgtcgccgtcgccgccgccgccgccgccgccgcccggagaaacctgagccaccgccccctgcccctccttccgggcttccgtac

SEQ ID NO: 1455 - DNA, 35280 bp, Homo sapiens; identical to SEQ ID NO: 1454

SEQ ID NO: 1456 - DNA, 120427 bp, Homo sapiens
ttaaagacatcttttgtttattgaacaattttatataaggcttcccctatgttcaatacttgtcccagagacgaagtgacgataagtcaatattctctcaggaatatcacattggagtgaggagttccactgcctgttgaccgtgttttgtttttctttgaataatctaaggatacgggatagaagttaagttccaactgtttctctcatcttatgatatgatattttaagtctttactggccaaaggtcatggaagcactggggaaagcgctgagctttctcctcaccaagctgaggtggggtggacaagagaggttgtactaacaaagctttccttttaacaggatgacttacaacttaagtgtctccctttgtgggaggaatcccagctatagcctagtggaccattcacccagggatcttcaatcattcgttcaaccctaacatttatatgcgcaccagctacatgctaggcagtgcgtcaggcattaaagatacaaggacgaatacagcagacacgacctcagtctttggacagagtttaccttctattgaggaagatagatgataaacaagtaataaatacataaacaaagtaatttcagctagctataaatgctatgaaaaaataatagtgttatataataaagagcgactgggaaatctatttcacatggagtgttaagtgaaggactttttgaagaagcgacatttgagctgttacctgtatgatacgagaccaacaatgtaacaagctgaggggagagcattccaggcaaagggaaaagcaaaaacacagccttggagtggaatggagttttattctgtttgccgaccagtaagaaggtcacgtggctggagctgagtaagcaaggggaataatggtgggagaaattacgtggaggaggtagtcaggggctagatcatgtatatattgccatgcaggccatggtaaggactttggattttattctgagtaccatgggaagccactgaaaaaccttgcctaagataatgggtttctgttttgcctaaggcaaattaactttttactgaagtatactatacattacggaaaaagtacacaaatcgtaagcttgatgaattttcatgatgtaatcgcatccatatcactagcacccaggtcaataaacagatcattaccagaaccccagaaccctcccttatgcccctttccagtaacgcccatcccccaacccacgggtaactaccatcctgacttctatcaccaaagattagttttgcctgtttatataaaactttatataattgcaatcacaatatgtattcattttgtgtctggcttctttcatttaatattatgtttaggagtttcatcattgcttagcaatagtttattggtgctatatggaagttgagtgcgtgatcacaccacagtttatccattctactgttgatggacatatgagtaatttccggtttggaactactacaaacagtgctgttatgaacattctattacatgtcttttggtgaacaaatatattcactcctatttgaaataaacttaagaatggaacttatggatcataaggtatgtgtatgctcagatttactagatactgccaaagatattctttccaaagataaattaacatccaatggtgccatttttggatatctcaggcaatattccttagtgttagatagtacatggcacaatcagagccaacattcttagttttgttgcatataaaatgagcataataacatctgcttagctgatctcacagggctactgcaagaatcaaatgcaaaaataggccgggcgcgatggctcacgcctgtaatcccagcactttgggaggccaaagcggtcagatcacctgaggccaggagttcaagaccagcctggccaacatggcgaaaccccatctctactaaaaatacaaacaaaacaaaacaacaaaaaaattagccaggcgcggtggcacgcgcctgtagtcccagctacttgggagactgaggcaggagaatcacttgaacctgggtggcggacgctgcagtgagccaagatcgcgccactgcactccagcctgggcgacagagcgagactctgtctcaaagaaaaaaaaaaaaagaaagaaagaaagaaagaaaaagaatataatagtccatcctcccaggcttcaaggagccatgcctggagggagaatggagtgaggaagcacagtcttcaccaggctgttgacacccattgtcatttccagaaacttctagtgctgggttaggcatttgtgaaaatattatttaatttacttatttcatcatcccagaaggaaaggtgttattaacctccttttacatttaaggcaactgaaacttagagacctgccacagagttcatacgtagcagagaggttttgaaatcaggtgtccttaattctttaactcattgtttataccagagaacagaaaaatgatcgtaattcctgtgtacgcttgttcatgagagcaacatttttacagatcacacttacaatcttttgacttcaaactgagatttgcagtttagaaatgtttccatatacactatctgattgaccctctgcatgataaccacgtgaggtaagtagtacagctgttattgtcttactttatagataaggaaaataatgataagaccttgtgatttgtccaagcttacatggaatttggtattcactatttatattagatggtggtgttttctaaagccaacagagaaagtagcaggaaaagtctattacacataagcaaaatggttgtgcaatactttggattagaataagactatttctggactttggcacaaagtgatgccatcatattattgtgcagtttttcctttttttcctgctttgatatgaagcaagagagacgtgggagtaggggaaagcaaataaagcaggcatttatctgacaagaaaagctaggaagatttaacaaagttatccttcttcttagttgacagacaagtatttcccaagagagctccataattgagcagacgatgcatttgatggatttgtgtattgtggtgtaagtgaaagctggtgggctttcagataggtagataaataggctttcagttagatcaccattacaatctcagttcaggtgtgtgaccttggaggagctatagaaattataaaaatgctagaagaaaacctcgggatgactctccaggataatgctctgggaaaagattttattccccaaaagcacaggaaacaaaacccagaaatagacaaatgagactggattaaactaaagagtttctgtgaggcaagggaaacaatcaacagagtgaagaaacaacccacagtatgggaatatggccattgtagaatggctgttattacaaagaccaaaaatgacagacgttggcaagtatgtggagagaaaagaactcttatacattcaataaacggtgctggggaaactggatgtccacatgcagaagaatgaaattagacccttttcttacaacatatacaaaaatcaactagaaatggattaaacgcttacatgtaagacctgacaccgtaaatctactagaagaaaacacatggtataactctatgatattggtctatacaattaccttttggatatgatccaaaagtataagcaacggaagaaaaactaggtaaatgaaattgcatcaaactgaaaagcttctgcacagcaaaggaaacaaaagaatgaagagacaacctgcagaatgggagaaagtatttgcaaactatacatctgataaggggttaatatctaaaatatttgaggaactcaaacaactcaatagtaagaaaacaaataacctgatttaaaaatgggcaaaggatctggatagacatttctcaaaagaagacatacaaatggccaagaggtatatgaaaaagtgctcaacatcactagtaatcagataaattcaaattaaaaccaccacgggatatcatctcatacgccttaggatggctattattaaaaagacaaaagataacaatgttgatgaggatgtggagataagtgaacccttgcacactgttggtgggaatgtgaattagtgcagccattatggaaaacaatacggaggtttctaaaaaaagctaaaagtagaactactacatcatccagcaatctcaccactgggtatatacccaaaggaaatgaaatcagtatgtccgagagatatcttccatgttctttgcagaaatattcacaatagccaagatataaaatcaatctaggcagaatacatgggagtgtatatagagaaaatgtggtatgcataaaaagtggaatactattcatccttgaaaaagaagaaagtcctgtcatttgtgacaacatggatgaacctggagaacattaagtgaaaataagccaggcacagaaatatcaatactgcatgatctcactcatatgtgtaatgtaaaaaaaaagttgatatcatagaaatagagagcagaatggtgggtactagaggctggtgggttgtggagtagtggttgggtggttggggatatgttgctcagaggatacataattttagatcagagaaataagttcaagtgatctatttttccatgtgatgactatagttaataacaatgtatcgtaatttgaaaatttctaagaaacagtcaatcaacggagtgaagagataactcacagaatgtgagaaaatgtttgcaaactatgcatctacaagagattaatacccggagtatataaggaactcaaactcaataaccaaaaaagacatattcccttaaaaatggacaaaagttctgaatagacatttctccaaagaaggcagacaaatggcaaatgggtatatttttaaatgctccacatcactaatcattagggaaatgcaaatcaaaaccacaatatcacctcaccccagttacaatggctatcattaaaaagacaaaaaataggctgaaagtaaggatggttagtatgtacaaacacagagagaatgaataagatctagtatttggcagcacaataaggcaactatagttaacaataacttattgtatatttaaaaataactaagagagtagaactggagtgttcctaacacaaagaaataataaaggcttgaaatgatagatacctcaattatcctgatttgatcattacatattgtatgcctgtatcaaaacatcacatgcactccataaatatatacaactattatttacccataataattaaaaaaatcaaaatttaatttaataacataaaatataataaagtgatcttaaaagaaatttgcccgtggttagatattacttgttacactttaattgatgatttctattataatttcatagtacttagaatatatatatatattagaaaatatcatctataggatttttgctttcatgagggtaatgatattttaagcctaaaatattagaattttcaataattttctctagtgtttggaaattattttaatcctctgtttagtgctcaaaaatgctgttcatttgtgactgattagttaaactttctaataaagtgattttacactctttatgttaaagaaacaacaaatgctggtgaagatgtgtagaaaggggaaatcttatacattgttgatgggaatgtaaactagtacaggcaatatggacaacagtactgaggttcctcaaaaaattaaaaatagaactagcatatgatccaaagaactcactactgggtattttaaaaggaaatgaaatcagtatgttggagagatacctgcactctcattgtgatggttcaatttacgagtcagcttgactggattgagggatgccaagacggctgttgaaacattgttccctgggtgtgtcggtgagagtgtttccaggggagcttggtgtgtgagacagtggactgcaacaggtaagatccactttcaatgcgggcgtgcactgtcctgttagctgggagcctggttgggacaaatagacagaagaggaggaattctctctctctgctcatcctatctcccttctgcagccagatttctttcctcctcctgtccttggacatcagactccagtttcttccacttttggactctgggacttgcatccacagcctccagtgggctcttaggcctttggcctcagactggggtctgtactctcagcttccctagttctgaggcttccagacttggagtgaatcgtgctaccagcttcttcggttctgcagcttgcagatggcctattgtgggacttctccatctctataatcatctgaaccaactacacctcataaatcctctctcatatatcctattggttctgtctctctggagaaccttgactaacacacccatgtttattgcagcactattcacaatagccaagatatggaatcaacataagtgtccatcaacagatgaatggataaagaaaatgtggtgcatattcacaatggagtactattcagccataaccaataatgagatcctgtcatgtgtgacaacatggataagcctgtaggacattacattaggtgaaataagccaggcacagaaagacaaactttgcatgtgctcacttatttgtgtgagctaaaaattaaataattgaaatgaagatagagagtagaagggaggctgggaaggttagtgggagggtgaggaggaagtggggaaagttagtgggtacaaaaaatagttagaaagaatgaataaagcctagtatttgctagcacaacagggagactgtagtaaaaaaataatttaatcatacttttaaaataaccaaaagagccaaatcatgagtgaactcccattcacatttgcttcaaagaggataaaatacctaggaatccaacttacaagggatatgaaggacctcttcaaggagaactacaaaccactgctcaatgaaataaaagaggacacaaacaaatggaagaacattccatgctcatgggtaggaagaatcaatatcgtgaaaatggccatactgcccaaggtaatttatagactcaatgccatccccatcaagctaccaatgactttcttcacagaattggaaaaaactactttaaagttcatatggaaccataaaagagcccacatcgccaagtcaatcctaagccaaaagaacaaacctggaggcatcacgctacctgacttcaaactatactacaaggctacagtaaccaaaacagcatggtactggtaccaaaacagagatatagaccaatggaacagaacagagccctcagaaacaatgccgcatatctacaactatctgatctttgacaaacctgacaaaaacaagcaatggggaaaggattccctatttaataaatggtgctgggagaactggctagccatatggagaaagctgaaactggatcccttccttacagcttatacaaaaattaattcaagatggattaaagacttaaatattagacctaaaaccataaaaatcctggaagaaaacctaggcaataccattcaggacataggcatgagcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacctacttgtctgacaaagggctaatatccagaatctacaatgaactcaaacaaatttacaagaaaaaaacgaacaaccccatcaaaaagtgggcgaaagatatgaacagacacttcccaaaagaagacatttatgcagccaaaaaacacatgaaaaaatgctcatcatcactggccatcagagaaatgcaaatcaaaaccacaatgagataccgtctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaggacacatgcacacgtatgtttatagctgcactattcacaatagcaaagacttggaaccaacctaaatgtccaacaacgatagactggattaagaaaatgtggcacatatacaccatggaatactatgcggccataaaaaaggatgagttcatgtcctttgtagggacatggctgaaactggaaaccatcattctcagcaaactatcgcaaggacaaaaaaccaaacaccgcatgttctcactcataggtgggaattgaacaatgaaaacacatggacacaggaaggggaacatcacacaccggggactgttgtggggtggggggaggggggagggatagcattaggagatatacctaatgctaaatgacgagttaatgggtgcagcacaccaacatggcacatgtatacatatgtaacaaacctgcacgttgtgcacatgtaccctaaaacttaaagtataataatcataaaacataaaataaagtaaaataaccaaaagagtataatttggttgtttgtaatacaaagataaatgcttgaggagatggatactccatttttaccctgatgtgattatgtactgcatacctatattagaacatctcatctaacccataaatatatacacctactatgtaaccacaaaaataataaataaaaataagataaatataaatttaaaagttgatgttatagaggtagagagtagaacagtggttaccagaggcaggggaggcgaggagggaaggagagatgggaagaggttggtcactgggtacaaagttacagttatggttagataggaggattaagttctggtgttctattgcacaatagggtgacaatagtcgacgataatatgttgtatagttcaaaatagctagaagagatgattttgaatgttctcactaaaagaataagagggggaatactacaatcaatctatgcctatatatttgataacttatatgaaccaatttcttaaacccacatggtaaaaaaaaacaaactaattcaaagaaaagtagataatctgaatagcctggcatgcattaaagaaactgaatctgtaatttaaaacttttcaagaaagagaactccgggccagacaatttcactcatgaattctatcaaacatttaagtaagatgtaatacaaattttacagtctctttcagaaaattaaggagagaaaatgaccccactcatattatgaggatagcatcatcctaataccaaactcagacagagatattacgagcaaaaaacaaaatagcaatatctcacataaacataggtacaaatattcttactaagatattagccaatcaactctagcaatgtataaaaaagataatgcatcaagatcaagtggagtttatcccaggtattcaaagttggttcaacattcaaaaatcaatcaatgtattttatcatattgtcatactaaatacgcaacatcgaatgatcatataaataaatgcagaaaaggcattcaacaaaattcaatattaattaatgataaaattcccaacaagttaggaatagaaggaaatttccttattctaataaaggctatccatggaaaacctacagtgaaccactgagtaattttcccctaaaatcagaaataagtcaaggatgtcctttctcaccactactattcactgttagtcctggaagtcccagctagtgcgataacacatgcacacacacacgcacacgcgcacacacacacacacacagagagagagagagagggagagagagagagaaatgaaaggcatacatattataaaggagaaaaatataccccattatgttgaaaaccccaaataatgtacaataaaactccaaaagactcttccagaagactcctagacttgataaagaacttcagtaaagtttcaggatacaaaatcaatgtacaaaacacagtagcatttctctacaccaatatcattcaagctaagaaccaaatgaagaacccatttacaatagccacaaaaaataaaacacctaggaatacatttaatcaaggaggtgaaagatctctacaagaggaactacaaaacactgatgaaaaaattgtgtatgacacaaataaatgaaaacacatcccatgctcatggatcaaaagaaccaatattattaaaaatgaccacactgctcaaagcaatttacagattcagtgcagtctctatcaaattaccaacacaatttttcacataattaaaaaaacttaaaattcatatgaaaccgaaagaagagtctgaatagccaaaccaatcctaagcaaaaagaacaaagcttgaagtattacattctgactttgaattatactacaaggctatagtaaccaaaacgtcatgatattggtataaaaatagacatatagaccaacggaacagaatagtgaacccagaaataaagtacctattaacaactgatcttctgcaatattgacaaaattaaacaatagagaaagaacaccctcttcaatatacggtgctaggaaaactggctagccatatgcggaagaatgaaactggacccctgtctctcaccatatacatgaattaactcgagatggattaaagatttatactttagacatgaaactgtaaaaatcctgtgagaaaatgtaggaaaaattcttctggacattggcctggcttaggcaaagaatttttgaccaggtcctcaaaagcaaatgcaacacaaacaaaaataaacagacgggactcagttaagctaaaaaccttccacacagcaaaagaaacaatcaacagagtaaacctacctaatgagaaaaaatatttgcaaattatgtatctaacaaaggctaatatccagaatctacaagaaactccaacaactcaacaacaacaacaacgacaaaaacaaaaacaaaaaacaagtaacgccattaaaaagtaggcaaagggcatgaatgggtgttttttgaaagacatacaagtggccaacaaacatatgaaagatgctcaatatcactaattatcagagaaatgcaaattaaaaccaaacaatactatcttacaccagtcagaatagctattatttaaaaatcaaaaaacaacagatgttggtgaggatgtggagaaaaaagtaatgcttatgcactgttagtgggaatgtaaattatcacatttatggaaaacagtatggagatttctcaaagaactaaaaatagatttctcaaagaactaaacatggtaaaaaatgaaataccatttgatccagcaatctcactactgggtatctacccatctgcattttacatatacgtggaatactatgcagccataaaaaaataatgaagtcgtgtgttttgcagtaacatgagtggaactggagtacgttatcttaagtaaaataattcagaaacagaaagtcaaatatcacatattctcacttgtaagtgagagcttaacaatgggtacacatggacatatagagtagcataatagatattggagactacaaaagggtgggaagttgacaagggttgaaaaattacctcttgggtacaatgttccctcttcaggtgatgggtacactaaaagcccagactccaccacgatgcgatatatgcatgtaagaaatctgcacttgtaccctctaaatccatttttaaaatcgaaaaatatcaccgtaagataccgcttcacagccactggaatgactattataagcaaacaaagcaaagagcaaacaagttttggtagggcctggtgggaggtgttttcatcatgggggcaggtccttcatgggtggcttggtaccactctcatagtaatgagtgagttctccctctgaattcattgcaagagttggtcgtttaaaagagtgtggcatgtccttggaacagctacaattcatacattgttgatgacagtgtaaaatggtacaagtactttggtaaaacttgttgcagttatttatgaaactaagcattcacctactctatgacccagcagttccactcctaggtatttaccttagtgaaatgaaaatgaaaacatattaaaaaaaacacttttacatgaatgttcacagcaactttattcataataacctgaaactggaaagagtccagatgtgtattcataaaagaagagataaacagaacaggcaaaaatctaatctatagtggtaaaagaaaatcaaactgtgggttcctctgagatgtatgtgcagaagtatgagagtacttcctgtagtgatagtaatattttatatcttgataagggtttgggttaaataggtatatgcattggtcaaaactcagtgagtgtatatttaatattttaaacatcattgcatatacattgtaactttaaaaagctgtaagcaaatattgaactctacttaatgatataaatgttgaagtattagggagatatgtactgatatctgcaatgtattatactttaaaattcactgaaaataagattaactgatgaatgaatagatgggaagataggtgataaagcaagtatagaaatatcttaatggtagaatctagatgtaagtctatggcttttctgtgttaaatgttttcaacttttctatatgtttagaaatgttcataataaaatgttgggaaaatagagttactactcattgttttaggcacttagatatatgagagataacagagggagagtttcccagaggaacttatccaagggaagtaaattaatatttacacagttcctcctacaagccaggggtaaaggtaaggataacaatttatttttaacttcacaacaagtgggcacagaaggtattattattgtaactggaaactcatgactagcaggttaagtaacttgtccaaggccaaaaatcaataaatggcagacaggatttcacactgaactccttctgattacaaagcctgtactctttgtagtatgtcaagttttgcagctatcttcaccctgcctcttcaccccatatctccttccctgcttttttgtttttccctagtacttatcacaatttgatatattatatatttgcttatttatttttaattactctgtcgtcactataatgagaattccaagatggccaggaatttttgtctattgtgcctacagtttcatctgcagtgtcaagaacagagcatgactcttggtagatgctcatgaaatatttgctgagtaaactgaattaatgcacagtaacagtttgcttggaataagcagaagcaggagcggtaatccatctgcaaaaatgcatagtaaaaagcttggctgcaagatgcaaaataatgggctccagaaacccaaagcagtttggaatagctagggaagaatgtatggaaaacatgaattacatgctagaagagtaagaagggatcagatcatacagaaccttaaaagccataaggaaggactctagtctttctctgaaagacactggggaggtttagaaggatcttaacatgggagcagaagataagactcagcatgaaaaattaatggaagagggctcacaatggaagcaaggacatcagttacaactttagccatgggaaagaaaagtgttctcactgcaagaagaggcattgtagatagaaagcaggggatagtttgagaaaaatataggagattgagttgataagactggttgtgtaatataagggagagggaaaaattaaatatgatgtttggtttatggcttgggaaacttagtggatggtggtaccattcaatgaaaatgggaaaacaagtggagaagtaggtttaaaatgagtagaagtgatgagttcacgtttgaatatgatatgttttatattctacaaaatatctaagttgtgatatcagtagtcaattgaatacacaggtcaagagctttgcataaatctgggctggatacataaatgttgttgggtaacctagctgtttggtcactgaggataatttaataactctttttcatttaataatgttttcatttaaaaaatactacctctaatatttgaccccacccctaaaataaacctagtattctttggttggtggctatttactattccatgggaattataagaagaatacaaactgtttgataataaaaagctatagaatagcaagattaaaatgtagcagatataagaatcttagggatttttgttacattagaaggctaatctttggcaaatatattacagttggggatagttctttgatactcacctgatcaaatacagctctttattccatgggtagatatttaagactggcccaatcccaatcatgtggttgtgacattctccaacatcttcaatatattcatgcttcaatggcactttactgaggagttcaaattcctcaggtgccttttgaagtacctgttctgctgcatagaatccatctactagcagtgtcctgccaccagttccttcatgtttaagacaatgaaacacttgaatgctaaagagagaaaagaaaattcttctgttcagtggaagagagaacatatcaaaattctagaaattatatataaaatgattactgaaactacttgtcattttcttttcatttcctaattggaaatctcatttcttaattgtttttctctcataggcagttgtacttttttgtgttttgaaatattaatgccactagaggtttcttctaaacatatctaacatatattgaagcttatatgtgctgggccctgggaatacaggcatgaataatatataacctatattttcaagaagctcatagtctagtaagaagaactaaagcaaataaataccaaataaaatatgataggtactataataaagttgcatacaagatatagtggggtcataaacaaaggaatgatctgttctagcggggtgttgtataaagaaatgttttggagaagaatgaaaattgttttgactaatcttaaagaatgagcaagaattggagtagaaggagattgagatgaggagaaggcattctaggcggagagaaagcatgaccaaagataccaatgtaaaacaacaaggagtaagaagttcctattggcatagcacagagaaccacaaaatgattttaaactgtgaaactctacggccatatcaatattttaaagagtccattatgttgatagtgtggaacatggactggtgagaagcaacgtgacaaaaaacttggaaaccaacttgaacaactgaaatagtaaagaaaaatattgagagcttgaactcagaaaggggcgttatagagaagaagacacacctgagagataccgagatagaagtagcagaatttgataactgaaggataggcaagaatctagaataactccaggtttctcacttgggcacctgaaaaatgataatgctatttactaagaccgagattacagacagatatgctgttgaatgataatgaggaagtatgagaggttgaggaaggagttcagtttagaggcatgttagaacagctaatcatatacagtttctgaatatgttaacagggaaaggtaaggtgactattaattgactggaaaactaaggtagaattttcaaacttatgagggaaaataaaattaatagtaatttaatcaaatatgcaaaactaagaaaaagtaaaaagcaaattaaaataagaaataaacaaaaatatggagtaaaatcaaggacaatctaatataatataaatacaattaaaaagagaaaggtaagcctggccatattgaaatttctgtgaaacttctaggtcagggttatttagttaccagttaaagatgtttaaggaagagaggtggattttgttacaagtgatagctaaagccaagagcatggaagaggtcgtttggagagatcatttcaagtaagaaaagagggataaggagaaaaccttgaggaagaataatatttaggaaatagacaaaagaagccagcaaaggaggctgaggaaaaatggtcagatatataggaagaaaactaggaaagaaggaatatttaagaaatttagtagtggttaatggtatgtctcagggatcaagtaagatgacagtacacactggatatgacaattagttgctggtgacgttagagagagtaactttaattgcggtgaggggtgggttgggaaaactagatgcctatgggtttgaggagtaaatgggaagtgagaatgaaaatatattgaatgtagctattattcttttaataatcttagccatgaagtggaagaaaaaaacatggctgtagctaaacggagatagagtccaaggaagtacaaaaatagagaattaagatatgggaggctgataagaaggagtcaataggtatggaaaggctgaagatagaggagagagaaatccccaaggaagctggaaaggatgagatccagagcaaagatagctttagagagagtaaagcatataacaatgaagatagtgattaaaatgaataaaatgatgaaaattatagctaatatttattgaacacttagtttgtgtcaggcagtatgatcatataatttaattccttagcaatgctaatggataggttagtttgtgtcaggcaatatgatcatataatttaattccttagcaatgctaatggataggttttatattactagtcccattttacagatgaggaaactgaagtacagagaaattaagttacttgtccaagatcacaaatctaatacatgttgaggctggaatgcaaatctgggtctggttgatgccatagcctgaactcttaagtgctattaccatactgctaatttacttggtccttgccattgattacaaacaattaaactaaagccacaaacagttgtttatctctggtgttggtcataaagggaagagctagtcagtatttgaacctcaacccctgtacagctgcttcttatctcatttcctcttttttccttctgtatccactagaatgaggatgcagggttgttgatctctccatatattgataacatttatcaggatatctaaaagctgctttgttcttccttccctgaatcaaacattcttaagttataaacccttaaaggaaatcagtgtaaccatgagcaattgcatattatcatcctctcatatagtctccataaatctatgtgcactcattttactcatatctttgtgtctcaggctcaccatctaaatgcagaagcaagatcaagaacacggaataaccacagaggtgcctctactgaagagcaaatggtaggaaaattgagtatagtatgtatcatctttggttcaaaagcatcttattccgtgtgaagaagttattcttccatcattcctcctctccaacttcttgtaaatcagattcaaattcttcttaatgccatactcaaagcagctgtgtttgcatgacgacccttttgcaatatgttaataactaaatgcaagaaatctgtacaaattccaaaactaatggttaggcaatacttttttgggggataatttataattactttgaaaaatgtaaaattacattttaataattaacaaaattaggactccatttatatagtaagatgagttttctttttattttattttattttattttattttattatactttaagttttagggtacatgtgcacaatgtgcaggtttgttacatatgtatacatgtgccatgctggtgtgctgcacccactaactcatcatctagcattaggtatatctcccgatgctatccctcccccctccccccaccccacaacagtccccagagtgtgatgttccccttcctgtgtccatgtgttctcattgttcaattcccacctatgagtgagaacatgcggtgtttggtttgttgttcttgtgatagtttgctgagaatgatggtttccagctccatccatgtccctacaaaggacatgaactcatcattttttatggctgcatagtattccatggtgtatatgtgccacattttctttatccagtctatcgttgttggacatttgggttggttccaagtctttgctattgtgaatagtgccacagtaaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttcttcacatcctctccagcacctgttgtttcctgactttttaatgattgccattctaactggtgtgagatggtatctcattgtggttttgatttgcatttctctgatggccagtaatgatgagcattttctcatgtgttttttggctgcataaatgtcttcttttgagaacttaaaaatattttattcctaggagtctgatatagtttggatatttatccccaccaaaatctcatgttgaattgtaatctccagtgctggaggtagggcctggtggaagtgtttagctcatggaggtggataactgatggcttggtgctgtcttcagatagtgagtgagttcctgtgacagctagctgtttaaaagtgtgtggcacctcctccctgactctctctcacttgctcctgtttttgccatgtgaactgtttgctccccgctcaccttccaccatgattggaagctccctgaggcctccccagaagaagatgctgctatgctttctgtatagcctgcagaaccatgagacaattaaatctctcttttttttttttataaattacccagtctcaggtatttatttatagcaatgcaagaatggcctaatacagaatctaaaaactgagttaaggtatttcaaaatgatcatgtttctaggggaagagaaagtcatacaaatctgcaggagcagatatgatcttggttcgaacagaatggaaaataattaagaaaccactcaagactatcacatataaagactttacactgtaaaagtctaatccacctacccacagggctcttgaaaataggtagtgtcagtgtgccgatccagagctagcttggtgtacgcagtgtcacctctggagaagtctgaagtgaaataccacatcctcccataaatggtttctctgttagttgaaataaagaaagacctgttagctatttgaaatgttcattcttgtctttcaaaactccttccaataccttctttagttactcacaaataacagtagatttttttggttccagaatttaatccataaggtgaaaatgacagttgaacatgctagtcttgacaattctgtcacttattaacattctagaaagttggggagaaaactgtggaagtataatattgtattatgaaagcttggagaatcatcccactctgattatgtgcccagttttcatagccttcataaattcaaggttcttttctatgctcacctttctttcacagaaaaagatatagctgcttctggaagtgatttttttattttattttattaattattattatactttaagttttagggtacatgtgcacaatgtgcaggtttgttacatatgtatacatgtgccatgctggtgcgctgcacccactaactcatcatctagcattaggtatatctcccaatgctatccctccccccttccccccaccccacaacagtccccagagtgtgatgttccccttcctgtgtccatgtgttctcattgttcaattcccacctatgagtgagaatatgcggtgtttggttttttgtccttgcgatagtttactgagaatgaggatttccaatttcatccatgtccctacaaaggacatgaactcatcattttttatggctgcatagtattccatggtgtatatgtgccacattttcttaatccagtctatcattgttggacatttgggttggttccaagtctaactttatttactatttttatagctgttgtcttttattagtaccattttttcaataatggtggtcatttcctaatattttggataatccaatttgcaaggatgactgaagagttctcatattatttataagacacagaagtgattaatgtagatcctcactcatcttttggacatggaggaataaagaaaagagaaaaggatagtttgtgttagcaagtatttagtgagacttgctgtaccattgttgttgtgtctctccttgaagtatacatcatatattttgattttgtaattattttcctgttcggctcaaatctgactaaaggtcactttaattctttagctttcaaagttcatcttattttctgaacccttgaagttcaaataggaaatgctcttccttttgaactatcatccctaaaactgtctcaatttatcacttaccagcacagtttctttcacttgaaagttctcaaactgtgattcaaactgaatggctcacagatgctgttgattatgctctaccagcacagggaagaagacccagcatactatctactacaaaatgagctatatctggatcttattaagtaaaaggaaagtactaattataataaagtaggttgacatcacacttaatactatagaagatcaatctatataccacccaaaagtgcgtaatggtaatgaaaaaaacaatgtatttaggattaggaaacctgggctatttgaattcaagttctattgtttactagtagagcactcctgggcaagacacttggtatatttgagtgtcagtgcctcagcagtaaaacggggacaaaacacacactgatcagggttcctataataattaaaagaaaataatgggtgggaatgtgctggctgaatgctatatagccttttaaggcagtgttattaacaatcagtctctgaatcaagccacaggaatcacagaaggtcaaattgaacagatgggaaaatagaggacagtgggggtcgagggggtgtgtgtgtgtgtgtgtgtgtgtaatggacatgcctatggtcacacaactacttgatggtagaactcagactactatccagttctccttacagtcagtgtttttttccagtgtacaataatacctgtcacttgggatcactgggctagaaacatattaccaatgactctgcagtcatcattatattttacacataagtgtatttagagattagaaatccagacctcaaataaagtactgcaagtgagagtcccttattcatgctacaaaatattctggattgaaaacgagggtgaccatacctgttacatttatttattggtgttcatgctctggaaattaattataatactgtggattttaggaaacaaatgaattacctgattaagctgatcctttctgccaacttctctgtgtgctcttgagtgggagggacattttctacgaatgcaattccatagagcagaaagttttgcagaaacttcttcagtccctcgttggtttctaagaagctctggcaatctaccgatggaacttgggcttgctggtagatttcagcattccatagtattctaggctggatgactttttgtttctgcccttcatagctgtttttcaccagccaattcaaatcatatttagtcacatgaccatctggcccttttaaggggaaaaataaaaggcactataataattacaaataatgtcaatatttgtaattggttacaactagttaagaatctttttcctagcaatcagttatccagtactgtattgtttatgaaaccaaattaaaatgaatgcctagaatgtttctgagaaagaaatatgtgtggtttgagtggtatgcatgaataaatgaatgaacaaataaatcttcccagaggctaaataagtttacagaattatagttatatagtaaaagatcttctggaaaattcatcaagtcatcaaagaatgataatccaagtaggcttttacaagcctacttggcactctctccccttgcccccatccctgtcttccatctatataggaactcagaatgtttgagctagaaggggctaatctttattttacagatggagaaaaagtcagtgactcactcaagatcacacaactaagtactataggtggaactagaaccccaccttcttgctgctacaagttcagtactattcaatgctgccttcctcttctacatgatgtaggacattgctgtctaattatatgacatcaacacaatacaataaaattactttgtaagtggcttcacctgctgtgcacaccccacccaaaaaaagttgaaaaccaaccctgaaatgctttagaaaatcttcaggataagcaaaggaagcagcagaaggagtgaaagactatgttgacaacttgtctctcctttttacttctctctcttttcctccctccccttggtaaaaaagtatcacactttggataatttggaaagcataaaaaagtatgaggaaattaaaagtcaccatgtttatcattctatcacccagatgaaactatgattgacagcctggcatcattccttccagtttttctgtacattctcttattttatgtaatttatgtatataaatatagtttatgtaatttatatatataaaatttgggactctgccattgtcacttaacattttaacaatttttaaaattaaattttatcattttaaaaattcaaccttcattaaaattaatttttaaagcttacaaaatatacattaccaagatttacctaacccatctgttattctgggtatgtacatttatttttaaaaaatttcctattatttattagtgatcatctttaaccatatttctataatttagaaatagaatgtatattacatttcttaaaagttcgtatctttgtatttagaaatttcaaagatataaacttttaagagttctgatatacataatcaaattactttttagaaagtctacttatcttcattccctccaacagtacatatgtgtccatcaaaatggagtattcttatttttaaaatatatttttttctaatttggtaactaaagtggaactgctatcttgtaataattttaacttatttgcttactaaggctaataagaatactttctatatttgttagacatctatgtttctttaatgcagggactaccaaactatggttgatgagtcaaatctggtgcttggttttgtaatgcctgtttcagaacacatgctgtccatgttgttacatattgtctatagctccattcactcatatagcccacaaagtttgaaaatatttaccatctggctctttatagaaaatgtttgctgactcctgctttaatgatttgtctgttcagtcctttctcacatttttctattggaacaattgtacttttcttcttttttttttttttttattatactctaagttttagggtacatgtgcacattgtgcaggttagttacctatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagccctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtcctttgcccactttttgatggggttgtttgtttttttcttgtaaatttgttggagttcattgtagattctggatattagccctttgtcagatgagtaggttgcgaaaattttctcccatgttgtaggttgcctgttcactctgatggtagtttcttttgctgtgcagaagctctttagttgaattagatcccatttgtcaattttggctttggttgccattgcttttggtgttttggacatgaagtccttgcccatgcctatgtcctgaatggtaatgcctaggttttcttctagggtttttatggttttaggtctaacatttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcggtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgctcatggtggaaaagctttttgatgtgctgctggattcggtttgccagtattttattgaggatttttgcatcaatgttcatcaaggatattggtctaaaattctcttttttggttgtgtctctgcccggctttggtatcaggatgatgctggcttcataaaatgagttagggaggactccctctttttctattgattggaatagtttcagaaggaatggtaccagttcctccttgtacctctggtagaattctgctgtgaatccatctggtcctggactcttttcggttggtaagctattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggattggtggtgatatcccctttatcattttttattgtgtctatttgattcttctctctttttttctttattagtcttgctagcggtctatcaattttgttgatcttttcaaaaaaccagctcctggattcattgattttttgaagggttttttgtgtctctatttccttgagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtgatgtctttgttctcgttggtttcaaagaacatctttatttctgccttcatttcgttatgtacccagtagtcattcaggagcaggttgttcagtttccatgtagttgagcggctttgagtgagattcttaatcctgcgttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatgtaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgttgagcacttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgacagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctggttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtacaccggagctgttcctattcggccatcttggctcctccccccaacaattgtacttttcttacaatttagcaaaagcaccttacatattaaggatatttagtcttcggcatacattttgctaatattttgcctgtttttaaataaacctttctatggcattttttttctattgtagagaaattagtagtcaatgtatgcatcataagcatgttttttcctccaatgctttttcttttaacttttttatttggagataatagattcacaggatgttgaaaagaaatgtgtaggaaagtcccatgagctcttccccttccttgatgttaacttgttatataaccacactacaatacccaaaccaagaaagtggtattggtacaatccattgggcttattcagatttaaccagttaaacatatattcatttgtgtgcatagctctatgcagtgtaattacatgtgtaactttgtgtaaccaccaccaaaatcaagatactcaaccatatgactccttcgtgttacccttttacagctacatccgccacctcctacccccgaatccctaactcctggacaccaataatctgttctctacctctataattatgttatttcatgactgttacaaacatgaaatcatgcagattggctttttcacttcagcataatgtaattgaggttcttccaagttatgtatcgaactagttccaataaagttgctgagtaggattttattgtatggatggtttgtttaaccattaacccattgggtagtttccaattcttggctattacaaataaggctgatgtgaacattaatgtacagggttttatgtgaacataagttttcatttcttcgggataaatgcccagaagtgtgatttctgggttgcatgtttagttttttttttttaagaaattaccaaactgttttccagagtgtaccattttacattcccataagcaatgtatgagtgatagaatttctctgcatcttctctagtatttggtgtagtcactgttttttaatgtagtcattctgataggtatgtagtgcaatctcattgtgatactaactttcatttctgtaacagctaataatgttgaacatcttttcatgtgtttattcgccatctgtatatcctattcaggaaaatgtctgagcatatcttttatccatttttaaattgtattgcttgtttttctgctgagttttaagagttatttagtcctagcgccagtcaggaccttaagatgttctcatatgttcttttcttgaagttttatagttttatgttttacgtttaagtccgcaatctactatgattttttttttatataaggtgtgagacttgagttgaggttcttttattttttcattatggatgtccaattgctctggtaccaattactgaaaagattatccttcctctattgaatgacttttgcacttttgccaaagataagttgactatatttctgtggatctatttctgggttctctattctattccattgatctatgtatctgtccctccaccaataccacattgtcttgattactgcagtctggaagtgatttcttcccacttaattcttcattttcaaaattgttttgcctctcctagggcctgtatatttccatttaaattttagagcaagcttgtttataattataaaaaaaatcttgcttatattttgacaggaattgcattaaaactatagatcaatttggagaaaactgacatcattactatgttgagtcttccaatccatgaacatgatttgtttctccatgtatttatgtcttctttgatttctttcatcagcatttaataatttttatcatacagatcctatacatattttgttagattatacctaaatatttaaatttatttgaagctatttttgaaatggtcatttttcatttcagtttctgcatgtttaagtatatagaaatatgattgatttttgtgtgttgatcttgtgtcctctgaccttactgaactcatttattagttttcacggttttattatagattacttgaggtagtctatgttaggatgtcatgtatctgcaaataaagagttttatgtatgaattttattaatttttcttgacttactataatagaattttcagtactatgataaataagagtggtgagagtggatgttaaataatagtggtaagaatgggcatccttgccatgttccctgtcttagagggaaagcattaagtctcactattaagtataatgttagctgtggattgtaacaattttatttgaagagaaaaataaaatgtttcaaaaaatccttccaaaacaagaaaaaaagaaaagtaagtaataacctatttttgaaaggaacaaaccattttccacaaaataactgtccttcagaagagtacccccaaagaagatcaagtctcctgtccactcacaagtgaaaaagagtgtggtctcatccagacgaatggtctttggcttgatacataaatccacactggcagtatccaggctgcgctggtgagtcttagagttgtagcacgatgctgagcggcagtggtctcgaagccagacgtaatcaaagcgcatcacggtattagcatatttcagctctagggaaaagatcacatttatcagaactatttattgagataactttaaaaaatcagcatccagaaaacttccttctaaaagtcttctaccaataagcaataagggttgaggggagggacttgccccttaccagatattaaaatatactgtagaacttctataattaaaatggtgtaatgttgtatttaaatagataaaatgatggaagagtataaaaagcccagaaatatacccaaatgcatatggaaatctggtatgtaataaagtgacagcaaaagtcattgaggaaaaaatgaattttttaaataaatggtgttgggacaactgatagaacttgggaaaagataaatttgtgtctgtatgtcatgttgtcacaaggttatcaagataaactcaaaatatataggagtactaaatttagaaaatgaaaccattcaaggatcaaaagaaggaagcataggtgcgtagaggatatatatatgaggtgatatggtttggctctgtgtccccacccaaatctcatgttgaattgtaatccccagtgttgggggagggacctggtgggaggtgattggatcatgggggcaaatttcccccttgctgttctcctgaatgtgacggagctctcacgagatctggttgctttaaagtgtgtacacttctgccttcactttctcctgctttgccatggtaaggtgtgcttgcttcccctcaccttccaccatgattgtaagtttcctgaggcctcccagccatgcttactgtacagcctgcagaactgtgagtcaattaaacctcttttcttcataaagtacccagtttcaggttgttctttatagccatgtgagaacaaacaaacacagaaaattgttaccagagaagtggggcattgctataaagatacctgaaaatgtcgaagcaactttggaactgggtaacaggcagggattggaacagtttggagggctcagaagaagacagaaaggcgagggaaatttaggaacttcctagagacttcttgaatagttttgaccaaaatgctgatagcgatgcaaactgtgaagtccatactgaggtggtctcagatagagatgaggaacttattgggaactggagtaatggtcactcttgctatgctttatcagagactggcagcattgtgcccctgctctagggatttatggaactttcaacttcagagagatgatttagggtatctggcagaagaaatgtctaagtagcaaagtgttcaagatgtggcctggctgcttctaacagtgtatgctcatatgcatttgcaaagagatggtatgaaattggaacttatatttaaaagggaaacagtatgaaaggttgtaaaatgtgcagtgaaaccatgtggtggaaaacaaaccattttctgggaggaattcaaggctgcagaaatttccataagcaaagagaagccaaatgttaatatccaagacaatgggggggaaatgtctccagggcatgtcagagacctttgcaggagcccatcccattacaggccctgaggccaagagggaaaaaagagttttgtgggccaggcccagggccctactgctctgtgcagccttgggacatggcccccatgtcctttggctctgtgtctcagcagctccagctctagccatggctaaaagggaccaaagaacagcttgggccattgcttcagaggatgcaggccccaagtggtggcttccatgtgttgttgggcctatgggtgcccagaaggcaggagttgaggcttgggaacctccgcctagatttcacaggatggctggaaatgcctggatatccaggcagaagtctattgcaggggcagagccctcatgaagaacctctactagggcagtgtggaggagaaatgtggggttggaagccccacacagagtccccactagggcactgcctagtggaactatgagaagagggccaccatcctccagaccccagaatggtagatccaccaacaacttgcactgtgcacctggaaaagccacagccactcaatgccagcctgtgaaagcacccccagggctgtatcctgcaaagccacaggggcagagctgcccaaggccgtgggaacccaccccttgaatcagcataccctggatgtgagacatggaatcaaaggagattattttggagctttaagatttaacgactgccctgttgggttttgaacttgcatggggcctgtagccccttggctttggccaatttctcccatttggaatgggagcatttaccgaatgcctgtacccccattgtatcttggaagtaacaaacttgtttttgattttacaagctcataggtggaagagacttgccttgtctcagatgagactttggacttgaacttctgagttagtgctggagtgagttaagactttaggagaccgttggaaggcgtgattggttttgaaatgtgaaaagacatgagatttgggaggggctaggagtggaatgatggaatgatatggtttgtctctgtgtccccacccaaatctcatgttgaattgtaatccccaatgttgggggagggacctggtgggaggtgattggatcatgggggcaaattccccccttgctgctctaatgatagtgagttctcatgagatctggttgtttaaaagtgtgtagcacttccccctttgctgtctctctctccttctccaccatggtaagacatgcttgcttgccctttaccttctaccaagattgtaagtttcctgaggcctcctagccatgcttcctgtacagcctatggaactgtgagtcaattaaacttcttttcttcataaattaaccattctctgggagttctttatggcagtgtgagaacaggctaatacaggaggtccttgtactattttagcaactaaccttctgttaatttgaagttatagcaaaataaaaaaattacaaaaaaaacaaagactttctatacatcaggttactcatttagaaaaggtaaataaagtgtgtgacccaatttacaaaagaaaagaaaaaaataagttatgccttcatataattcaaaaaaaataaatttctgatggattaaagtacaaaaaattaaaactgtaaaacattaaatgttgacaaccttgaggtaggaaaggctgttttaatatgacacaaaaggcacagagataaattaatctatattaaaataaataccttctgttctgcaaacaatataaaagcaaagttaaaagagaagtaacaggaaaaatatttgtagcataaaaggattaatatccagcatacagaataaacctctgtgatcattaaagataaaaacccaacagaaaaataggtgaaggatatcaataaggaaagtcaccagaagtgacgggcaaacgtatgaactgcccccagccttggtaataatcaaagaaatgggtatttaaaccaaaatgtgataccattttatacccatcagagcaataaaaattttaaaggctgattaaaatgtgttttaaaggatgtggggaaaaatgcatacttgcaaacattggtagtaggagtatatattgttaaagttatactagatggcaatcagcaagtttctatgaaaataatttaaaatgtgcatatttgacctagatattcacctctcagtatttatttttttctcttgtactttatttatttattttatcttttaatatttttttttatgtcagtagcttctggggctcaagtggtttttggttacatggatgaattgtatattggtgaagtcagagatttcagtgcacccatcacccgagtagtgtacactgaaactgatatgtagttttttattctttatccccctccttccctctccccttctgagtctccagtgtccattataccactctgtatgcctttgcataacatagcttagctcccacttgtaagtaagaacatacagtatttggtttttcattcctgagttacttcacttagaataatggccttcagctccatccaagttgctgcaaaatacattatttcattcttttttatggctgagtagtattccatggtgtatatatacattttctttatccacttattggttgatgggtactgagattggttccatatctttgccattgtaaattgtgctgtgatgaacatacacaaacaggtgtctttttgatataatgacttcttttcctttggacaaatagtagtgcacctctcagtatttatcgtatagaaagtgtcacacatgtggagctgcatataaggttattcataatagtgatggttataatagtaaaaataattagaaaaaagactaaatgtctatcagtggggaagtggaagaatcgctgaataaactgtggtttatccacattttaagatattaagcaatagtttttaaaaactgctatacctgtacctctcacattcactttcattggtattatcattctcattttaaggacaactaactaaagctcagagatgctaagtaactttgtaagaatataatcattaggtggtagagctaagacatgaacccaagtcatgcaaccccacagcctagtacactaatgtgtctcaaagtacagccttgggaatctggaggtgatacttcttttagaaaaacacagagaggagcttggcaaattttctcccccaaaagtattgataaaactggccaaactaaaaaagaaccattttaagactctggaaattgtccaaaggtatacagcaaattgagaagtatttattatatttttaatttctttagtaaccttcatactgttttccataattggtacaccaatctacattcccaccaacagtgtacaagagttcctttttctccacacccttgccaacacttgttatctcttgtctttttgataataggtattctaatgggtgtcaggtggtatatcagagtagttttgatttgtatttctcttataattagtgatgttgagcatcttttcatatacgtgttggtcatttgtatgtcttctttggggaaatgtctattcagatccattgaccattttttaattgggttatatgttttgttgctattgagttgtatgaattctttataaattttggatatgaaccccttatcacaaatacagtttgcaaatatttttcctaatctctaggatatcttttcattttgttgactgtttcctttgctgtgcataacctggttagtttgatgttgtctcatttatttattttggtttttgtatcctaagcagttggtgtgatatccaaaaaaatcattgccaaggccaatgtcaaggagctttaccacctgttttcttctaggagttttatggtttcaggtcttattcttgtttaagtcttttatccattttgagctgatttgtgtgtaggatgacaaaggtccaatttcattcttttaccttctgagtatatgcccaaaggaaatgaaagtactacctcataaagatacctgcacttccatgttcattgcagcattattcatgaaagccaagatatggaaagaacctaaatgtctgttgatggacgaatgtataaaaaactgtggtatatatagacaatggaatattattcagccttttaaaaaggagatcttgccatttgccataatatggatgaacctggaggacattatgctaagtgaaataaaccagatacagaaaaaaaatttgcatgatctcatttgtatccggaatcttaaaaaaaaagtcaaataaatatacagagagaataaaacagtggttaccagggccaagggtaggggcatgaggctaaggacacaaagtagcagatatgtagaatgatcagatctagatgtctgttatataacaacatgaagactatagtttataatagtgcattatgttttggatttttgctaaatgagtcaatggtagctgttcttgccacaaaaaaatgggtaactatgtgagatgattgatatgttaatttgcttcactatagtaaccattatactgtctatatgtatctcataatatcatgtcatatactttaaacatacacaatgcaatttcttttaaaaaggaagcatttatttacaaaaaaactactgaaccttgggtaaaaacagtgggaatctgtggtgtattttagcatggggtgctcccactcctattcctccacctctagctccaatcagcagtagttccacgaaggtgggctaaaccaagaaaaccggcagctttgctgtcaaatatgactaacttgatttggagcagagcatgcataaaacccccatgcatctgggtgttatcaaaaacaattagggaagccatactggttggagcaaacaacagaccagaagaacaggcagaaatctaaccaggctatatagggagtgagaaagctataatgggccttgaaaagctcccacacatccctagtatttggaaggttgcacatgcatgcagtgctgtatgcacactgaagagagactggaaatggctccagttatttacatgtctctggatgaaaatgaggctttttgtaggagacatgagaatgacagaaagtaaaaaccaggacaaacttctatggttagtctgtttgcatcattatagagaaatacctggggctaggtaacttgtaaagaaaagagatttatttggctcatggttctgcaggttgtacagaaagcatagtgctggcatctgcttctggtgagggcctcaggaagcttataatcatggcagaaggtgaaggggagctaacatgacacatagtgagagagagagcaagagagagtgaagaagtgccaggctcttttaaacaactggatcttgtctgaattcattactgaggggcaggcaccaagccattcatgagggatttgccctcatgacccaaatacctcccatcaggccccatttctaacattgcagatcacatttcaacatgagatttggaggagacaaacatccaaaccatatcacttgtaaatagctcaaacttcaagtgtatgcctcaaacaacacacagatcctctggcaaagggtggaagccttattacattaagttttttaagcataacctctgatcaatacttggctggcctctaaactatatcaggaattcccaacctgatgcctcaactaggcctatggacatctgggccagatagtccttttgtcatagggacaggtgtcagcagcatcttcctctccagttgtgacgacaaaaaatgtctccagacaatgccaaaggtcctctggggggcaaaatagaccccaattgagagcctctgggctatggtgaccccagtgcaatgcttaggaaaccacagttaaaaataaaaacaagaagtaaaaataaaacctgagcagagacatcagtggctacacactgcagggcacaaagactccacagaattaccccagacaacaaaaaaatacacaaaacaaacaaatacacaaaatacaaacaaatacacaaaaatatgcaacaattcctctggggacatgagaactcagtttccataaaatattatctaaaatgtccagattttcaacaacaagaaaagatcatgagatatgtatagaaacagaagggttacctacacacagaaaaaaagcaggcatcagaaaccctctgagaatattacagaaaatcctattgcctaagtcaaacatgcagatagaaggcaacttacgtcctgcagaaaatgtctttcccttctaatagtcttgagctttacaggagagaagcagaatggactattggggcatcacctccatgtacctatattatttcctcattataagccaacacttggtctttactgagtcattttgtctgtgacagcaggcatgccttatacaagtgctttcaaggtataccccaactggatgcttgaaaatgtatagatactgaacttaattgaaagactgtctgatacaactgctgatactctgaaatagggctattcatttggtggtgccctacagttggagttcttgtcctagggtgtgtggaataatatgcaaaattcgtgtgtgtgtgtgtgtgtgtgtgtgtgtgtgtgtgtgtgtgtgtagaatttctatggggtctataacctaaaaatattgagaaccctttccctagagtgacaaaagtgtttgagtaccactaacccttattcagtttggtcattgcagtgagatgatgcacagttcaacaaactacagcttgtgggtcaaatatagtatgtgacctattttgtttggcttgcaagataaaaaatggtttttacacttttaaagtgtaataaaacaaaaacaaaacaaagaaaatcactgtaatggttaactctatatgtcaatttgactggaccatggggtgcccagataagtggctaaacattaattctgtgagagtgtttctggaggaaattagcatttaaatcaatagactgagtagagtacattgccttctgcaatgcgggaataattctatctgcctgcttgaactgggatattggtcttttcctgttcttggactgaaacttacatatcagccttccattttaggcctttgaacttcgactagaacttagaaaggttctcctggttcttaggccttcagactaaactggaatcatatcaccaggtttcctgggtctcaagcttatggatggaagactggtactttttagtttccataattgtgtgagctgattcctttacacacacacatacacatgcacacacacgtgcacacgcacacacacacacacacacatatatatccccctattggttctgttctgtttctctggagaacactgactaatatagatattggtactgagaagtagggtactgctgtaacaaatacctaaaattgtggaagcagctttggaaatgggtaatggggtagaggctgaaagagttttcaggtacatgctagaaaaaagcctagattactgtgaagggattgctaatggtgtttctggtaagaggtcagaaaaaaaaagaggacagctagagggaaagcctccatgttcctagagaatataaataattgtaaacagaatgctggtagaaatgtgaatggtaaaggccattctgatgaggtctcagatggaaaagaggaacatgctactggacaaaggaaaaaaaagtgacactttttataaagtggcaaaaaacttagctgcaaagtgatgagagagcagttggttccttctgactgcttacagtaaaatgcgagaagagataaatgaattgaagaaggaactgttaaacaaaaaggaaccaggacttaaaagatttagaaaattctcagcttatccatattgcaaagaatgagaaagtatgtttgaaagagaatactaagggtgtggctgatccacatttgataaggagataagtgtgtgcatgaaccatggtcctagtcagccatctcaacagaagccataaacagagatgggattataccagcagaaaaactgccagctgggaccaaaaagaacagagaaaatgggacaaaattgaaagagttgtgcatgtgctatttattcctcaaaaaaagggaagagtgaggctaaaggcaatttagagatcatcggggctgccactcccaccacaggcccaaggggcagggctagttcttcctcaggctagagtgcagtggtgcgatctcggcttactgcagcctctgcctcctgggttcaagcgattctcctgccttcgtctccctggtagctgggactataggtgcccgccaccatgcccagctaatttttgtatttttagtagaaacaaggttttgctgtgttggtcaggctggtcttgaactcctgacctcaagtgatctgcctgccttagccttccaaagtgctggtattacagacatgagccacctggcacccggccttatttctctctttttggaatgggactgtctctattgtacctgtcccaccttcctattttggaagcacatacttatctggtttcacaggagaagaaattttgcctcaggataaattgtacctcaagtctcacccatatcaaatttaggtgagatttagttgagactttggaattttcatctttagagtggatgctggaatgagttaagacggggttgttgggatggaaggtatgtattttatgtgagaagaatatgaatttggggaatctatgggtggaatgtaatagactgaattgagtctcccctaagtccatatgttaaagctctaatccccaatgtgatggtatctggagatggagactttgggagataattaggccatgaaggtagattcctcatgatggtattagtgctcttataacaagggacaggagatggagccctttatctctccaccatgtgaagatacagcaagaaggcagagggcagccttctgcaagccaggaagagagtcctcaccagaacttgactatgctggtgccctgatgttggattttgtagcctccagaactgtgagaaataaatgtctgttgtttaagccacctgggctatggtcttttgttaaagcagcctgagccaactaagacaaccatgggacagagattgtacatggcccaaaaaaagcctaaaatatttactgtctggctgtgttagtcagttcaggctgctataacaaaattataatagactgggtagcttaaacaacagatatttatttctcactgtctggaagctaggaagtctaagatgagggttccaggccatttgattcctggtgaggacactcttcttgctgtgcagatggctaccttgttgctatatcctcaaatgatagagatagaatgtgctctctcttataatggcactaattccatcatgaggactccaccctaataatctaattagctctcaaaggttccatcttcaagtaccatcacattgggagttaggcttcaacatatgaatttggagaaaacacattcagtccatagcactggccctttacagataaaagtctgctgacctctgagataatctgtagcagaaactctttttttcatcctctccttcacttctagtgagttggcaagagtagctaatactaccaccttaatagcatttgaaacctaactaacccctgtctccatttaagctccacacatcagtcagaatactctttccaatgaaatttagcttagaatcccttaagtagtttcccattacaataaagaccaatctcctcaagattgcctacaagggtctgcacaatgtggccccggctaacctctgtagcatcttttgtcaacccttccttgcacttgatgtagcagtccatataggccaatatgacatattctctgtagcctaactcttgtacatatagtttgctctaactgaaacattcttcttcactgcctcaaccctcttcccctgcctagttcatattcaatactcatgactcagcaggcagtcattcataactctccaggttggattaagtacctttcctctttgttcttacagcaccctatgtatttcctaaaagaatttctcatcttgtcttatgcttgtttatcattgccacaagactgtgagtatcttgaggatagggaatgtgtcttcttcctctctgcatgctttgcacttaggacaatgcctgaatcctggtaggtattcattaaatgtttgttgaataaatcaatggtaaatcaagcagtggtgcagctgccttactggtaactccaatacaggccacatatctacaaatgatcttctcctgctctactagatagctagtaatcctgactatatgctatattccattttcaggttaagagttgctagttatataagcagtgtagtagtggaataaactactgtgtggctagacttgccttttagtaggcttcaatatatcccctcattttagttaagttggtatgcttactgtccttttgctgactggaatccattcttgccttttcacttgtaacttttctccttgaaatcacaggagaaattaattaaaggactttctgattaaatgaccaccttctccttcaaaatatagctaaaaattcatttattcaaggcagcttctttgaataatgtatttcctctttgaaattaaatatttgataggtatcaactcaatttacatttgtgtctggcataagctaattatgcttcttatatttatttacttattttattcatttcagggactctacatcttacattgagaaagggaatcttccatctttggttctctaacagttcttagctcagttaataaaattaacactcagcaaatgcttattaattagatcttatcaaaattttaatacagaaaagaaatttgaaactcaccttgattcatctcttttataacccacatttaatcaatcaccaaggtctgttgattccacttcctaaatctttctgaaatccatataacctctccatttacactcctttctcctgccacattcaggtattcatcatctatagacactgggacactataaaaggattttaaaaatcaaggcagtaaaatcagattggagtttagaaagagcactctagtttcaggatggataatggatcatcaggagagcaagacaaggctgcagtaatcctgttaggatagttacctcctcgcttctcaatgttgtttttggaccactttttctccctccttcctctaaaacccaagcttctttgaagatcatgctttcttaattattctaatcaagtacctcttgagtcactctccatttttaatgaagaccagtttactgttgtccactttatcctttccctgtcatccttggcaacttcatcatcattaatgacagtactctcaaaattttcatttaaaacattccatactctagccacctcttattaccattccagttcaattattctggcactcctcaccccgataatccttcaaccccataaagagctccaattcattgaccctaagctccttttcactctctgtcatcttgtttcctttaatgtcctcacttacctccttaatgtcctcacttccctccttacagagcccatattccatggtccatcattttaatcaattccctgcaaacattcttaacttccttgtcccctctctctgtgccatacttctctgacaaagccccaaccatggtaaactcaagttcctacctcctgtgcagccaagcagctgaaaattgctggagaaaaatttttcttttatgttttatttttttaattgacaaatactgtgttttgttatcttgtaaacatgatgttttgaagtatatatacattttggaatggctaaacctaaccaattaataaatggattacttcacatagttattatttttgtggtgctagtatgtaacgtcaactctgtttttcaagaatacaatatcatcattaactatagtcattttgctgtatgatagatctcttgaaatgtattcctcctatctaactctaattatgtatcctctgaccaacatgtctccatcttccctcccctcaatcaccctagcctctgataactaccattatactcacttctatgagatcaaattttttagattccacgtatgagtgagataatgcagtatttgtcttcctatgcctggcttatttcctttaacataaattcctccaggttcattcacgttgctgcaaatgacaggatctgactctttttatggctgagtagtattacattgtgtatgtatacctcacttttttcatccactcatccattgatggacgcttatgatggagaaaattttaaaaactgcactggctagtatcattttaaactcatcatgaaaaatctcaaattagtactcaatatagccaaataattcttgcataatttcctagtaaaatcactcactctctaagaagactgtgtcataccatctccccatcctcaaactgccaacacctcctcacccttcacactttcaactgatgaccttgcttcttccttcaaagaaaatgtagaagcaataagagaatcttcacaaactgatgccccatatccaatcacttacctgcatctgtgcccatatattccacctttctttctgttacaatcgttgaaatatctgtgcatctaatcaaggtcaatacttccatttatgaactagattctatctctttttcatactcagagactatgctcctgaagcagttctattcctctcttttgcatcaccaaattttccttccctattggatcatcctcattagcaaacatgtaatatctcccatattaaaataatattccaggagtgccatcagcaagatggcagaatagaaaaaaaagaccctccttcccccatggtttgaataacaatttatggaacaattgcctttatgacaaattcagaaatgagttaaaaggttgctgcaccccaggcaagtgcaaagccaacctcaccaaaacccagtaggaaaattcatggcatttcttcaccagagactcttctcccagcttggtgcattgtaactgagaggaaacccctacctcctgacttatcctaggggggaaaagaagttgaatgtccaacattctaacttttcagggtgttatctaaaagattggtttctgtcttgcctgaatctaagaactgacagcaatgggatgccaggttgggggcctgctgagaacaaaggtgatcaatgtggcttggcctggcaccagagtctgtagaccacagacagacattatgtggagctccaataccctagtttactacagaaacagagagatggcagtatcacagacagacatcaaggggaactcctgaatagaaactgataaatctcttcaactagatgattatatgcacaatcccagaagagtatgccttcccaggaaaggattaggaggtctctggattctttaactgggctaattggagaatgtcctccttgtatgcaaccagaccacaaagactgagaaaggtagctgagctttcaaatgttaaagtctcaacaagatatagtaagacatacgaagaaacaaagaaatgtggactattcaaaggaataatttaaacctccagaaagcacccctacagacatagagaaatataaattaccaaaaactcaaaataagcatcaccagaataattaaagaattaaacaagaacatagataggcaactaaacaaaattaggaaactgacatataaacaaaataagaatatcaacaaataaataaaagtataaagaagaatcaaacagaaattctggaactgaagtatctaataatcgaattggagaaattcactggagggattcgatagcagaattgaccaggcagaaaaaagaattagtaaactcatcgatagggctttgaaattattgagaaagagaagaaaaaaacaacaaagaatgaagaaaaatgaggagagcctaagggatttatggggcaccaacaagcagaacaacatacgcatgatgcaaatcacaaaaggggaaaagagaaatgagtagagagcttatctgaagaaatgatggctgaaaactctccaaatttgatgagagaaaaggacacacaatttgaataaacaaacaactccagttggaataaatctaaagagacctacactgagacccatcaaaatccaactgtcaaaagtcacaaagacagaatcttgaaagtggcaagaaaaaatgactcatcacatataagggagcttctattaaactatcagctggtttctcagcaaaaccttgcaggctagaaaggagtgaaataatatattcaattactgaagaacaaaacctgcccaccaagaacattatattttgtaaaactgtccttctaaaatgaaggagagattaagacttcccagataaacaaaaggagaggaagttgatcaccactcaatctgccccacaagaaatgctaaagggatccttcaagttgaagaaaaaggatgataaatagcaacacaaaaccatatgaaaatataaaccttctgataaaggtttattgtgtagaattgtaatataagtgtgtaaatcacttttaaatatggtataaattttaaaaacaaaagtaacaaataattatagatctatgttaatggatgcacattataaggaaaggatgcccaccctcaatattactattgttgaagtactgggattcctagctagaaaaattagacaagaaagagaagtaacagaaatctaaattggaaaagatgaagtaaaattgtctgtattcacagatgacatgatcttatatgtagaaaaccctaaatattccatatgcaataaaaagtattataactaataaatgatgtcagaaaatttgcaggatacaaaagcaatacataaaatgcattgcatttctatatattaatggtgaccgatctaagaagaaaaattaagaaaaaattccctttatttattttattttattttttattatactttaagttctggggtacatgtgcagaacatgcaggtttgttacataagtatacatgagccatggtggtttgctgcacccatcaacctgtcatctacattaggtatttctcctaatgctatccctcccctagaccccactccctgacaggccccagtgtgtgatgttcccttccctgtgtccatgtgtcctcattgttcaactcccacttatgagtgagaacatgcgatgtttggttttctattcttgtgttagtttgctgagaatgatggtctccagtgtcatccatgtccctgcaaaggacatgaactcatccttttttatggctctatagtattccatggtgtatatgtgccacaatttctttatccagtttcacactgatgggcatttgggttgtttccaagtctttgttattgtgaacagtgctgcaataaacatatgtgtgcatatgtctttatagtagaatgatttataatcctctgggtatatacccagtaatgagattgctgagtcaaatggtaattccagttctagatccttgaagaatctccacactgtcttccacaatggttgaactaatttacactcccaccaacactgtaaaagcgttcctatttctccacatcctctccagcatctgttgtttcctgactttttaatgattgccaatctaactgatgtgagatgatatctcattatggttttgatttgcatttttctgatgaccagtgatgatgagcttttttcatatgtttgttggctgcataaatgtctgcttttgagaagtgtctgttcatatcctttgcccactttttgatggggttgttttttttttcatgtaaatttgtctaagttctttgtagattctgaatattagccctttgtcagatggatagattgcaaaaattttctcccattctgtaggttgcctgttcactctgatggtagtttcttttgctgtggagaagctctttagtttaatcagatcccatttgtctattttggcttttgttgccattgcttttggtgctttagtcatgaagtctttgcccaagcctatgtcctgaatggtattgcctaggttttcttctagggtttttatggttttaggtcttatgtttaagtctttaatccatcttgagttaatttttgtgtaaggtataaggaagggatccagtttcagccttctgcatatggcatcaaaaaggatgaaatacttaggaataaacttaaccaagttagtgaaacacttctacagtgaaaactacaaaatgttgctaagataaatcaaagaaaggtacaaataaatgaaaaggcatctcctgcttatggattggaaggcttaatgttgttaaaatgtccatactacccaaagtgatctacagattaaatgcaatgcctatcaaaactccaatggaatttgttgtagaaacagaaaaaaaccttcctaaaagtcatacggaatctcaagggaccctgaatagtcaaaataatcttgaaaaatgagaccaaaattggaggcctcgcacttcccaatttcaaaacatgcaacaaagcaacagtaatcaaaatagtattgatgtatgaaaaagtctttatctctcacttttgaaggatcattttgctggatatataattctacattggtagttgtcccccctttaacactttaaggttgtcattccattgtgttcttgcttgcacagttcctgatgagaagtccactgcaattcttatctttgtttctctgtaggtaaggtgtttttctccccactaggctgccttcaagaatatctctttgtctttggttttctgcagttttaatataatatgcccatgtgtgaggtcctgcttgtttattttaaggggtgtgtgtgtgtgtgtgtgtttatttataatgcatttgttaatgtgtctatttttatgccagtatcatattgttttgattactattgctttgtaatatattttgatatcaggtagtatgatgcctccagctttgttctttttgctcaagattgctttagccattcagggtcttaagttgaaaacttttcctttcagatcaggaacaagacaatgatgttcactcttcctactcttactccacatagtactggaagtcgtagccagagtaattaggcaagaaaaagaaataaaagacatgcaaataggaaagaaagagatgaaattgtctctgttcactgatgaaataatcttatatatagaaaaccctaaagagactaccaaaaaactgttagacttaatgaattcagtaaaatcaacatacaaaaatcattaatgcttctaaaccctaacaatgaactaactgaaaaagaaatcaagaaaacaatgctatttgtaatagttgcaaaaaaatacttaggaataaatttaaccaaggagattaataatctctacactcaaaactataaaacattgattaaataaattggagaacacacaaataaatgaaaaaaattccatcttcgtggattggaagaattaatattgttaaaatatctatactattcaaagtgatctacagattcaatgcagctcctgtcaaaatttcaattacatttttcacagaaatagaaaaaatcctaaaattctgactgataatttcaacacctgtgtcatatgtaagtctggttctgatcttgctttgtctcttcaaattgtgttatttcttgccttagcaagttttgtaatgttgttattgttaaaagccagacatcttgtatagagcaatagctactgaggtaaataggattttaccatgaatatttatattaatctggcctggagttaggttgtgtttgatgtttgttgtctctgtgggtaccagaagcattaaatttctctagtgattttgcttttgtcttctctcttggccttggcccttccctttgtgctgtacctcagagacaggctgtctcttgcagctcttccagctgtaatccactgtcattttaactggaggcttattagcttgttgtaggatgtggggggatgagggcattctacaatcttcagattctcagtctttggagtgcatagtgggcctgtgtcttggaagtgtgactttaacaattgtttttgtttctcttccagggtgtggtagattgaactgtaaccctcaaaaagatatgttgaagtcctaatccctggtacctgtgaatgtgaccttatttagaaagcctctttgcagatgtaatcaagttaaaatgaggtcacactggattagggtgtgttctaaatccaatgactgctatctttataaagagaaatatttgaagacagagattagatattgagaagaaggccatgtgaatatgaaagcagagattggagtcatgctggcacaagcaaagtaaagccaaggattgccagcaaccataagaaactagaaaaggcaaggaaaaactctctcccaaagggagcatggccttaccaaccctccaagactatgagaaaatacactgttgttttaaatcacctagtttgtgtaatttgttatggcagccttagaagactcatacacataggtaaagtattccctcctgccaactaatactttctgtggttctaacattcctagtctatatctttgaaaccctctcccttgtatattaaggctttcttttctttatttttttttcccttaggtaagacagggagatggagtggggctggagcaggctgagttgccttcccctagttgagaagggatttcactattgccctctgttatttttgtctttctcccaacttgtaggctaatcttaaaaataaatggctagaggtcctgtcaactccacaaaaagtattttcagaccacacaaaaggtatttatcattgcataacaatgtgaattgtacacttaaaatggttaagatagtaaattttgtactatgtgttttcttaccacgattttatcattccaatttttgatatatgtgctgccaaagcaaacatttcttaccacaagttttaaaaagtatctgtcttcacacatctcttaccaaaatgatcttcatgttgctgccaagcacaagtcagagacttggaggctgtatggtgccaatggacagctaaaggaagtaagcttttgaagttgggctgtggaagggccggatatatgactcctcccttcagcaagtcctgaagcctgctgtgtaggtgggacaatctgtggtaccacatcctagaagattggataataacaagttagtagtaatatacaacaacttttatgaggctataggaataacactacagatataattatgtaaaatgatagatttaatgatctcaatacagaggattaaacaaaggagaaattgtgaaaagttaagcataagtgatctataaccattacttacattttctcattagccactcttattttatgtcatacaatcttccttttggcctactacctaactgaagcagtgctttaaaaaattcactaatcttaaccttccaaatacatacagtcatctgcataatgacatttctgtcagtaacagaccacatatatgatggtggtcccataagattataatggagccgaaaaatcctattacctagtgacatggtaatgtagcacaatgcattaccttttctatgtttagatgtgtttacatacacaaatgctcagcgttatgttacaattgcctacagtattcagtacagtcacatgctatacaggtttgtaccctaggagcaacaggctatatatatcatatagcctggacgtgtagtaggctataccatctgggtttgttaacactctaggatgttcatacaaccatgaaattgctgaatgaggcatttctcagaatgtatccctgtcgttatcctgtcaactgacccataattgtaaaaggattatttttcatgtctcatccttctgggtctctctgcttgtgacactactaatcacccctattccgactatgtgaaactttcttctccgctggttatgtgtgctgtgggcaagttacttaaaccctcagtgactccatttcttcctttgtaaaatgaggttgataatagtatttatctcatggctttactgtgaggactaaaatacttagaattatatgttccatactaagccctacatatgtatcactgctattactatcgttattacggctgttgttaggcataaactttatgttgggaaaatgccttgataaacctgcttggagttggtgatgctgagtagcatagttttagaaaaattaataaaacaacaccatttgcataaggtcttaaaaggaattaatttgtcctgtggcagaagactgagagagctatgtgattgcagataggctgtgtggttctcaatgtgaaccttctcaattacaccctcaaatatgcagtagtgtaattaaacccacaaaatgcttatgttgagtggactggtgagtgcctgtgtgtgtgtgcgcgcatgcgtatgtgtgggtatgtgagttgtaagctgatgaaaggactgaacttcatgctgatatgggatgaaaccaatcacataaattaaagccatagctagagatataatagaatttactaatcactagggagcagtctgtaattacaggatagagaatggaaggctaaagtcaaatttattgagattttgtggctgagggcaaagaggagagcacagaaactcctctgctgataatctgggttacatttatttcttcactgtctcttgtttccaacctcctacctacagatactgtctgaaacaggggctggcaatctgtgccccacaaactaaaaatggattttatattttttaaggagttgtaaagaaaaacaaagatgagtatgacaccaagactccagaccaagaccagactagaatttcttctttgtagtctatgaagtctacaatatgtgctatctggatcttcaaagaaaaaaaatttccaactcctagtcaaatattaaattcttaatcaaatactcttctcccactacatcgaaaaatctcccaaaaatctactcttaagtatattcactcacttcattatttcacaaaataaatattactaataggtactttttttttttttgagacggagtcttgctctgtcgcccaggctggagtgcagtggcgctatctcggctcactgcaagctccgcctcccgggttcacgccattctcctgcctcagcctcccgagtagctgggactacaggcacctgccaccacgcccggctaattttttgtatttttagtagagacggggtttcaccgtgttagccaggatggtctcgatctcctgacctcgtgatccgccgcctcagcctcccaaagtgctgggattacaggcgtgagccaccacgaccagctataataggtactttcttaagtattaagatacaaacataaataaatcagcagtcctagccaccattcaagatgttcacaaactagcagggaagaaagacaagtacagggtgataactactactatttataatagttttaagcatacaacacagtgaaaggtgcaaaggagtaagaagttaaccatgcctgaggaaagtggtggagctccacatgactagtgttctttgaagaaggtttcattgttttatattaacttaaaaataaaactgattgtaaaaaaaaaaaaagatgggattgttggaggtgttggaaataatccacacaaccctgaaatatataaaataataagtaaaagcctctttctttcattatttaccaccccattctttcaaggaaactgttgatgaggtttggcatatacaatgacacatataattaaaatctccacacctgctatagacacatacagaaatacatatgtatttaaaccataaagaatggtagaaaacaaagtctctcctcccccatttcccataatctcactactcaaatgttaccagtttcaatttttagaaatcagcccaagcaaaactggatatccatatgcagaagaatgagacccctacctcttgccatatacaaaaaatacaatctaagtgaattaaagacttaaatctaagaccgcaaactatgaaactactacaagaaaacattggggaaacataccaggacgttggtctgggcaaaaatttctggagtaagacttcaaaagcacaggcaagctaagcaaaaatggacaaatgggatcacatcaaattaaaaagctactgtacatcaaaggatacaaccaacaaagtgaagggacaacctggagaatgggagaaaataatttgccaaccacccatctgacaagggattaataatcaagcaatttgcaaactggcagcaggtatctgaaattcacacaactgacaaagtattaatatcaagaatatttaaagacatcctacaggctgggcacggtggctcatgcctgaaatcccagcactttgggaggtcaaggcgggcggatcacaaggtcagcagtatgaggccagcctgactaacatggtgaaaccctgtctctactaaaaaatacaaaaattagccgggtgtggtggcacacacctgtattcccagctactcaggaggctgaggcaggagaatcgcttgaacccaggaggcaaaggttgcagtgagctgagattgtgccactgcactccagcctgggcgacagagtgagactctgtctcaaaaaaaaaaaagacatcctacaagtcaataggaaaagcaaacaatatgtgagcaaatagtatgaacagacatttctaagagaaaacacatatggtcaatatggtcaatcaattcatgaagagatgttcaacctcattaatgattagggaattgtaatctagtcacagtgagatatgatataaccatctgatcggcaaaaattaagatgtctgacaatagcaagtatagaggtcttgcacatctttcattgaattcattcctaagtgatttcttgtgctattacaagcagcattttaaaatttcaatttgtaattgctaacagtatacacaatgcaactgacttttatattctgacctggaatgctgtaatcttaataaaaacagttattacttccagtaagcgctttggaaatttctcagcattttctatataaggaatgtcatatatgaatagagttctacatcttcttttgcaaactttataccttttgtttgtttttttgctgcattgtgctcactagttaggaggagtaagcatggacaaccttgccttgttcctgatcttaggggaaaacattctagtttcatgattaagtatgttgttagccatgtttttggatttttttgttattgttattaatggcctttttctggttggggaagtttccttcaattcctagttttctgagagtatttatcaggaatatgacttgaattttagtaaatgtactttctacatctattattttatggcttgttgctttattctagtaaagtggttaattattctaattgacttcctatgttaaaacaaccttgcatttctggaataaaccccatttgattatgatatattatcctttttatacattgttggattcaatatgctgaaattttgtttcagtattttgcatctagatacatgaggaatacatggtctggtgtgtgtatgtgtgtgtgtcatctttatcaggtattttatcagatttatgctgggtttttaaaattgtactttaagttctgggatacatgtgcagaacgtgcaggtttgttacataggtatacaaaccatggtggtttgctgcacccataaacccgtcacctacactaggtatttctcctaatgctatccctcccctagcccccactccccgagaggccccagtgtgtgctcttcccctccctgtgcccatatgttctcattgttcaactcccacttatgagtgagaacacgtggtgtttggttttctcttcctgtgttagtttgctgagaatgatggtttccagctacatccatgtccctgcaaaggacatgaactcatcctttttatggctgcatagtattccgtggcgtatatgtgccacattttctttatccagtctcaaattgatgggcatttcggttgtttccaagtctttgctattgtgaacagtgctgcagtcaacatacgtgtgcatgtgtctttatcgtagaatgatttttttttggtcttgcaaaatcagttttattgtaatatgcatatatgaaaatttacccatgatgcatagtcgcaatcctaatttaacttgtcctaattaaactaatcctaaagtaactaattttacttccatttttattatgtgtgaaaataagttctttctataatgttttgtactattggtctacttgcttgcttgcttttccatccattgcaatatttgggaatggattacaaaaagatacttggataagtagcactgaaagctgttaaaaacagaatatcaattcctggagtatgtttctatctggatgcacacgaatgaaataattgaactctcaaagttcttttcacgcccttaattcaatgaagcaattcctgaagcaacacattcacatctcatagctgatttacatgtttccttttgctagccttctcttttggactaagttttctccttactaatgtcagttcaaactggtgagacttcagacaagtggtttctcaatcctgatggcacaatagagtgatgtggggaactttagaaaagttctgatgatccggccctgcccctagagactgtgattaaatattttgagtgtatatgaaccacttggttatttggttactatgtcatcaaagcaggttaaaaacgaggggaaaagccatttttttcttcagcctggctatcttgacaactaacaaattattttttaaccccaaaagaaaagaaaaatgggaccaaagatatttttacttttagtaaataaagcgcatcaactctcaaaaggtgcttggccctttaaacggcatggcaatgcacagaaagacagttgggtgaggctgcatgcccttcataaccatttcaacacctacctcgggtcccaaaataaatatttttaatattgtctcattctggactgttccaacatgcactatatcagcttgtctacatattctaatgtaactgcatacaagtttccagcagctcatgtattttctttttttttattatactaaaagttttagggtacatgtgcacaacatgcaggtttgttacatgtgtatacatgtgccatttggtgtgtcgcacccattaacccgtcatttaacattaggtattcttcctaatgctatccctcccccctccccccaccccaaatcctttgggtatatacccagtaatgggattgctgggtcaaatcgtaattctagttctagatccttgaggaattgccacactgtcttccacaatggttgaattaatttacattcccaccaacagtgtaaaagcgttcctatttctccacagcctctccagcatctgttgtttcctgactttttaatgatcacaaaataagttagagaatgttacctccacttcacttttcagttctagtatttccacttggtccttatttagaaattctgtttatcctctgaagttttccatctgttcattcattccacttatttgctcctgtaagttctctaacatatttacaataacagttttaatgtcctggtcagaaaacaccagtatctgggttatctgtgagtctgcctttattgactattgtcctccctccttattatgactatttattcattttgttatatatgtagtattttttggaatgttggatattgtggatggcgtgttttagatggttttgtaaataacctttatcagaagttactttttattcctagtttgctaaaagactttttctctcataaatggatgttgaattttagggttttttttgcatttattgatttgactgtatgatttttctcctttgtttctgtggtgagttaccttgattcactttcaaaatgtaaaccaactttgcaacgctggcataaaccaaactacaatagggtatattatccttttaatacatcactgtttacaattttctaatagtttgttcgaaattttgcatctatattgatgtgtaaaattaacccaaattttcctttctcatattttccttataatattttagttacagtattattctaactttataaaaagagttgtaaagacatctattttcttctgttctctggaaaatgtcatgtgagattgatattatttctttcttaaattttgatagaattactcagtgaaggcatctgagtcttggctttactttgtgagatgggtttgagttacttaatagttataggtcagtgcagaaatttatcttcttgtgttctttttggtaagttatgtttcctaggaatctatgtattttatttaaatttttagtatactgacttaaaattatttacaatatccaattgtaactgttctgttttatgatatataatggtagctcctgtctcattcctaatattggttatttatgctttctctctcttcttttgtttctttatccatatttctagtggtattatcaattttattagtcttttcataaaagaaactttcggtttcaataatgctgtctgtcaaatatgtctttcttacaggaaattctgttcttatctttgcttccttctacattctttaggattaattttctattgtttttccaattccctgagatggatccatatgtcattgattttttagcctttcctcttttgtggaatatgcattttaaggacacaaatttcccttacagtaatggttaaacagtatccctttaaattttaagatgctatatttccatttctcagtcagctcaaaatattttctattttacattgcaatttttaaaaatttggcccacaggttattttaaagtatactacgaattttagggagattttctaatttatttcttgttttctaacttaatgtcagtgtggccaaaaaatactataattgtttaaagtttttgagatttgctttatggctcaacacatcacgtatttttctatgtgcagaaaagaatatgtattctgcaattgttgcatgtggttgtctatatatgtcaattaggtcaagtttgttaatattactgtccaactcttctatataattattggttttctcttttttgtctgatattctatcagttactaagggatatattttaagatctctgattatgattgtgaatttattgggcatcagtaaatttttgctttgcctattttgagtgttaagtgcatacaaatcagaataattgtatcttcttggtggattgcccctgttatcattataaaatagctctatacttagtaaatatttctaccttaaagtcacctttgtctggtattaatatagctatatcagctttcttttgggtagtatctgcattctatacttcttccatccttttactttcaatcttcctatatctttccattttatatatctcttataaacaagatgtagattttgtattttttaaccattctaataatctttgtcatttaactgaggtattcagtccatttacatttattataattactgatatatttaactctactatatcactatttactttctgtttgtcttgcctattctgttatcttttctctccttgctttgttttgtactaatatggtaatttgtattattcaatttactccttgtttaattcttatacattcttttactgtttttagtgattattctatgaataataacatatatatatgacatattaaagtgtagcacaaattagagggtttatgttaactccatttatcttcctccctcaagtgctattattgtgtattttaattgcatacacatgcacgccacatgacattactatttttattcattcattcattcattcattcattcattcattcatttatagattcagagcctcgctctgtcacccaggctggagtgcagtggcatgatcatggcaaactgcagcttcaaactcctgggctcaagatcctcacctcagcctcttgagtagctgggactacaggcatgcactaccttgctttgccaagacattactatttttttaaatatgatcaatgaacattcagatctacccacatatttaacctcccccctgcacttcattcattatatatttccaagatttcatttaggatcagtttaattctgcctgaagatccttaatatttcctttggtttttggtgacaggttccctaagttatggaccatctaaaaacatctattttacttccattttaaaaggctggatatagaatttaccagataaaattttaggttgacagttaattttgtcagcattttgaaaatgtagttctatcgtcttcatgttgtttttttgaaaagtcaaagccaatctaattgctattccttgaaaggtaatactttttttttctccaaatgcttttaagacttttttttctttatttttttggcagttcttactaaatacacctagatgagggttttttatttatttattctgcttcgggttatggtactttttgaatccacgaactgatgcttgtgacaggcagatttctaagatgacctccagttacccttgctgttgtaaaatcttttcccctggagtgtgagagggattatgaatatgataaggtttcacttgcattattacattatgtatatgggacagctgactttaagaaaggggaatggcccttggttgggattacctaatgcagcaatcctttgaaagagactggtctcttcttttttttttcctttttttaattatactttaagttctagggtacacgtgcaccatgtgcaggtttgatacataggtatacatgtgccatgttggtttgctgcatctgtcaactcatcatttacattaggtatttctcctaatgctatcccttccccagctccccaccccctgacaggccccagtgtgtgatgttccccaccctgtgtccaagtgatctcattgttcaattcccacctatgagtgagaacatgcggtgttggttttctgtccttttgatagtttgctgagaatggtttccagcttcatccacgtccctgcaaaggacatgaactcatcattgtttatggctgcatagtattccatggtgtatatgtaccaaattttcttaatccagtctatcattgatggacatttgggttggttccaagtctttgctattaggaactgtgctgcaataaacatatgtgtgcatgtgtctttatagcagcatgatttataatcctttgggtatatacctagtaatggaatcactgggtcaaatggtaattctagttgtagatccttgaggaatcaccacactgtcttccacaatggttgaactagtttacagtcccaccaacagcgtaaaagtgttcctatttctccacatcctctccagcacctgttgtttcctgactttttaatgatcgccattctaactggcgtgagatggtatctcattgtggttttgatttgcatttctctgatgaccagtgatgatgagcattttttcatgtgtctgttggctgcataaatgtcttttgagaagtgtctgttatatcctttgcccgctttttgatggggttgtttttttcttgtaagtttgtttgagttctttgtagattctggatattagccctttgtcagatgggtagactgcaaaaattttctcccattctgtaggttgcctgttcactctgatggtagtttcttttgctgtgcagaagctctttagtttaattagatcccatttgtcaattttggcttttgttgccattgcttttggtgttttagtcatgaagtccttgcccatgcctatgtcctgaatggtattgcctaggttttcttctagggtttttatggttttaggtctaacatttaagtctttaatccatcttgaattggtctcttcttagtgaaagagacttgaagcaagaaagggagttgatgccaggaagatttttcattggctttgaagatggagataactacgtggcaagtaaggcaggcagtctctagaagatgagagtgagttacagctgacatgcagcaatgaaacagggacttcagtcctatggttacaaggaactgaattcagccaaccagaaaggaatgtagcctggccaacattgtgatttcagcctttaatactgtgaccagagaactcagtcatgccacacctggacttctgtcctattatcgggggacctgccccgataatcacgtgggttcttttctagtttcctaagcatcggctggcttgagaaataaaaggacagagtacgaaagagagaaattttaaagctgggcgtcctggggagacatcacacattggtaggatccgtgatgccccacaagccacaaaaaccagcaagtttttattagggagtttcaaaaggggagggagtatatgactacgtgtgggtgacagacatcaagtacttaacagggtaatagaatatcacaaggcaagtggaggcagggcgagatcacaggaccacaggacggaagcgaaattaaaattgctaatgaagttttgggcaccactgtcgttgataacatcttatcaggggacagggttttgagatcaaccggtctgaccaaaatttattaggcaggaatttcctcttcctaataagcctgggagcgctatgggagactggagtttatttcacctctgcaatctcgaccataagagacaggtacgccccgggggggccagttcagagacctacccctaggtgcgcattctctttctcagggatgttccatgctgagaaaaagaattcagcgatatttctcccatttgcttttgaaagaagagaaatatggttctgttctgcccagctcaccggcagtcagagtttaaggttatctctcttattccctgaacaactgctgttatcctgttcttttttcagggtgcccacatttcatattgctcaaacacacatgctgtacaatttgtgtagttaacgcaattattacagggtcctgagacgatatacatccttctcggctgacaggattaagagattaaagcaaagacaggcctaggaaatcacaagggtattgattggggaagtgataagtgtccatgaaatctttacaatttatgtttagagattgcagtaaagacaggcataagaaattacaaaagtattaatttggggaactaataaatgtctataaaatcttcacaatccacgttcttctgtcatggcttcagccggtccctccgtttggggcccctcacttcccgcaacaacctatagaactgttagctactaaatggatgttgttttaaaccactaagtttgtggtaatttgatatgcagctatagaaaaataatgcaatgctgtattacttttcaaaaattcctcatcatcacgtcttcaaatattgtttctgtaccattctctctcctttttttctaggactcctattgcacatatatcagatctttacacatattaggtgccagacactgttaaaggtgctgaaaatatatcagcaaccaaaaatattcctatcctcatgaagcaccttttaatgacatcctgatcccccctacacctaaactgtttcctcccacagagttcctcctcacagtaaattctagtctcattcaaccagttgcgtaactcaaaaatcagtgcttcaaactcaatacttcattaaaaaaagttttccccccagtcaattatcaagtcatgataacttttatcccctaaatgattctcaaacttcacccaccgtagtgtatctctacttgccaacatgcctgtccaggcccatcattatttctcacttaaagactgcaacagccttctaattgacctatccactcttgccctcccttcaaactttttgcacatggtaggaagagttaactaaaatatgtcagtgtgtcactccatttgaatatctccctaggcttttcaatgtaaaatccaatgtccttaatgtaatgccttctactacctggttctgagctacctctcagcctaacttcctgctacttacctccttgtactttattgcttaaccccagatttaccatgttctttcatatttgaagaaactcatgttcatgctctttgttcaaactggaagcccttcccttcctattctgccttttattcatcttttaagaatcagtctagatatcatctcatctaagaagtcttctctaaactcccagaataaaccagtagctttcttttgttctctcataatagtctttatgtgtttcttcttaatacattatgttgaaatgatatgtttatatgtctttccccctaataatgctggatgttcctcaataggaaggcctatctgtctcattcattttgataccctaacatctagcatggttcctagtacttagcagaactccataaatgtttgtgaaaattgaattgaattattattcttccagcatcatagcccctttaaatctaaaatgtttgcttaatcttaatgtctgcttaagatattttgcttaagtaaataatattgactgggtcaatccaaaggtagggtatacagcagatcatcaaaaaattcatcctttgcctatgatatgttaatcagcactctttgaatatggtgatttaattaattaatacataattatattacttttataacccatattatcttgtccagaaggttatcataaatgacttattagtcttgctgaaatttcattcattcatttaagatatgtaattatgtctgccatatttccataaactacctctaatagccttgtcagaaataagaaccaggtttgtgttgaatggctttgttgataactgtaattttttaagtactcgcttatttgaaaatttgttttagaagctaacttaagagacatttagctcactgattagaagattgaagactccccctttttctttgttagcctcagtaatatatttatataaatccaatcttaaagcacctttcctattttccttaatgccttcgattactgagagtagtttagtaatatcaactgagttacaatttacccattccaggacacatgtactttttctttctgagagtatagttaaaatattgttcttgttgtctttacaaatatgcatttctacaagcctgaggtaattttggaccttatccttccaaatactaaccctttaggcacatgtcaccagttatatttatccttgtgtttgtgccctttttcctatttcttatatattatcttttaaaaaaaagaaagtatgaactcattgtaaaacttcctatgtggccccatggttttcctcttttctcctttaatagaataatttgctgtttcattgtcaaaattatgtttttgagagcttcccaacctttagagtctaaagccatcgtaatgtaaattaaggtccaaaaagtatcaatcataataacagaaacttttggagatcagccatagctagaaattctagtcagagtaggcaattacataataggtcaatctgaatcttttcatggttattactaaggaagaagcattacctcctgaaaggcttaaagccaagagtgcatttagctcctgtcaatttttccttccaaatgtctttcagatttgtccttctctttccattcctatagattccttcatcacctcatacctggcctattgccatagactagatggtttccttgccttcagtccatccatattccaatccattgtccatacactattgccagattaatcttcttaaaacactttcatcatgccattctcctgcctaagacttagctcaaatgtcaccttcttcgtaaaatattcccagctcccttaggaagagttagcaactgcctactcagtgttttcacaggtctctgtgcataaccttattagtgcacttaaaacatgtatgacaatcatttctttaattatttttcttacctcaattgctatgagctccttgaggagaggcaaaggtttgagccatctctttacaattgcactcagggcgttacataatctatcttgccccacccatgtcaggaccatcacatatactgccttctctgcttaccatgctctccccttcattcttcctgctcgttccttaggtctcagattaaatatcaattcattgagaaaccttcgctgacactcttattaactaattaattagttaatcatttgaacaaatatttgtcgggtgtctactttgtgctagacattgttttaggcactagggatataccagtgaacaaagaagacaaaaagtcttgctttcaagtttatcttctagtgggagaaggtagataattaagtataaacataataagttatatatagtaagctataaaaaatagcaggataaagcagtgtgctggaagttggactttgaaacatggtggtcagggtaggcctcattaagaaagatgacatttgatcaaaggaggagttagtcataaggatatctggggtaaagtagactaggcagaggggatagccaatgcaaaggctctaagttgtgattatatctgttgtggccaaaagaaaaaaaaaagaaagaaaaaacattgtagctggagctcactaagcaagaagtaaaataatagatgaagtgagaaaggtaggaataaataggtcaggtcagatcatgtagggccttataagctaatatataaaaactttagtttttactctgatagaaatgatgaaccattgtagggttttaaaactaataggtaacatgatgacacattttaaatgaactgttctggctgttgtattgagaataaactgtaaacaggccaaggaaaggagggatacctgttagtaggctattacagtactggatttattgaagtaatccaggcaagaaatgatagtgacttagactaaggcagtagcagtgaaagtggtgaaaaagggtcagagtctgtttttttgaaggcaaaaacgacaggatttgctgatgaattgaaaatggggtgtgagataaagaggaatgtattagtccattttcacactgttataaaggactacctgaaactgggtaatttataaagaaaagacatttaattgactcacagttctacatggttggagagacctcaggaatcttacaatcacagcagaaggtgaagggaaagcaaggcacgtcttacatgatggcaggagtggggggaattgccacacttttaaaccatcagatctcatgagaactcactcacaataatgagaacagcaaggggaaatccactgccatgattcaatcacttcccaccaggcccctcctctaacattggggattacaattagacatgagacttgggtggggacatacagccaaaccatattatcccacccctggcccctcacaaatctcatgtccttttcacatttcaaacccaatcatgccttcccaacagcccccaaagtcttaactcatttcagcactaaaaagtccaagtccaaagtcttatcggacacaaggcaagttccttctgctatgatcccataaaatcaaaaacaagttagtcacttccaagatacaatgggggtacaagcattgggtaaatgctcccattccaaatgggagaaattggccaaaacaaaggggccacaggccccacacacgttcaaaacccaacagggcagccattaaatcttaaagctccaaaataatctcctttgactccatttctcatatccagggcatgctgatgcaagggttgtgctcccacagccttgagcagttctgcccctgtggcttagcagggtacagccactgaggctgcattcacgagctggcattgagtgcctgtggcttttccaggtgtacagtgcaagctgttggtggatctaccattctggggtctggaggatggtggccctcttctcatggctccactaggcagtgcccagtgtggactctgtgtggggcctctaaccccatatttcccctctgcattgccctagtagaggttctccatgatggttctgcccctgcaacagacttctgcctggacatccaggtgtttccatacatgctctgaaatctaggcagaggttcccaaacctcaattcttgccttctgtgcacccacaggcccaacaccacatggcaattaccagggcttggggcttgcatcctctgaagcaatgtaccatggcccctttaagccacagttggagctggagtggctgggatgcagggcaccatttcccaaggctgcacagagcagggaggccctgggcctggcccatgaaaccttttttttttctcctaggcatctgggcctgtgatgggaggggctgccgcaaaggtctctgacatgccctggagacattttcttcattgttttgaccattaacatttggcttctctttacttatggaaatttctgcagcaggcttgaatttctccccagaaaatgggttttttggttttttcctttctatcatatattcaggctgcaaatttgccaaacttctatgctctgcttcccttttacatataagttccaatttcagaccatttctttgtgaatgcacatgacagtatgctgttaggaacacccaggtgcatataacactatgctgttaggaacagccaggttacttcttgaacactttgctgcttagaaatttcttccaccagataccctaaatcatctccctcaagttcaaagttccacagatctctagggcaggagcacaatgctgccagtctctttgctaaagcatagcaagagtggccttcactccagttcccattaagttcctcagttccatctgagatcatctcagcctggatttcactgtccaaatcactatcagcattttggtcaaaacccttcaacaagtctctaggaagttccaaactttcccacatcttcttgtttctgaaccctccaaactgttccaacctgtgcccactatccagttccaaagtcacttccacattttcagttatctttatagcaatgtcccactctcctggtacccattttctgtattcgtccattttcacactgctataaagaactacctgagactgggtgatttgtaaaacaaagaggtttaattgactcacagttctgcatggctgcaaggcctcatgaaacttaaaattatggcagaaggtaaaggggaagcaatgcacaccttacatggtagcaggagacagacagagcaaaaggggaagttccacacttttaggccatcagatctcctgagaattcactcacaatcatgagaacaacaaggagaaagtccacccccatgattcaatcactttccatcaggcccctcctctgacatgtggggattacaatttgagatgagatagcaggagtggggaacagagccaaaccatatcaaggaatgaatgataacccaaggtatttggactgaaaaactgaaaggatggggaagactgctggaggatgtttggaaaaacagattagaattttagttttggatctgttaaatttgagatgtctattagatttttaggtggaaatatcagagaggcagttggatacatgagtcttgagttcaggggagagatatgagctgcagatacaaatttggcagttgttccatagttggtatttaaagtcaggagactggatgagactaccaaaggaattggtatagacagagaaaagaagattaacatttgttagtttctcatagatccttttattcttcaatgcacttattacaacttgtaattatttgtttatttgtttttatttctgtgattgtttggctaatgtctggttgccttattacaagaaaatgttccaatgagagcagggtctatgccattttctccatcacaatcagcaaaataatatgttggattgcatgaattaaaagaatgttcctttttttcaaggactcaaaattaaatgctcacaagggctaggcaagtaacataaataagtcgagtataagagacaatgtgttgtagagagaggggtgaactgaagtgtccaaaaatcatagccactacttagttccagctgattatggacagataggcctagtgttgtaatcttcagaatttttgaaatgagccagatatacagattatatatgaaatctcccaaattgtaatgccaacaactgtattagttcaggtcttctaaaaaagcagatgccatgataaaaatagatgtgcaagtaatttactggggaaaagatatgtgaggggaagtgggaagagtgtctagacttggagggtcatcagaccatggtacaggtcctatccctgtggaagacagaaagaaggaagcacagtctcagactgcaatgcagatctaagaaagtttcaggaaggctgttggggaatactcaagccaaaggtggccattaaaggagtctgggtctccaaggaatgggctctcattagtattcttgccatggtcattcagtagtttggaacagttgatgggaagtgtagccttggaagaaagaaacaatgatggatgatagaacacagcagctgggccctcagtcagctatactccctttagtaggagatatgagtggcacattgtggtgggcatcacaatgactaaattcaacaatgccacaacagtatgagccaaaaacacatcttcaagccatattcagccccaatgtggacagttgtcaacctctgctctagtcactaacatatactttaccatcaatgggctagttatgtatagatcctaacataggccaaaatggattgccaatagcatctaggtagtagagtttaagttaccaggtgagaacatgaaaagcattagccaaagtgggtttaaaatgtgctgccagaatagaggtagtttcagagtatgaaggagcaaaaactacaatccaaaaggaaaaggtatgagttaaagcaaagtgtctacaagcattatacgaacataaacagtgaagtcaaaaagcagaaatagtttataataattgactaagcagagcatttcagatcttttgtctgtgaaaggagaataagcactgttatatgtatttactgtcaacaatatgctgtgagaggaaagggaagaccttaaagaatttggagtctgaaaggcagtgacaactgtggcctttggtgagagacaataatatcaggcagggcatagccaattacatcagtgtatctaccataatgggtatggcttgtggtactgaaaagcagggcaggacaaggttgaagtaaagtttaggtcaaacaaaggtggtctagggtcaagagtaggtgaaactaccccttgagtttcctggtatgtccttgattccaatgcatggacttcatgtttccatgtaccaaaagacattatgtcagatgcactgccatgaaaggtcttaaaaggacttctaggggctgcagaggcacactggggtggcattataatatgggcagaaaagtagggcttggacttagcccatcaagacttacaaatggcagtgaaagttcagttcctccaatccacagtcacacacacacacctcatccacacatttatttgccaggtgccaagtaaggtttttctgaatgtccaccatgctctgctgagcacaggtgttggtatactgttgcttctgaatgaaatctattgactctactgctaggtggaagaggtgcctcgatactctggagatactgacttgaaaatggggaccacccacttgccctttggggggtagcctttggctgctgtgagtttgtagtaaaagtataggcaaggcaccccatcaccccgtgggggtctcctgcattgctctgttggagaagtccctttctcagatgcatagatgttgtgggataagatacggtataaatgaagagccccctaaatgccttaggttgctttgaaaacctagggaccattatgaatctgagacactatgatgaatagctagaaaaaaaatgttccaacagaagcaatgctgtatggttaacacctttaaagtaaagcctgaaccaaggctatgtgcatctgtgtgttttccagggacagtagatgcagcaaagtgacttcaaggttagtgattatactcctggattctgttatctggccagttagcattcttaatttgaagaaacacagtttcttatctctgggccatactttgcagctatattgtctactggggcaccattatctcctccaagggtatactatgttgccactagaatcattgtatcaaagatatatttttctaggaggcagatgtcacaatccaagaaggatttcttccagtctaagcaggaaggttgtgagcaatgctaaaaccaggaaataaaccatcaaggactgtccaaggatgacctactaacatggcaatataagattgtagtcagggggacagaaggtaacaatgagtgttcaacatgaaggataaggcagatatacaacagaagaacagacagcaaagttggttcctgggagagtaaagtaagagatgggccaatgttagattgaatggttcattatttccctgtgaatggccacttaaggtaccagaactccctttttatgggttgaggtacacgctgagagagtaggtatatgtgactaaaagagacacactaacctactcaggagatgtcaatggtcctgttcatggtgttgctcataatacttcaacctgggatgctctcttcactctatataaaatctctcttcattcttcaaagaccatttcaaaatctgttcattcaaagaagtcttcctcacttcatttggactacacagatttctatctttcctgatggccagtgatgcatactatttgaaccaaacgtgctggtgttatcttgattttaactgtcctcctaattggttcatcaagtatgtaagctttgattctctagctaagctgcaaatcccatgagtttggagagtaaatttacttgtaacctccacagtgtcaaacatatactaagaacttaatacatttttatgtgaattaacaaatcaagatccaacaatcattggttgcagaataatcagaaatgtctggggaatggccgcagttggaaactctagtcagagcagcaactgcatatgggccaacttcgatatctttatggttactacaaagaaagaaacagcatctcctgaaaggctgcaagccaacagctagagcatttgacttcctgaatgactggcagttacatctgaacataatgactgcattaggaattgaaataaaaacaatttttcctatactttttgtgcagtacaagaagcaatctaagaacttgaaatcccaaatgtctatttatctcaagttacaaaataaaacgaaacaagctatccaattaaaaaaaataaatcacccataatagatacctaaaataaatacaggggacacaggaatagctgagtgaggagttcaataaagttattcaaaatgcaaaaataaactggacaaagttgtcaaaaacaaccacatcatgactctggaaaccgacaaaatcatacaacaaattgagaagtattaattcaagaaaaactattgaatcttgagtacaaatggtagaaatctatggcattttaacctggggtcattcccattccttccaccagccctgtggcatggtcattttaaatgtacagtggaagaccgaagaactgaaagctccactgatggagggtgctgccatcatttgtagaagatcacaataaaacccatatccacttcagaggtcaggcagccaagatggccgaataggaacagctccagtctacagctcccagcgtgagcaacgcaaaagatgggcgatttctccatttccatctgaggtactgggttcatctcattagggagtgccagacagtgggcgcaggacagtgggtgcagcacactgtgcacaagccgaagcagggcgaggcattgcctcactcaggaagcgcaaggggtcagggagttccctttcctagtcaaagaaaggggtgacagatggcacctggaaaatcgggtcactcccaccctaatactgcgcttttccgacaggctgaaaaaacggcgcaccaggagattatatcccccacatggctcagagggtcctacgcccacggagtctcgctgattgctaccacagcagtctgagatcaaactgcaaggcagcagcgaggctgggggaggggcgcccaccattgcccaggcttccttaggtaaaaaaagcagccgggaagctcgaactgggtggagcccaccacagttcaaggaggcctgcctgcctctgtaggctccacctctgggggcagggcacagacaaaaagacagcagtaacctctgcagacttaaatgtccctgtctgacagctttgaagagagcagtgattctcccagcatgcagctggagatctgagaacaggcagactgcctcctcaagtgggtccctgacccctgacccccgagcagcctaactgggaggcaccccccagtaggggcagactgacacctcacacggctgggtactcctctgagacaaaacttccagaggaacgatcagacagcagcattcgcggttcatgaaaatccgctgttctgcagacaccgctgctgatacccaggcaaacagggtctggagtggacctctaacaaactccaacagacctgcagctgagggtcctgtctgttagaaggaaaactaacaaacagaaaggatatccacaccaaaaacccatctgtacatcaccatcatcaaagaccaaaagtagataaaaccacaaagatggggaaaaaacagagcagaaaaactggaaactctaaaaagcagagcacctctcctcctccaaaggaacacagttcctcaccagcaacggaacaaagctggatagagaatgactttgacgagttgagagaagaaggcttcagatgatcaaactactctgagctacaggaggaaattcaaaccaaaggcaaagaagttaaaaactttgaaaaaaatttagatgaatgtataactagaataaccaatacagagaagtgcttaaaggagctgatggagctgaaagccaaggctcgagaactacgtgaagaatgcagaagcctcaggagccgatgcgatcacctggaagaaagggtatcagtgatagaagatgaaatgaatgaaatgaagcgagaagggaagtttagagaaaaaagaataaaaagaaatgaacaaagcctccaagaaatatgggactatgtgaaaagaccaaatctacatcgtattggtatacctgaaagtgatggggagaatggaaccaagttggaaaacattctgcaggatattatccaggagaacttccccagtctagcaaggcaggccaacattcaggttcaggaaatacagagaacgccacaaagatactccttgagaagagcaactccaagacacataattgtcagattcaccaaagttgaaatgaaggaaaaaatgttaagggcagccagagagaaaggttgggttacccgcaaagggaagcccatcagactaacagtggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaacagctcctgaaggaagcactaaacatggaaaggaacaactgataccagccactgcaaaatcatgccaaattgtaaataccatcgaggctaggaagaaactgcatcaactaacgagcaaaataaccagctaacatcataatgacaggatcaaattcacacacaacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggacggagaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatgctaaatatatatgcacccaatacaggagcacccagattcataaagcaagtcctgagtgacctacaaagagacttagactcccacacaataataatgggagactttaacaccccactgtcaacattagacagatcaatgagacagaaagttaacaaggatacccaggaattgaactcagctctgcaccaagcagacctaatagacatctacagaactctccaccccaaatcaacagaatatacattttttttcagcaccacaccacatctattccaaaattgaccacatagttggaagtaaagctctcctcagcaaatgtaaaacaacagaaattataacaaactgtctctcagaccacagtgcaatcaaactagaactcaggattaagaaactcactcaaaaccgctcaactacatggagactgaacaacctgctcctgaatgactactgggtacataacgaaatgaaggcagaaataaagatattctttgaaaccaatgagaacaaagacacaacataccagaatctctgggacacattcaaagtgtctagagggaaatttatagcactaaatacccacaagagaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaagactcttcaaaaaattaatgaatccaggagctggttttttgaaaggatcaacaaaactgatagaccgctagcaagactaataaagaagaaaagagagaagaatcaaatagacgcaataaaaaatgataaaggggatagcaccaccactcccacagaaatacaaactaccatcagagaatactacaaacacctctacacaaataaactagaaaatctagaagaaatggatacattccttgacacatacaccctcccaaaactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtactattccttctgaaactattccaatcaacaaaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcaggctaaaaactctcaataaattaggtattgatgggacgtatctcaaaataataagagctatctatgacaaactcacagccaatatcatactgaatgggcaaaaactggaagcattccctttgaaaactggcacaagacagggatgccctctctcaccactcctattcaacatagtgttgtaagttctggccagggcaattaagcaggagaaggaaataaaggctattcaattaggaaaagaggaagtcaaattgtccctgtttgcagacgacatgatcatatatctagaaaaccccattgtctcagcccaaaatctccttaagctgataagcaacttcagcaaagtctcaggatacaaaatcaatgtgcaaaaatcacaagcattcttatacaccaataacagacaaactgagagccaaatcataagtgaactcccattcacaattgcttcaaagagaataaaatacctaggaatccaacttacaagggacgtgaaggacctcttcaaggagaactacaaaccactgctcaatgaaataaaacaggatacaaagaaatggaagaacattccgtgctcatgggtaggaagaatcaatatcgtgaaaatggccatactgcccaaggtaatttatagattcaatgccatccccatcaagctaccaatgactttcttcatagaattagaaaaaactactttaaagttcatatggaaccaaaaaagagcccgcattgccaagtcaatcctaagccaaaagaacaaagctggaggcatcacgctacctgacttcaaactataccgcaaggctacagtaaccaaaacagcatggtactggtaccaaaacagagatatagatcaatggaacagaacacagccctcagaaataacgccgcatatctataactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctataagaaaacctaggcattaccattcaggacataggcatgggcacggacttcatgtctaaaacaccaaaagcaatggcaacaaaagacaaaattgacaaatgggatctaaactaaagagcttctgcacagcaaaagaaactaccatcagagtgaacagacaacctacaaaatgggagaaaattctcacaacctactcatctgacaaagggctaatatccagaatctacaatgaactcaaacaaatttacaagaaaaaaacaaacaaccccatcaaaaagtgggcgaaggatatgaacagacacttctcaaaagaagacatttatgcagccaacagacacatgaaaaaatgctcaccatcactagccatcagagaaatgcaaatcaaaaccacaatgagataccatctcacaccaggtagaatggcaatcattaaaaagtcaggaaacaacaggtgctggagaggatgtggagaaataggaacacttttacaccgttggtgggactgtaaactagttcaaccattgtggaagtcagtgtggcgattcctcagggatctagaactagaaataccatttgacccagccatcccattactgggtatatacccaaaggattataaatcatgctgctataaggacccatgcacacgtatgtttattgcggcactattcacaatagcgaagacttggaaccaacccaaatgtccaacaatgatagactggattaagaaaatgtggcacatatacacaatgaaataccatgcagccataaaaaatgatgagttcacgtcctttgtagggacatggatgaaattggaaatcatcattctcagtaaactatcacaagaacaaaaaaccaaacactgcatattctcactcataggtgggaattgaacaatgagaacacatggacacaggaaggggaacatcacactctggggactgttgtggggtggggggaggggggagggatagcattaggagatataactaatgctaaatgacgagttaatgggtgcagcacaccagcatggcacatgtatacatatgtaacaaatctgcacattgtgcacatgtaccctaaaacttaaagtataataataataaaataaaataaaataaaataatacaacagagcacacacacacacgaaactcatatccagtggcattgctgaaaacaatagcaaaatcagtggcaagcaatcaaggaaggccaatatgacagctagcctaaagcctccataatggttgtagagagccacaggccagaaggcctgccagcaagaaatttaacagggatatccaggtaatgagacagccaaagtaggccttgaaaagttctgacatatcactgggggtttggcagactacgtatatttacaaactgcacacttgcttatgaaaggtcagagtggatcctagatatgcacttgtccctgggagaacatgagtccttgtccacacagaaagtaagagtgagacaggcttgtaaacagcctgaactttgaatttgtttcccatcccacatgcagatccacttttcaaagggtagaaacttagccttactggttaaagattttaattgcaatctctgaccaaccattaactgaccactaagctatgctgatacagaggtaatattgtctaaaacgtccagttttccttaaaaaatattagacatgagtgtgtattccatacatggggtgaaaacagcagtcaacaaaaaccatttctaggggctcagatgttgcacgcaacagacaaggacaaaaaatgtactcaaagaacaaaagaacaaaataaaccatgtttaatgaattaaaggaaattaggagaacaattacttagcacacagaacatcaacaaagagacagaaattataaaaaaagaaaaatggaaactctggaattgaagggtataataactgaaatgaaaaattcactagggagactacacagattgctctgacagaagaaggaatcaacaagcttaaagatagattaatagagataacttgatctgtagaacagaaagaaaaaatttaagaaaaatgaacagagctacagagacctgtgggatagcaccgaacacaacaacctgtattagtttactaagactaccataaaaaagtgccacgaactgggtggcttaaccatcagaaacatattatctcacagttctggaggccagaagtctgagaccatgtgttggtaatgttggttccttctaagggctatgagggaaagatatgttccagaccactttccttggcttgtggatagccatcttctccctgtcttcacatcatttcccctctgcatgtatctgtctccaaattttccctttttataagaatataagttaaataatttcattttaatttgattacctctgtaaagaccttatcttcaaataaggttgcattctcagatatagagggttatgactttaacatacgaattttggagggacaaaattcaatgcatatcgtaacatatgagtcattggagtccaagaaaaagcagagagacaaaaagggacagacaaaatatttgaaaatataattgtcagaaatttcccaaacttgatgaaaaatattaatctacacatccaaggatctcaacgccaaggatgataaacacaaagaaatctacatactgaaaaatcacaataggctgttgaaagccaaagaaaataagcaagtttcaaagaaacaaaagaaaaaatgagcaaaccaaatccagcagcacaataaaaagctaatccaccgcaatcaaatagactttacccctgggatgcaagtttggttcaaaatatgcaaatcaataaatgtgattcatcacataaacagaactaaaaacaaaaactacatgattatttcaatagaagcagaaaaggcttttgataaaattcagcatctgttcatgttaaaacaaattaggcactggaggaagatgcctcaaaatagttaacagccatctataacaaacccacagccaacatcatactgaatgagcaaaagctggaagcattccccttaagaaccagaacaaaacaaggatgtccagtttcaccactcctattcaacatagtactgggagtcttggccagagcagtcaggcaagagtaagagataaaaggcatccaaataggaagagaggaagtcaaactatctctgtttgcagattatataattctatacctagaaaaccccatagtctctgccaaaacctcctagatctgatttaaaaaaaaatcagcacttcagcaaagtttcaggatacaaaactcaatgcacaaaaatcagtagcatttctatacaccaacaacatctaagctgagagccacatcaagagtgcaatcgcattcacaacagccacaagaagaataaaatacctgggaatacagctaaccaggaaggtaaaaaatatctacaatgagaattacaaaacactgctcaaagaaatcatagatgacaccaacaaatgggaaaacattccatgttcatggataagaagagtcaatattgttaaaatggccatactacccaaagcattttacagattcaatgctattcctatcaaactaccaatgacattcttcacataattagaaaaaaaatctaaaattcatatgaaaccaaaaagtagcctgactagccaaaacaatcgtaaggaaaaagatcaaagctggaggaatcacattacttgactttaaactacactacaaggctactgtaagcaaaggagcatggtactggtacaaaaacaaagatatagaccaatggaacagaatggagagcccagaaataaagttgtgcacctataaccatctgatcttcaatgaagttgacaaaagcaagcaatgaagaaaggattccctattcaataaatggtgctgggataactgctagccatatgcagaagattaaaactggaccccttccttataccatatacaaaaatcaactcaagatggtttcaagacttataaatgtaaagcctaaaactacaaaacccctggaagataacctaagaaataccattctggacacaggcccagtgaaagatttcataacgaagatatcaaaagcaattgcaatgacaacaaaaattgacaaatgagacctaattaaactaaagagcttttgcacagcaaaagaaactatcaacagagtaaatagacaacacacagaatggggcaaatatttgcaagctatgcatctgacaaaggtctaatatctggaagctataaggcacttaaattaacaagcaaaaaccaaacaaccccattaaagagtgggcaaaacacatgaacagatacttttcaaaagaagacatacacatggccaacaagcacataaaaaagtgctaaacatcaccaaatcattagaaaaatgtaaattaaggcctggtgcagttggctcacacctgtaatcctagcacttttgggaggccaaggcgggtggattgcctgagctcaggagtttgagaccaggctgggcaatatggtgaaaccccatctctactaaaaataaaaaaaattagttggccatggtggtgtgcacttgtagtcccagatactcagggaggctgaggcatgagagttgcttaaaccaaggaggcagagactgcagtgagctgagatcacaccacggtgctccaacctgggcaacaaagcgagactctgtctcaaaaaaaaaaaaaatagaaaaatgtaaattaaaaccacaatgagataccatctcacaccagtcaggttcatagtggctgattagatgtagctagtatatgccccttccatggagataatactaacagcccagctctcaaagaactattaggttggtgcaaaagtaattgcagtttttgccttaacacatccagccctggtgccactgccactgctgccaccactggccaaggagggaaagaagagatcaggcactttcacacactctgaggacgaatcccatccctgctgctgctgcaggctgctgtgaaacgaaagagaaagaaaaccatgtaacacacaggtgcctgcctatgttgctcccactgatagtggtcccaccctatatggtgacaggactacagctgctaccattgagagcccagtccccaaagaactgcatcctgccctggggctaatgctgccactgccaccatcaggcccaggagggagatgggggaggcctggcacttttacatgccccaaggaaaagttgtactagtgctgctgtaggctgtaggaccaaggtatgagcaggctgtgtgccccacaagtgcctgcttgcactgctgacaatgacaatggccccatcctcccagatggcaggcccacagtgcagccaccactgcccccacctgaatatcctgccggcagcctggagacaaccctgcccctgcctatcacagctatagcctgaatacactaaccagggtccctgagggcaagtacactaacccagtcctatgcccccagtactcaagtatgctatccagaggcctggggatctctcagcccagtccataccagtggaacctgagtactcttcccagggtctgaagttgggctgacccaacataccaataccaccactgctggcaaacaccaacacatatcacctgtgtgccaggagattggcccacccaacccattgctgccacggcaaagacgagcttcaaccacataggttgtaggaggatgccccatcaatgctattgccattgcccacatcatgcccactgcacaggggcctgagaacctgcccataaacccggccaaacattgtcactgctgacatctgaacaagccacccggaggcccaagaattggcctgccttcacctgttaacaccagagccagaatacatggctctggggttcaaggacaggcaagctcagcccactgctgccaccactggggccccaaaactggcacacttcacatcacagccccagaaaaactttgccctagaaaaccctaaagactttctccaaaaaacttgtagagttgatttcagtaaactttcaggaaacaaaatcaatatacataaattagtagcatttctatatgccagtaattatccagctgagaaacaaattaagaaggaaatcccatttacaatagctacaaaaaataaaatagtaaggaatatatttaaccaagaatctctacaaggaaaactacaaaacactggtgaaagaaattgtacatgacaaaaatggggaaaaacatcccatactcatgggtcaaaagaatcaatattgttaaaatgaccatactgctcaaagtaacctacagattaaattgcaatccctatcaaggtacccacatcatttttcacagaattagaaaaaaattataaaattcatatgtaaacaaaaaagagcctgaatagccaaaggaatcctaagcaaaaagaacaaagacggaggtatctcattacctgacttcaaattatactacaaagctataggaaccaaacagcatggtactggtataaaaacaggcacacaaatcaatggaacagaatagagaacacagaaataaaaccacatatctacaaccaactggtctttgacaaaggtgacaaaaacacacaatggggaaaagacaccctttatttttctttttcaacttttgttttagaattagaggttacacgtgcaggtttgttacaaaggtatattacataatgctgaagtttggggtatgactaaatctgtcactctggtagtgaacatagtacccaataggtagtttctcagcctttagccccctctttctctcccacctctagcagtccccagtgtctgtctattgttcccatctttataggacatcattttcaataaatggtcttgggaaaattggattgccacatgcagaggaatgaaactggactcctatctctcaccacataaaaaaatcaacttaagatggagtaaatacttcaatataaaaccagaaactatacaaatactggcagaaaacccagggaaactgctggatattggtctaggcaaagaattcacaactaagacctcaaaatcgcaagcaacaaaaaaaaaaaaatagaaaaatgggacttcattaaaaagctcttatacagcaaaataattaatcaaccaggtgcacagacaacctggagaatgggagaaaaatatttgcaaacgatgcatccaacatgaacctagttctcagcagccagcactcaaattcacaaggaacatgaacaactcaacaacaacaaagaaaacaaataactccattaaaaagtgggtgaagaacataaatagacatttttcaaaagaagacatacaaatgaccaatagacatatgaaaaaatgctcagcatcactaatcactggagaaatgaaaattaaaaccacaatgagatatcatcttacaccagtcagaatggctattactaaaaagtaaaaaaaaacagatgttggtgaggatgctaaaagggaatgcttatacactgttgatgggaatgtaaattaatataacctctacagtatggagatttctcaaataagtaaaaatagaactaccgtttgatccagcaatcccactaataggtatctacccaaaagtaaaaaagccattatataaaaaggatacatgtacttgtatgtttattgcagcactatattagtccgttttcacactgctgataaagacatacctgagactcaacaatttacaaaagaaataggtttaatggacttacagttccacgtggctggggaggcctcacaacgatagcagaaggtgaaagacacatctcatgtggcagcagacaagagaagagggcttgtgcagggaaactactctttataaaaccatcagctctcctggtaccatttcttctgaaactattccaatcaatagaaaaagaaggaatcctccctaactcattttatgaggcaagcatcatcctgataccaaagcctggcagagacacaacaaaaaaagagaattctagaccaatatccctaatgaacatcgatgcaaaaatcctcaataaaatactagcaaaccaaatctatcagcacatcaaaaagcttatccaccatgatcaagtgggcttcatccctgggatgcaaggctggttcgacatatgcaaattaatacatgtaatccatcatttaaacagaaccaaagacaaaaaccacatgattatctcaatagaagcagaaaaggccttcaacaaaattcaacagcccttcatgctaaaaactctcaataaactaggtagtgatggaacgtatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaataaaaggtatttgattaggaaaagaggaagtgaaattgtccctgtttgcagacaacatgatgtatatttagaaaaccccattgtctcagccccaaatctccttaagctgataagcaacttcagcaaagtctcaggatacaaaatcaatgtgcaaaaatcacaaacattcctatacaccaattacagacaaacagagagccaaatcatgagtgaactcccattcataattgcttcaaagagaataaaatacctaggaatccaacttacaaggaatatgaaggacctcttcaaggagaactacaaaccactgctcaataaaataaaagaggacacaaacaaatggaagaacattccatgctcatggacaggaagaatgaatatcatgaaaatggccatactgcccaaggtaatttatagattcaatgccatccccatcaagctaccaatgactttcttcacagaaattgaaaaaactactttaaagtccatatggaaccaaaatagagcctgcattgccaatacaatcctaagcaaaaagaacaaagctggaggcatcatgctacctgacttcaaactatactacaagactacagtaaccaaaacagcatggtactggtaccaaaacagagatatagaccaagggaacagaacagagccctcagaaataataccacacatctacaaccatctgatctttgacaaacgtgacaaatacaagaaatggggcaaggattccctatttaataaatggtgcttggaaaactggctagccatatggagaaagctgaaactggatcccttccttacaccttatacaaaaattaattcaagatggattaaagacttaaatgttagacctgaaaccacaaaaaccctagaagaaaacctaggcaataccattcaggacataggcatgggcaaggacttcatgactaaaacaccaaaagcaatggcaacaaaagccaaaactgacaaatggatctaattaaactaaagagcttctgcacagcaaaagaaactaccatcagagtgaacagacaacctacagaatgggagaaaatttttgcaatctacccatctgaaaaagggctaatatccagtatctacaaagaacttaaacaaatttacaagaaaaaatcaaacaactccatcaaaaattgggcaacagatatgaagacacttctcaaaagaagacatctatgcagccaacagacacatgaaaaaatgctcatcatcactggccatcagagaaatgcaaatcaaaaccacaatgagataccatttcacaccagttagaatggcgatcattaaaaagtcaggaaacaacaggtgctggagaggatgcagagaaataggaacagttttacattgttggtgggactgtaagctagttcaaccattgtggaagacagtgtggcgattcctcaaggatctagaactagaaataccatttgacccagccatcccattactgggtatatacccaaaggattataaatcatgctgctataaagacacatgcacatgtatgtttattgcgaaactattcacaatagcaaagacttggaaccaacccaaatgtccatcaatgatagactggattaagaaaatttggcacatatacaccatggaatactatgcagccataaaaaatgatgagttcatgtcctttgtagggacctggatgaagctggaaaccatcattctgagcaaactattgcaaggacagaaaaccaaacaccacatgttctcactcataggtgggaactgaacaatgagaacacttggacacagggtggggaacatcacacactggggcctgtcgtggggttgggggatgggggagggatagtattaggagatatacctaatgtaaatgatgagttaatgggcgcagcacaccaacatggcacatgtatacatatgtaacaaacatgcacgttgtgcacatgtaccctagaacttaaagtataataaaaaaaaagaaaagaagaaagaccatcaaaaaaataaaataaataaaaccatcagctctcgtgagacttattcactatcatgagaacagcatgggaaagacccacccccatgattcagttacctcccaccaggtccctcccaccctcccacaacatgtaggaattcaagatgagatttgggtgtggacacagccaaaccatatcaagcactattcacaaaggcaaaggtatggaattaacctgaatgtccgttaatggatgactaaataaaatgtagtacatatgcaaaatggaatactattcagccataaaaaataataaaattgtcttttgcagcaacatggatgtaactgaatgccattatcttaagtgaaacaacagagaaacagaaaagaaaatgccacatgttctcacttataagtgggaactaagtaatgtgcacacatggacatagagtgaggaatgataaatatcagagacttggaagggtaggaggggagtgagggatgagaaattatttaatgagtacaatgcacattattcaggtgatggttaccctaaaatcccagacttcattactaggcaatatatccacataacaaaactacacttgtacctcatatatttatacaaataaaaagaggaaaagaaaaaaattcacaatgactttccagcaacagatcccaatcaaaaagatattcacaaaatcccagataacaaattgaaaatacaaattttaaagaagctcagcaagataaatgagaaatctgaaaaacaaaaataaatcagaaaaacaattcaagatatgaattagaaatttttcaaatagatatttttttaaaaaagaacccaacaaaaattctgaaactgaagaattcattgaataaaatataaaatacatttgaaagttacaacaatagattaggtcaagcagaagaaagaatttcagaacttgaagacaggtcttttgaaataatccagtcagaaaaaaaaataaataaaaaagaattaaatagaatgagcaaaaccttcatgacatttgggataccataaagtgatcaaatctttgaattatcagtgttctcaaggctgaagagagaacaaaatgatggaatcctatttaatgaaataataggtgaaaaattcccaagtctagcaagagacttcgacatccatatgtctatatggggctcaaacatccccagaaatacaatgcataaaggttttctccccaccacattatagtcagtctctctaaagtcaaagataaaacaggattctaaaaatagcaagagaaaaatgtctagccaccaataaaagaactctcatcagactaacagcagatttctcagcagaagtcttacaggacaggaaagaatgagatgatgtattcaatgtcctgaaagaaaaaaaaactgccagccaaggatactatccccagcaacgttttcactcataaatgaagggaaatttatgatttccctcataaatgaagtctttttcagagaagcaaatgctgagagaattttcaccactagatgagtcctacaagaaatgctcgagtcttaaacctgaaagcaaaatgacagtatttaccaccatgaaaacaaacaaaagtataaaacccactagtaaaccctacacacaaatgaggaagagaatggactcaaatgataccactacagaaaatcaccacaccaaaataacaaacaataagagaaaacaaaaggaacaaaaaatatacaaaacaaccagaaaacaattaacaatatgataagaacaaaacctcacatagcagtgataaccctgaatgcaaatggactaaattctccacttaaacatatagactggctgaatggattttaaaaacatggtccaactgtatgctgcctccaagaagagcactttacctgcaaggatacatatagacaaagggggataatgaagacattacatgcaaatggaaactaaaagtaaacaggagtagctatacttagataaaacagactttaggtgaaaaacagtaaaaagacaaggtcattacataatggtaaattaatcaagcaagaggatataaattatacacacacacaaacacacacacacacacacacacacacacacacacacatatatatatgctttatgaatctgtgtgctccatgaaaataaacaaaatgttttgtatgtttggagtacatatatgcactcaatcctggagcacacagatttgtaaagcaaatattgctagatataaagggagagaaagattccaacacaataataatggggaactttaacagcccactctcagcattagacagatcatctagacagaaaatcaacacagaaacattggatttaaactggtaaactgatccttagaccaaatggacctaacagatattaaagaaaatttcatccaacaattacagaatgcacattcttcccacaggcacatgagacactcttcaggatagaccatatgctggctacaaaacaagtctcaacaactttttaaaaactgaagtcatatcaagtatttcagaccaaaatggaataaaattagaaatcaatagcaagaagaactttagaaactgtaaaaatccatcgttattgggccaggcacggtggctcatgcctttaatcccagcactttggggaggccgaggcgggcggatcacctgaggttgtgagttcaagaccagcctgaccaacatggagaaaccccgtctctactaaaaatacaaaaaaattagccaagcatggtggtgcatgcctgtaatcccagctactcgggagcctgaggcaggagaattgcttgaacctgggaggcagaggttgcagtgagtgagatcatgccattgcactccagcctgggcaacaagagcaaagctccgtctcaaaaaaaaaaaaaaaatccatggttattaaacaaaaagctcctagatggcattgagtcaagaaataaattagggagagcaaaaaatttcctgaaacaagtgaaaatgaaaacaacacatacgcaaaagtacagggtacagcaaaagcagtgctcagaggaaagtttatagcaataaatggctacatgaagaaagtacaaatatttcaaataagcaacataacaacgcacttgaaggaactagaaaaatatgaacaaaacccaaaattagcagaaagagaaaaaataataaagataagagcagaattaaacaaaatagagactcaaaaaatacaaagatcaacaaaatgaaaatttggttttttgaaaagataaacaagttttataaacaactcactaagcaaatcaaaaaagagagaagacccaaataaacaaaattagaaatgaaaaaggagatattacaactgataccaaacagaaatacaaaagatcatcagagactattatgaacatctatacactaacaaagtggaaaacctacgggaaatggataaatcccttgacatacacaatgtgtcaaagttgagtcaggaggaaatagaaaagctgaacagatcaataacaagtagtgagattgaaccagtaataaacagtctcccaaagaagaaagctcaggaccagatggattcacagatgaattctatcaagtgtataaagaacaactaatattaaccctcctgaaactattctaaaaaattgaagaagagagaactatccctaactcatttaatgaggccagaattaccttcataccaaaatctggcaaagacacaacagaaaaagaaaagtaaaggctgatattcctgatgaacacagatgcaaaaatcctcaacaaaatactagcaaacaaaatccaacagcacatcaaaaagataatacaccacaatcaagtgagatttatcccagggatggaaggatggttcaacatatgtaaaccaatatatgtgctacaacccatcaacagaatgaaggacaaaaattatatggtcatcttaatagatgcagaaaaagaatttgataaaattcaacgtcctttcatgataaaaactctcaacaaactagtatagaaggaatatacctcaaaaacataaaggtcatatataacaaacccacagttaacatcataccaaatggaaaaaagctaaaagccttacctctaagaaatggaaaaagacaaggatgcccactttcaccactcctgttcaacataatactggaagtgctagccagagcaaccaagcaagagaaagaaataaaacgcatccaaattggaaacaaggaagtcaagtcactctctttgctgatgatatgatcttatatctaaaaaaatctagagactctactaaaaaactcctacatttgataaataaagtaacattttaggatacaaagtcaacatacaaaaatcagtagtgtttatatatgccaacaatgatctagccaagaaagaaagcaggcaatcccattgacaatagctacaaaaaataaaatacttgggaataaatttaatcgaggtgaaaaatctttacagaaaaactaaaaaatactgacaaaagaaatttaagagaacagaacaactggaaaacatcccatgcttaagtattggaataattaatattattaaaatgaccaaattacccaaaccaatctacagattcaatgtgatccctatctaagaaccaatgttattttacacagaattagtgaaaacaatcttaaaatttgtatggaactaaaacagagcccgagtagccaaagcaatactaagcaaaaagaacaaagatggaggcatcacattacctgacttcaaattatattacaaggctatagtgtctaaaacagcatggcattggtataaaaacagatgacacatagacaaatggaacagaatagagagtctagaaataaatccatgtacttatatccaactgatttttgacaaagataccaagaacatatactggtgaaaggaaaccctcttcaatagatgattctgagaaaatgggagacctgtatgcagaagaataaaactggacctctttctctctccatataaaaaattaagtcaagaaggattaaagtcttaagcatgacccaaaccgtttaagcagtagaacaaaacacagagaaaacattggtctaggtaaagatttcatggctaagacatcaaaggcacaattataataaaaacatacaaatgagactttattaaactaaagagcttttgtacagcaaaagaaacaatcaacagagtgaagagacaacccattgaatgggagaaaatatttgcaaattattcatccaacaagggactaatatccagaatctagaaggaactcaaagaactcaacaataaaaaaaaaaatcccgttaaaaagtgaacaaaggatatgaatagacatttctttttaaaatacatacaaattgccatcagctgtaggaaaaaaatgctcaacatccctaatcatcagggaaatgcaaattaaaaccacaatgagatataatcataccccagctaggaagcctattatttaaaaaacaacaaatgaacaaatgttgatgaggatgtggataaaagggaactctcatctgctggtggaatgtaaattagcacaactatggaaacagtatggaggatgtttcaaaaaactaaaaatagaattaccatatgatctagcaatcctataatagtactgggtatttatctaaaggaaacaaaatctgtatatcaaaagaatacctgcacttacatgtttataacagcactattcataatagcaaagatatagaataaacctaagtgtctattgaagaatagataaagaaaaatttggtatatatacataatggaatactattcaccataaaaaagaatgaaatcggctgggtgtggtggctcacgcctgtaatcccagcactttgggaggccgaggaggggagatcacctgaggtcaggagtttgagacctgcctggccaacatggagaaaccctgtctctactaaaaatacaaaaattagctgggtgtggtggtggacacctataattccagctactctcgggaggctaaggcaggagaattgcttgaacccgggaggcggaggttgcagtgagccaagatcacaccactgcactccagcctgggtgacagagtgagactctctcaaacaaacaaacaaaaaaacaatgaaatcatgtcatttgcagcaacatggatggaactggagttaagtgaaataagccaggaacagaaagacagatactgcatgttctcactaatttatgaaaggtaaaatcactgatttcatgaagatagagaccagaatgatagatattagaggtcgagaaggatgtgtggatgggagaagtgatatagaaagattggttagtgggtaccaacatacagttgaatagaataaataagttccaataatctataccagagtgactacagttagcaacaatgtattatatattccaaagtagctaaaagagaggacttgaaatgttaccaacacatagaaatgataaatattcaaggtgatggataccccaaataccctgacttgatctttatccatcctatgcatgtaacaaatactcatatgcaccccaaaaatatgtaaaatattttgtatcggtaagaaaaagaagaaaatgtcaaccgaaaattctatttgcagcaagactgtacttcaaatgaaggtaatataaagacattcccaaatggataaaaattgagagaatttattactagtagaactcctgtacaaaaatactaaagaaagttccttgggctgaaaggaaatgacaccagatggtaataaaataatcacaaagtaataaaggtaaagattattacatgggtaaatataaaacatggtacatacgtgtacatacacatgtacttctgtttcctttgcttaactgatctaaaagacaattgtataaaacaataatttatgaaagtgtatggttggtcttacaacatataaagctacaagatacatcatacttaccaaaatatgtgtggataaaatagacctatattggagcaagaaaatgatgccattgataacatgcatcctcagaaagaattgaagacaaccataaatgataaatatataaattaatctaaaagactttataaatgtattttctcctttcttccatctcttctttaaaaacataattttacaaattcataattataactgtatttgggggtttatatcacatatagacataatatacattactttaataacataaaagaaggtagaaaatggagctcttctgaagtttctacgtgctactgaaatgaagtcagcattaatcttctgtaaactgtggtaaaataagatgcacattataaaccctagagaaaccagtaggaaaataattaaaaatatacatgtatatgataaagacatcaaaaattaattataacagtatattagaatatagctatttaacacaaaaaactagagcaggaagaacagaggaacaaaaagacagggtatatgtagatgaaaaatagtaaactggcaggcagaaattgaaacagactaaatgtaaacagttacattaagtataaaataattaaacattcaaatcaaaagggagaaactatcaggctggattttaaacactagatgaaaaaatatatatctaactatactatgagagacacgctttacagtcaaagaaacaagctaaagggaaaggatggggaaagatataccaggtaagccttaaagagagctagagtgactacactgttattatactaaatagactttttaaaagagaaaaattttataattcagtaattcaattcctcagggaaatgtgaaaagtaaaatgatacatgcatctaacaaatagagccccatggtacatgaagaagaaagaaactgatagaattaaagaaagaaagaaataatgcaacaataatagatgaaaacctcaaaatcccactcttaataatggatataacaaaaagaaaatcagtgaagaaataaaagacttagacaacactatatacttatggactacctgacatcaatagaacacttcactccaaaacgcacattcttttaagcacacatgtaactttatacagaaaagacaatatgcaaggtcataaaataattccccataaatttaaaagactgaaatcataaagcatgttctctaatcacaatggaattaaattagaatcaatagtagaaagaaatttgggaaatccacaaatatttaaaaattaagaaaaacatataaataatccatgagctaaagaagaaaccaaggggaaattttttttgaactgaatgaaaataaaactaatataccaaaatttatggaacacttcacacctattagaatggctattatcaaaaagactaaagataacaagtgtggtaaggatgtggagaaaagggaacccttgtacacttttggtgggaatgtcaattaggatagccattatggaaaacattgtaatggttcctaaaaaaattaaaaatggaattaccatttgatccagcaatctcacttactggtatagccaaaacatataaaatcagtctgttgaagagacatctgcacccccatgctcactgcaacactatttactataatcaagatatgaaatcaacctaagtatccatcaataggtgaaagtgtaaagaaaatgtggtatgtatacacaatgggatactattcagccttaagaaagaggaaaatcttgtcatttgcaacaacatggatgaacctggaggatgttatgttaagggaactaagccaggcacaaaatgacaaataccaccttatctgacttatatgtgtaaactaaataacttgaactcatagaagcagagaataaactggtgcttctgaggggctgggtgcaggggaggggactggggagatgttggtcaaatgataaacaatttcaatttgacaggagaaaggagttcaagacacatggtgactatatttgataacaatgtactgttattagcaagatgtcaaaataggagattccaggctttacttctctccatagaaagtgcaactagcaactatcaacagaccaaaacatctttgtgaaaaccccaaaacttgggaaaagcctgagacacccatgtggaccacagaactaaataaaaacccattagaaggataagaggaatgatcccactttgacttcaaggcatctcctactcccctaagttggcacagtgccatacagagacagttctcctgggcttacagtttctacagtgggaaaagagaaccagaggcagacaactagatttctagcattccaagatgctccccaggaagcccactctagtctcacctcatggggaacagaaagaataatgacacagctagactgccttgggtcaagtagaaacaaagaaaggaggcagagctcataaccaccagtgtgtgaatcttggtgatagctctgggctcctgctagcagtggtgccctgtcagatgtaccagccaatggcatagcccacccacaaagtagagctgattgctcccagaagcacagtgggaagttcaatctggcttaagtctctaggatggccagcctccatgcccagcctcagactccccaaggccccttccagggagagagttgcccatcacagcacattttggcaaagcacaggggctaggcctgcccccatctgggagaacaaacagcagcttggctcagccacaaaccccatctgaaaaccccacccagacagggaggcaaacctcaactatgcatttctactgagcatagaagatactcccaaccatcccaagcagcaactctgcctaatcttggagaccagcctgcacccctggcccaaccacagaaatcaaatggtggtaatgcccagccaaggaatacaccctgtgatccagcctgatcagaggtgattgtaaagcccagccaacaactctgcctgatttcagagctcagccagtgatgccataagatattgaagcccagccagcagcctcatatgacctcagagcaaaggcagcagcccaccaagctagaaaatacaacagcaagctctgacttcccaggcttgttaccagatggccccgtccagtatcacaggctagacaatagtgaaggtccatccctgccaaagaactcctgtaaaggttggaagaggtggttgcctcctcaaatgtaaagacaccaacataaagaaacaagaattaagaagaatcaaggaatcattacatctccaaaagaaactaataaaactccaacaatgggtcctacagaaatggagatctatataatgactgacaaagaattcagaataatcctctttaaaaagttcagtgaactacaataatatatggataaaaaattaaatgaaatttggaaaacaatacatgaacaaaataagaaggctgacgaagaaatagaaacaattttttaaaaataaaaatcttagagatgaagaactcaatgaatgaactgaaaatttcaatagaatatatcagcagcaggctctataaatccaagaaaaaaaaaacaatcagtgagctcaaagacagaacatttgaaataatgcagtcagagagcaaaaagaaaaaagaatgcagaaagcctatgagaattatggaacaccatcaagagacttaacatttgcataataataatacatgaagaagaacagagaggaaaagagccagaaaggctatttaaggaaataatggctaaaacctttccaaatctgggggaagatgccaaaagtctggcaaaggaagcatacagacctgcaatcaaattaaacccaaagaggagctcaccaagacacaataatcaaactgtcaaaattcgaagacaaataaaaagttctgaaagcatcaagatataagaaacacatcacatacaagggaatatcaatatggctatcagcatatcagatgttttagcagaaactctgcaggtcaggagaaaatgggatgataaattcaaagtgccaaagtggggagggggaaacccagcaaccaagattactttaactggcaaatctgtccttcaaaaatgaggaagcaatttttaaaaaaaagaaaaaaatgagggagaaggaaaagctttctcagacaaacaaaagctaagagagttcatcaccactaggcctgccctgcaggaattactaaagggagttatttaagctaaaacagaaggccactaattaataacataaaacatatgaaaatgcaaaacttaatggtataagtaatacagttacatatagaataggagtataatgatggtgtgtaaagcaattttacctcaagtacaatggctaaaagtcaaaactatgaaaaataactataattaaaataaattatcaagggatataaattacaaaatgctgtaaattttgacaccaaaaccaaaatgtgtgtgttcaggggaataaaagtgtagagctatatgtgataaaagttaagttcttatcagcttaaattcacctattataagatgttttatgtaagccttatgataacaacaaagtgaaaaatctatagtacagctgactcttgagcaacatggtttgaactgcatgggtccacttatacacagaattttttcaacatatttgaaaaattttttgaaatttgcaacaatctacaaaaacttacaaaccatgtggcctagaaatataaaaatttaagaaaagggtatgtcacgaatgcataaaatatatttagatgctagtccattttatcatttactaccacaaaatatatacaaatatgttataaaaagttaaaatttgtcaaaatttacaaacacagactgtacatgatgccattcacggtcaagataaatgtaaacaaatataaagatgcagtattaaatcataactgcataaaatttactgtagttatactactataataatttcatagacacctcttgttgccattgtgggtgggcttaggtattatgagtatccacctaaaaagctgtgtgatgctaatcatctccacaagagcagttcatgtctgcagtaaattgcatatcatagtaagaagtgatctctcatgattctcacatatttttcattgtatttagtgcaatgccataaaccttaaacatcatgggatccatacaaagtgccacttgtgatgttggaagtgcttccaagaagcagagaaaagtcatgacattacaaggaaatgtttagttacttgatatgtactgtatgtagattgaggtctgcaactgtggttgtccaccatttcaagataaataaacccagttaaggaccattgtaaataaagaaaattcatgaagctgtggctgcagctatgccagcaggcacaaaaaccttgtaccttttgtgaaatacctttttatctcattttgaaaatgtagtttttatatgggtacaggatttctatgagaaaggcatacctatagattctaatatgatttgaggaaaactgaagtgattatatgacaagataaggcaaacgaaaaggtgaaggatctaaagctggaaaatttaatgccagcaaaggatggtttgacaatttcagacagaggtttggcattaaaaatgttaagagaagcagcttctactgactaagaggcagcagatgatttctgagataccattaagaaaatcacccaagagaaaggctatctatatgaacaaggttttaatgttaataaatgtgccctatactgaaagaaagataccatgaaggacatttattagtaaggaagagaagtgaatatcaagatttaaggcaggaatggataggctaactctaccgctttgtgcaaatgcagtcaggtttatgatcaggattttccttatctataaaactgctaatctccgagctttgaagggaaaagataaacaccagttgtcagtattttgattgtacaacaaagcctggacaacaagaaacctttttctggattggtgccattgatgctttgtccttgcagtcagaaagtaccttatcagtaagatactgacttttaaagttcttttgatattggacaatgtccctggacacccagaacccccatgagttcaacaccaaaggcgtttaaggggtctacttgcctccaaatacaatgtctctaattcagtccctagatcagagggtcataagggcctttaaggctcattacacccagtactctatagaaagaattgtcaatgctatgaaagagaaccccaataaagagaacatcatgaaagtctggaaggattacaacattaaagaattcccccatgtgtatcaaaagaaagaaatgaggctattttgacatgacttattcttaggaacctcagtcagttgcccaatacactgtcccctaaatgctaacattatctaatactttcaagggttgttgtccaacttctcagaatttactcttcaaaatatatgtttgtcagttccccaatcttttggcgcctcttatgttttctgtagtttccataattcctgacagtgactatactcaggaatacatttcttctaagtatacgaactcattgaaataggctcagtgtttctttttttttaaattctattattattatactttaagttttagggtacatgtgcataatgtgcaggtttgttacatatgtatacatgtgccatgttggcgtgctgcacccattaactcgtcatttagcgttaggtatatctcctaatgctatccctcccccctccccccaccccacaacagtccccagtgtgtgatgttccccttcctgtgtccatgtgttctcattgttcaattcccacctatgagtgagaacatgcagtgtttggttttttgtccttgcgatagtttgctgagaatgatggtttccagcttcatccatgtccctacaaaggacatgaactcatcattttttatggctgcatagtacacatgaaaaaatgctcatcatcactggccatcagagaaatgcaaatcaaaaccacaatgagataccatctcacactagttagaatggcgatcattaaaaagtcaggaaacaacaggtgctggagaggatgtggagaaataggaacgcttttacactgttggtgggattgtaaactagttcaaccattgtggaagtcagtgtggcgattcctcagggatctagaactagaaatgccatttgactcagccatcccattactgggtatatacccaaaggattataaatcatgctgctataaagacacatgcacacgtatgtttattgtggcactattcacaatagcaaggacgtggaaccagcccaaatgtccaacaatgacaggcttagtgtttcttaagcatttttttacctaagctaatacaagttgagtattccaaattcaaaaatccaaaatctgaaacattttgagcactgacatgagctcaaaggaaatactcactggagaattttggaatttggatttggggattaaagatgctcaactggtaagcatgtaatgcaaatattccaaaaaaaacaatctgaaatgcttctagtcccaagcatttcagataaggaatactcaacctgtacattcttcaaaataaaatccttttcaaaaaaaaaaaaagatgccatcattgttatagaacaaggcatgaaagccataaagccccaaacaataaatttctgttggagaaaactgtgtccagatgttgtacatgacttcatagacttatgacagagccaattaagttaatcatgaagtagattgcacatatggcaaaagcaggtggaagggtgaagggtttcaagataggaatattggaaaagtccaagagctaatagataccatgccacaggaattttaaaattttaaaatgacgacttgatggagatgagtgcttccgaaccagtgccagattatgagaaagaagatgtagatgaagcagtgccagctataaagacacatgcacacgtatgtttattgcggcactattcacaatagcaaagagttggaaccaacccaaatgtccaacaatgacagactggattaagaaaatgtggcacatatacaccatggaatactatgcagccataaaaaatgatgagttcatgtcctttgtagggacatggatgaagctggaaactatcattctcagcaaactatcgcaaggacaaaaaaccaaacaccgcatgttctcactcataggtaggaattgaacaatgagaacacatggacgtaggaaggggaacatcacacaccggggtctgttgtggggtggggggaggggggagggatagcattaggagatatacctaacactaaatgacaagttaatgggtgcagcacaccaacatggcacatgtatacatatgtaacaaacctgcacgctgtgcacatgtaccctaaaacttaaagtataataataataataataaagaaattgacactagacaatacagaagaagggttctgattattcaagactgcttttttacttcttttacaatatggacttttctatgatatgggcactgaaactaaagcaaatggtggaataattggtaccatataggaacatttttagagaaatgataaagcaaaaaatacagacagaaattatgatgttcttctgtagttacaacgagtgttcctgcctctcctgcctcccgttccacctcctccaccccttccacctctgccactcctgagacagtgaggtcaacccctcctagtcctcctccttctcagcctactcatcttcacataagaatacagtatataatatgtataacataaaaagtatgtgttaattgactgtttatgttatcagtgaagcttctggtcaatagtaggctattagtagttaagtttgggggaataaaaaattacacatggattttcgactgtgcaagagtcagaagccctaacccccacattgttcaagtgtcaactgtacttccatattatacaaactcttcctgagaacaaataaagagaaaatactcccatactcatgtttaaggcaagtataatctttatatcaaaatcaaaccaagacaacacacttacagaccaatctcactcacaaacatgcttgtcaagaacacaaacaaaatatattagcagaacaaatccaagaaaaaaagtaaagacatgaatcatgttcaaggttgcttaaattttagaaagtatattatagaattcaacaaattaataggtgatagaagcaaaatacactcacttcaacatgttcagaaaaaaatagataatatatccattcacaatattttaaaagtctctcagtaaattaggcatagaatggaacttccttagcctgttaaggggtactaaaacataacaaacatacttaacagtaagatataaaagcatttccatttatttattgatagtgagacaaaaattgatacaaccatgttgaaaatgagtttgacgttttttatctagtagagttgaggatatgcatacactttatcctaaagtagtggttttcaacaggcatcttgccaccatcaaccggcatcttgccatgtctagggagtgtgttggaaatgtgtatggggcaggttggttatcacaatgattggaggggaattattgacatttagtggcatcagagatattaggcatcctgaaatgttcaggacagtcccaggcaatggagaatcctgcctaaactttttaatattaaccttgacatgcctacaaatgaaaaacctgtttataattaccagaggccagaacctacctccttttgttacatataaacatggtatttttgcatgaatttactatatactgaattttctaggagtaaatctaccaagtaaattgagagaacagtatattttcttttgttcagaaatttatccaaaataatttttttagaaaatcatgtcaccaatgataattacactttgtggtattatatttgtagccgtcacattcatggcgatcaatgtataggtgtaaatatttggctacttcaggtagtcatgtttcagcatttacatatttaaatacattattataaatcactcgcatttaatttttcctttaaattctagttaggacattgtgctcatattttaaatatgtgtataggtaggttatgctatctatgaatttcacttctggttaataaagaaattggtacaaaatatttgttacaaaaagggaattggtagagtctttcaagatggctgactagaggcacaagacacttgactcctccacaaagaagaaccaatcaactgggaacgaccaacatcacagctgacaaaagttgcaatactagttgaagcaaatgagaccagcctaaaatttaacagagtaatctactgcacgagacagctatactgggctttaaataaggtcctacatatccctaggggtctccaagtctgtgcacatgctcgggagaaactgaacagtgcctcacttatctactagtctttgcctaaatgtgtggtgttatacagtagcaagtaatagcaaaggtagatttctaaactgcgtgaatctggaatgtacgccccagcccacacatggatactttcagcaaattgtggaaccctcactggcagaaggtgtttaagcataacatatgaacaatcactggatgaccactaaaatatggcccagcagtgaccccctggaagctagcataataacaacaacaaccaaaaaaactgagtaaaagcatcagaggccacaccctgtgggggaggccagaaggcagtggaatagcaaaatgctgaaagaaaaatacccaaaattttcaagtaagaattctatatccagcaaaattatccttcaaaaatcaatgtgaaataaataaattccacaatacacaaagacagagaattcattgctaacagacctaccctacaaaaaatactaaagtccttgagctaaaaggaaatgacaccagatggtaacttgaatccataggaagaaataaagaggattagtaaaggtaattatgtaagtaaacataaaagagaaaatacatacttttcttactttcttttaaaggaaaactacataaaacagtatttttaaaactgtgttgttgggcttataacatattaagatgtaaaatatactgcattaatagcacaaaggatgggtggagaaaacttccctgtgttgctgaaattaaattattattaatctaaagtaggttatttcaagttgacatacatattgcaatccccagagcattcaataaaaaagctctagaaattacagtaaaaacatcaaaaaaggatttaaatggtatgcaagaaattagctatataacataaaagaaggtaataaaggagaaacggaggaacaaagaagtcaagaaacattaatgaaataaatgaataaagccagatgtacatctataagtataaatgggttaaacagtccaatcaaaacaaacattgtgagactggatgaaaaacacactccaaggatatgccatctacaataatggaaagacacactttaaatgtgaagacataaacaggttaaaagaataaaagaatgaaaaaattgtattaaaaaaaagagcaaccataaaagagctggagtggttaaactgatatctagtatcagacaaaatggactttaagaaaaaaatgttatagaaaaagaaggacattttataatgatgaaaggttctattcatcaggaagatatgtaactataaacatatacacatctgacaacaaaactctccccaactaattctatgaggctggtctctgacatcaaacaaaacaaatacattataagaaaagaagcctacaattcaacttcccttatgaatacaaatgcaaaattccttaacaagatgttagcaaatcaaatccaccagtatttcaaaaaggattatatatcatgacaaagagagatttattccaggaaggtaaggttcgtttaacacccccaaattaaggtaataccctatgttacattagttaataatgtattgtgtagaataaaggacaaaaaccacatgatcatttcaatagatgcagataagccatctgacaaaatctaacagtcattcatgatcaaacataaaaacttaaccaattagtaaaacttcctcaacctgataaagaacatctacgaaaaatgcacagctaacatcacatttagtgatgaaggattgaatatttcccctaagaccagaaaaaaaacaaagatgttcactcctgtcattcctattcaacattatactggagatgctagccaggggaattaggcaaggaaaacaagtaaaaggtatccaggctggggaaaaaaaataagtcaaactgtccttgacataatcctgaatgagaaaaccctaaggaatatacccacacactcacatgcacacatacacatggacacacacacacacaatattaaaactaataattctactcaacaaagtcacaggataccaaatcaacatgcacaaagtcaatttgtatttctatacacttgcaaaaaatcataaagtgatattataaaaaataattcacaatagtaccaaaaattaaatacttgggaataaatgtaacaaaaaagtaaaagatttttacactgaaaactacaaaacattgttgaggaaaattaaagaagatctgaataaatggagaggtatttcaagttcatggattgaaaaatccaatactgttagttggcagttctccccaaactgatgtatagattcagtgcaatcgctaccaaaatcaaagcagaggctgggcatgatggttcatgcctataatcccagtactttgggaggccaaggcaggaggatagcttaagcccaagagtttgagaccagcctgggcaaaatagggagaccacatctctacaaaaatattgttaaaatagccaggcatagtgatgcacatctgtagtcccaggcactcaggagactgaggtgggaggatcgtttgagcctgggaggttgaggatgcaatgagctgcaactgtgtcactgcactccagcctgagcaacagagcaagaccctgtcgaaagaaagaaagaaaagaaagaagaaaagaaaagaaagaatgaaagaaagaaagaaagaaagaaagaaagaaagaaagaaagagtgacaagatgatcctaatatttatatggaaatggaaagaacccagaatacccaaaacaatgttgaaaaagaagaacaaaattttaggattcacctttctcaatttaaatacatattacaatgccacaatagtcaagacagtagggactggcataagaatagaaatataaactaatggaacacaattgagaggtcggatataaacccttatatttatggtcaattggttttcaaaaaaggttccaagtcaattcaacaggaaaaggttagtttttcaacaaatgatgatagtacagttggatatccatatgcaaaaagattaatgaagaccttcaccttacaccatacacaaaataacacagaatgaatcagagtcataaacgaaagacgtaaaagtataaaacttttagaaacataggaaaaccttcatgatattggattgggcaaagaattattagatacaacatcaaaaaacacaattgacaaaagaaaaaaaataacttggactttatcaaaaataaagaaccgagagcccctctgccactgccattgcagcagctctgtccttgctgccctaagactggggaaggaataaagagcctgagggatttacttgcacctccaacatgccacagttgccatacagaatagagccaagtctctcatctctgtgagcctccaaccccctggtcttcaccaagcagggcccctggcttgggcccacagaacagctgccctacctcgtggctgaacatacccattgtcagtggctctgtgttgctctggggtggagctcccagaggcaaatgaaatgccctctgagactgccactgcagtggtactgcctttgctgcccttggattggggaaggaacaaagaccctgagtgctgtactcatacctccatcatgccacagccaacctaagaagaggctagtctgtcttccctgtgagctcccttctccccctccccattcatcaccaggcagggctccctggctcgggcccacaatgcagccactccaccccaggatgaatgctccaaatgatagtagttctgcatttctctggagtggagacccaaaagacaagtgaaaggccctctgcaattgccactgccaaggtccctgcccctgctgctcccaagctggggagggaacacaaagcctgagctcatctgaaggctgcatgtgaagcccaagagtgtcaagccaagctctgcagccagcactcaagtgggagaggagcccacaccctcagagcaccaagagggagcatggccgcaaacacaaggaaatagaggagtcatgtggctgagcaagagcctacctaatggccattacacttaagcaccatctactggatcacagcccaaattttgacaccaaaaatacttacctaatatatccctctgtgaaacgaagaacaagaattcagctacaaataaagaccccgcacaaagctccagcactctgacaatgtccagaaatgaggtcaactgactatactcaaatcacaccacagttaaagaaacattagcccacacacaggagaaagaaccagcacaagaactctggcaacccacaaagccagagtgtcttttttcctccaaacaacactagttccccagcaaggattcttaaccaggctgaaatggctaaaatggcagatatagaattcagaatgtggataggaattaagatcatttgagatccatgagaaagttgaaactgaatccaaggaatttaaggattataataaaacaatacaggagctgaaagatgaaatggccattttaagaaagaaccaaactaatatgatagagctgaaaaacataatactgtccatgaaaatttcccaaacatcactagaaaggacaacattcaaattcaggaaattcagagaacctctgcaagaactatacaaaaggaccatccccaagacacatagtcatcagatgctccatcaagctaacagcgacctttcagcagaaatcttgcaagtcaaaagagattgggggcctagattcagcattcttaaagaaaagaaactccaaccaagaatttcatatccagccaaactaagcttcataagcaaaggagaaataagatcttttttttagacaagcaaatgctaagggaattcattaccatcaggcctgccttacaagaggtccttaagggaatgctaaatatggaaacaaaagactattactggccaccacaaaaacacacttaaagacataggccactgacactataaagcaaccacgtgatcaagtgtacataataactagctaacaacatgatgccaggatcaaatctgcacatatcaatattaatcttaagtgtaaatgggctaaatgccaaaattaaaaggtatccaacggcaaattggataaagaagcaagacccggtggtatgctgtcttcaagagtcccatctcacatacatcacatacaatgacacccatagactcaaagtaaatggatggagaaaaacctacaaagcaaacaaagaacaaaaaaaagcagggattactattttaatttcagacaaaatagacattaaaccaacaatgatgaaaaaaggcaaagaaggacattacaaatggtaaagagtcaacaagaagacttaactatcctaaatatatatgcacccaacacaggagcacccggattcataaaaccagttttcagagacctatgaagaaacttagataactatacaataatagtgggagatttcaataccccactgacagtattagacagatcctcgaggcagaaaactaacaaagatatttgggacctgaactcagcatttgatcaagtggagctaacagacatctacacaacaatccacccaaaaacaacagactatacattcttctcatctgcagataacacatactctactgaccacacagtcagccataagacaattctcagcaaattaaaaatttttaaaaccaacaaaaacaaaaatcataccagccacattctcagaccacagcacaataaaaatagaaatctataccaagaagattggtcaaaactataaaattacatggaaattaaacaacctgctcctgaatgacttttgagtaaacagtgaaattaagtcagacatcaataaattcttggaaactaatgacaacaaagatacaacatgtcagaatctcaaagacatagctaaaacagcatcaagaggaaagattatagcattcaatgataaaaaaaatgaatgaaatcaatgaggctggttccttgaaagaataaataagacagatggactgctagctagactaacaaagaaaaaaagagaagacacaagtaaccaaaaacagaaatgataaaggggacatcatcaccaaccccacagaaatacaaaaaaaaaaaaaaaaccccatcagagactattatgaacatctttctgcacacaaactagaaaacctagaataaactgataaattcctggagacatataacctcctaagactgaaccaagaagaaatacaaaccctgagcagaccaataacgagttccaaaattgaatcagtaatgaaaagcctaccaaccagaaaaaaacacaggtccagaaggattcatagctgaattctaccagacatataaagaagagctggtaccattcctattgaaactattccaaagaattgaggagggactcctccctaactccttctttgaggccagtatcatgctgataccaaaacctggcaaggacacaacaaaaaaggaaaacttcaggccaatatccgtgaagaaagtagcatgtcaaaaagctaattcaccaagatcaagcaggctttatccctgggatgcaaggttggttcaatgtatgcaaatcaataaatgttattaatcacataaacaaaactaaaaacaaaaatcacatgttcatttcaatagatgcagaaaagccttttgataaattgcagcatctattcatattaaaaaccctcaaaaaactaggcactgaaggaacatacctcaaaataataagagctatctatgacaaacccacagccaacatatactgaatgagcaaaactggaagcattctccttgagaactggaacaagacaaggatgcccactctcaacatactactggaagtcttggccagagcaatcaggcaaaagaaagaaaaaaaaggcatccaaataggaagaaaggaagtcaaactatctatgtttgcagacaatattattttatacatagaaaacccctttgtctctgacaaaaatctcctagatcatatcaacaacttcagcaaagtttcaggctaccaaatcaatgtacaaaaatcagtagcatttctatacatcaataatgtccaagctgagaaccaaataaaaaatgcaatcccattcacaatagacataaaaaaaataaaatacctgagaatacagctaacctgggagatgaaagatatctgcaatgagaattacaagacactgctgaaagaaatcggagatgatacaaacaaatgaaaaatcattccatgctcacggataggaagaatcaatattgttaaaatagccatactgctcaaagcattttatagattcaatgctattcttatcaaactaccaatggcattcttcacataattaaaaaaaattattctaaaattcttatggaaccaaaaaggagcccaaatagccaaagaaatcttaagcaaaaatacaaacttggaagcatcacattacttgatatcaaactatagaagtctacagtaaccaaaagagcatggtactggtacaaaaacagacatatagaccaatggaacaaaatggagagcccagaaataaggttgtgtgcctacagccatctgatctttgacgctgatgaaaacaagtaatgggatagatactccctattcaataaatggtgctaggattgctggttgctgtgtgcagaagatagaaaccagaaggcgtctgccttctttacaccatatacaaaaatcaacccaaaatggattagacttaaatgtaacaactaaaaccataaaaacccttgaagaagacctaggcaataccattctagacatgggccctgtcaaatatttcatgacaaagacatcaaaagcaatggcaataataataaaaactgataaatagcacctagttaaactgaagagcttctgtacagcaaaataacctatcaatagagtaaatagacaacacacagaatgggagaaaatatttgcaaactaggcatctgacaaagttctaatatctagaatctataaggcacttaaattaacaagcaaaaaccaaacaacctcattaaaaagtgggcaaaggatatgaacagacacttttcaaaagaagacatacatgtggtcaacaagcatatgaaaaaatgctcaacatcactaatcaatgaaaaccacaatgaaataccatcttacaccagtcaggatggctattactaaaaagtcaaaaataacagatgttggcgatggtgcaaagaaaagggaacacttatacactgttggtgggaatgtcagttagttcagccactgtgggaagcagtttgacaattcctcaaagaacttaagacagaactaccatttgacccagccatccattattgggtatatacccaaagaaatataaatcgttctgccataaagacacatgcatgcatatgttccttacaacactattcacaacagcaatgacatggagtcaacctaaatgcccatcagtggtatatggaataaagaaaatttggtacatatacaccatggaatactatgcagccacaaaaagaatgagatcatgtccttggcaacaacatggatggagttggaggccattattctaagcaaagtaacacaggaacagaaaaccaaacaccacatgttctcatttataaatgggagctaatattgagtacacatggacacaaagaaggggacaatagacacgggggcctacttgaggatggagattgggaggagggtgaggatcaaaaaactatctattgggtactatgcttattgcctgtgtgatgaaataatatgtacgccacacccctgtgacacacaatttatctatagaaccaacctgcccctatacctctgaaactaaaataaaagtaaaataaataaaaacctttgcccttcaacatacagtagtaagaaaatgaaaagacaaaccacagacttggagaaaatattttcaaactacatatctgataaaggacttgtatataagcaactcttacatctcaatagtaaggaagcaaacaacctaatcagaaatgggcaaaatatgtgaggagacatttctccaaagaacatatacaaatatctaacaagcaaataaaaagatgctcaattagccattaaggaaatgcaaatctaaatcacaatgagatacttctccacaccctcaagaatagctacacatttgaaaaaaacaaaacaaaacggggaaataacaaatatggtgatgatgtgaagaaatacattgctggtggttcatataaatctagtaactgtaaaatagtacagccccttgggaaaacagtttggcagaaaattaaacatacagttataatatgaccaagtaattccactcataggtgtttaaccaagagaattgaaaacgaatgtccacccaaaaacttgcacacaaacgttcatagcagctttattcataatagccaaaagatagaaacaatccaagtgttcatcaactgatgactagatagacaaaatgtagtatactgatgcaatggaatattactcagctataaaaaggaatgaagtatttatatatgccacaacattaataaactttggagacattatttagatgaaattttcaggataggcaaatccataggcacagaaagtagattagtggttgtctgatgctgggagtagtaatgaagactgactgcagatgggcaaggaagatgtcactgacgtgatgcaaatgttttaaaattagattgtagtgatggttgcaccacccaataaatttataaaatcactttaaatatgcaaattttatggcatgtaaattatcctaaatacaatatttaaacactgtgagcatcaagaaaaaaagagaactttcatctccttactttgacaatttattagggatcatacagaggtcattaggctgtttgttgttgttgctgtggtggtggtgggttgtggttttcccatgagagtcgagggtcatgcaaccatttggtcttttaaaataaaaatttttaaatcaattaaaaaagaatattgctggcttgaaatttggagtagtcatgggacaaagagaagtggatggattttttaaaatattcaggatgtagaagtgacaagattttgtagcagttagatatagggagtggggaaaggtgaggaggcctcagactgagtatgcttaaagttgaattcctgttgtcctcccgaactggctgtcctgtgctgccaatctcagtgaatggatcagcatcctggcacagagttgacattcattgattgcctttggagtgaatgaacagagtatgatgaatagagtgaaaatatagctaaacaaggcagacaccaggtcctgccaaatagccaatgcaaaactcacccttcaggttggctcagcagatatccagcataatttttttctcacctttcaaaccatttgggaaatcatgaggtattttcctcatccagaagaacactcacctacatatcagccactccttccctagaacctacaggtatggagcaggctgggttttttcaagagcctcttatcctgtaaatctttacacagggcaatggcaggtgcatgtacagcccatatgagcccaggggatgcttggtattatagaaaggggatcacagtggtgcccaactgatggatccgtgttcagtttgcaggaagagactcttcccaccaaagaggtttgttaatcctggggtccccctcccagcccctggaggcatcagatacagctgtcagaaacattgtaaacacccagtgatccacttggctggttttactgttgttcccagggttgacaagcagaaatacagaacaaatggtggttcctgaaacagaggccaaaacaaggaagtgatctgttccagtccaagcttccaagaaataaagaactaggtggggcacactaaacaagcccccagactcaaccaccccagtaaacattcccttcatcacactggttatgagataaagtataagttttttaagccttattataaataaccttacttaacgtcttctggttgttgtgaaaattatagtattttgcaaaatatatgttcaccattatcattaccaccagttccttaatgaggagaaaccagaagttgacaccaaaatgttgatccataatgtttatagtccttctttgtctttatagttaatgtaaaataaactgtatgtaatttttactacagtgtgtcctgaaagggcaaaccaagctacaagcaactctaaaagactactactgtatgggagtggattatgaaagtgtttcttaaatatgagagctcaagtttttctttcagcgactgagttaaagcacgcaactcatttatcatgagacttttgctaggcagtgtactatgtccactcaacacacatcattttaggcaatcatctggttaaaacgtttaatagtatggcattcacaaacccattcttcagagttgacattcaattaatggtttgaatgtcgtttccagggcagtcaggagtatttaaaggcttttccattgttttcggaagagaaagaaaacttcctagcctaacttacttacccagagccttgctccagagggggcagacaaagggtaaaatctgggcagagaacattagtggatatgagaacgaaagaaagtgctgcaagatcttgcagacagctgagttccaccttccactctactgccgaacaaagtgaggcaggaagagggtagggactcgctgaaagctaaacaccaagtcagtgacagatccagggctgtaaagtccgaccgagattgaaacaatgtacactgggcgtcagtcccaacgcgagcttgctccagctcttccagctcttcctgagcgctaggcccatccggcctcacgctgatctccgggcagactctgtcgcgcaactggcacagatcgtgacgacaaccctgcggcaaggcaggagtggccttcctctccgccagggttaaggtgagtaccaccgcccttgggcccagcagcccgggtgagagcctccgccgcccactgcgacaggcctgaaagcgagcgcctgggtaaacccacccgtagcacccatggggacaccccttccctgacccacgggacggaacccacctgtgctggaggtcgtgactgctaactccgcagagtgggcagaattccaagcaaggagagtctcgggaggcagcctttcacccgccttttgccttttcacccccaaaactgtcggccccacgctcccctcccccagcccgctcgggcccagcggagagcctgtaggcccc

SEQ ID NO: 1457 - DNA, 123950 bp, Homo sapiens
ttgtttgaaaaggacccattcatttattcttccaacacatctgtattataaaactactatccataaggcactgtgttaggtgctgtgttcctgaccctacagatcccattccaccatagcaaaaggtaaaagtgactctacagtgagcttggtagacatagacccatgcttatatactcagggacacctggaagagatataaaaacagaaacatctcacataggaagttttcaatgcatcgtgatcaggactcaaataatccccttctctttttcttcagtgtactaaagggagcacattgttgagaaggaccggttgcaaatttccaaaaaggagagtaaaataattaatgagtcaaggtctcaggagagacagaaggtaaggggagtccttcagtaagtggggaaattgatttgttttgtgtcctcatctctccagggccatgagcatgtcctttgctggccataagtcaatgctgatgacctcagttatagtgtaatcttcaaggctaatttacgcaaaacttcagaaatggtaaacatcctcatgaagactaatgatgacatattttaggagtgcataatagtaggtatagagaaaaaactgcagggtaaaatgttattgctgttcttattgctaaagggcatactccttaagaaccaaagttaattatcagtcctttgacctaagaggaaaacaaatttcagggactcccctaaagattcctatgtagtacaaataaaatgccaaaatattttggaacacattttggagcactggataggtcaataaaataatgtgtaaattgccaaatgtgatctaggaactccctgcaaacatcagattaggctctattctctatctgaatactgactttgctttgctttgtaactcctatcttcactaataatgccttttcccccctcttgtgtgcatcctagcctatattctctttcatcattctacagtggtcaatgtggttattgtacagcttcactttcaatgaaagctgagggaaaagaagcctcataccctgccccccacccgcccccgccaatacgtaaaagaagccatttaaaaaataaaagcagcaagctactaaatttgactcattcaaatcttggcaattagcatgtatagtatgttatgagagagagagagagaaaattagcagaaatggaggaaaacatattacatcctaaataccaccaaattgccaaaatacacatttgggtagtaatctccagagaactctctggaggcacagcatctatcatgctgatttccctgaacaatattacagaatagccctgtgtactttctcttggggggggaggtgtaaagaattatcatatggaacctcacaagtctctaaaacctttctgcaattatccctcataggattaccacactgatgagtttgttcaacaggcgctgttgtgacttcctaatttaactcctatagagatgatttgtgtggaagataaaacactatatttgaactcaattcccaccttatccctgagcttatgctaccaagcaattcttacaatgtttggagttctattagactacagagaagaatctagggtttcagctaaaccctttaatccacaggcctaggtaaaggactgtctcaaggtagtcgctagcccatgggttctcaaagtatggtctgaagacccctggaggagtccctgagacccttttcgtgggtctgcagattaaaaattattttgtataataacaccaagatgagttacattcaattaggcatttttcttttgaaattaagcagacttttggaaactaagatgtgcatagccctgtagtaggctaagtggaagttacaaaggcagtagtagctttttttccccctctcgttatctcatgaggatacagaggacttttccagaggctacatgacatatggttatgtcatctctctcatagctgagggatgtgtgcttctgtgttcttcttgagctttaaatatttctcagtcttaatacctaaaataattagtatcaatagatagaacccacacccaagaactccttggggccttcaataacttttaagagtgttaaggtgtcctaagaccaaacattttgcaaattgttgctttatcaggatttttgttatttctagaatgcatttctttctaactgatctacttgggaaaaaaatcgttacctcatggcaattattgctttcctatcaatatggagattatatttctgaaggagactgaccaaaattatattaaaaggtttaaatcaaacaagtggatccatgttataacatgaggaagagagctgccccactagatgtctgacattagataactcagagtcccgcctctccaacaagtctcccttactagagaaacggacagattctgttttgtgggatgggataaggagacaatctgaagtagagtttgacacaatattattctgcccatatgaaattctggtagccagggtgccaggtgtattcataatccagatgctgtcaattttaagcctgaagccccaagaggcgagcagtgtttaatacatcatctcttgttaaatagcagccacacagttggcggtagccagtgaagcattccctgccatgtaggacacgccagttgtctataaataggacctgtgaatgggccaaaaaaaaaaaaaaaagagagagaaaacactgtcagaagaaggacagaccaaaggaaccctaagtcagaagagatcatttaaaagataacctttaggttgttttctggttgcattaaatgagatatttttcttttgaaattaaacaaacttttggaaactaagatgtgtatagccctgtagtaggctaaatggaagttacagaggcaacagtaggtaatgggccctgcactggaggagcttctgtttctcaagtaattgttctcttatcaaagtaaatcagataattggtttgtttctttttctttttctttaattcttattctaccctttctcaaagggttaaattatctcatgacattttatgctaagctgaaggtatttttcatccagaggaaataccaaaaataaaaactatggaatcatgaagctggaaggacccttgggggtcatctagttaaaccccttcatcatacaaatagagtcactgatgccttagagatgggatgaggcttgcttccagagcattcagtgagtgggcggcaggaccataaacaaaaccaaggactcttttctctttttcctttgcaacatcgtgactcacatattaagtaagtacccgttcttcactgcttcagtattacaagcttgcttgacatctttagagattaggacccaccctgccaggctttagtttgacccaaaactcattctcaggtctcctcaactctatcgttagagtccggtgtgctgtataccagcgatggacgacatcataaggaacggtattgatgacagcccggtcatagttgttgtacctaacatggaatcatgagaagaaagatctcaaacacatgttaaagacatcttttgtttattgaacaattttatataaggcttcccctatgttcaatacttgtcccagagacgaagtgacgataagtcaatattctctcaggaatatcacattggagtgaggagttccactgcctgttgaccgtgttttgtttttctttgaataatctaaggatacgggatagaagttaagttccaactgtttctctcatcttatgatatgatattttaagtctttactggccaaaggtcatggaagcactggggaaagcgctgagctttctcctcaccaagctgaggtggggtggacaagagaggttgtactaacaaagctttccttttaacaggatgacttacaacttaagtgtctccctttgtgggaggaatcccagctatagcctagtggaccattcacccagggatcttcaatcattcgttcaaccctaacatttatatgcgcaccagctacatgctaggcagtgcgtcaggcattaaagatacaaggacgaatacagcagacacgacctcagtctttggacagagtttaccttctattgaggaagatagatgataaacaagtaataaatacataaacaaagtaatttcagctagctataaatgctatgaaaaaataatagtgttatataataaagagcgactgggaaatctatttcacatggagtgttaagtgaaggactttttgaagaagcgacatttgagctgttacctgtatgatacgagaccaacaatgtaacaagctgaggggagagcattccaggcaaagggaaaagcaaaaacacagccttggagtggaatggagttttattctgtttgccgaccagtaagaaggtcacgtggctggagctgagtaagcaaggggaataatggtgggagaaattacgtggaggaggtagtcaggggctagatcatgtatatattgccatgcaggccatggtaaggactttggattttattctgagtaccatgggaagccactgaaaaaccttgcctaagataatgggtttctgttttgcctaaggcaaattaactttttactgaagtatactatacattacggaaaaagtacacaaatcgtaagcttgatgaattttcatgatgtaatcgcatccatatcactagcacccaggtcaataaacagatcattaccagaaccccagaaccctcccttatgcccctttccagtaacgcccatcccccaacccacgggtaactaccatcctgacttctatcaccaaagattagttttgcctgtttatataaaactttatataattgcaatcacaatatgtattcattttgtgtctggcttctttcatttaatattatgtttaggagtttcatcattgcttagcaatagtttattggtgctatatggaagttgagtgcgtgatcacaccacagtttatccattctactgttgatggacatatgagtaatttccggtttggaactactacaaacagtgctgttatgaacattctattacatgtcttttggtgaacaaatatattcactcctatttgaaataaacttaagaatggaacttatggatcataaggtatgtgtatgctcagatttactagatactgccaaagatattctttccaaagataaattaacatccaatggtgccatttttggatatctcaggcaatattccttagtgttagatagtacatggcacaatcagagccaacattcttagttttgttgcatataaaatgagcataataacatctgcttagctgatctcacagggctactgcaagaatcaaatgcaaaaataggccgggcgcgatggctcacgcctgtaatcccagcactttgggaggccaaagcggtcagatcacctgaggccaggagttcaagaccagcctggccaacatggcgaaaccccatctctactaaaaatacaaacaaaacaaaacaacaaaaaaattagccaggcgcggtggcacgcgcctgtagtcccagctacttgggagactgaggcaggagaatcacttgaacctgggtggcggacgctgcagtgagccaagatcgcgccactgcactccagcctgggcgacagagcgagactctgtctcaaagaaaaaaaaaaaaagaaagaaagaaagaaagaaaaagaatataatagtccatcctcccaggcttcaaggagccatgcctggagggagaatggagtgaggaagcacagtcttcaccaggctgttgacacccattgtcatttccagaaacttctagtgctgggttaggcatttgtgaaaatattatttaatttacttatttcatcatcccagaaggaaaggtgttattaacctccttttacatttaaggcaactgaaacttagagacctgccacagagttcatacgtagcagagaggttttgaaatcaggtgtccttaattctttaactcattgtttataccagagaacagaaaaatgatcgtaattcctgtgtacgcttgttcatgagagcaacatttttacagatcacacttacaatcttttgacttcaaactgagatttgcagtttagaaatgtttccatatacactatctgattgaccctctgcatgataaccacgtgaggtaagtagtacagctgttattgtcttactttatagataaggaaaataatgataagaccttgtgatttgtccaagcttacatggaatttggtattcactatttatattagatggtggtgttttctaaagccaacagagaaagtagcaggaaaagtctattacacataagcaaaatggttgtgcaatactttggattagaataagactatttctggactttggcacaaagtgatgccatcatattattgtgcagtttttcctttttttcctgctttgatatgaagcaagagagacgtgggagtaggggaaagcaaataaagcaggcatttatctgacaagaaaagctaggaagatttaacaaagttatccttcttcttagttgacagacaagtatttcccaagagagctccataattgagcagacgatgcatttgatggatttgtgtattgtggtgtaagtgaaagctggtgggctttcagataggtagataaataggctttcagttagatcaccattacaatctcagttcaggtgtgtgaccttggaggagctatagaaattataaaaatgctagaagaaaacctcgggatgactctccaggataatgctctgggaaaagattttattccccaaaagcacaggaaacaaaacccagaaatagacaaatgagactggattaaactaaagagtttctgtgaggcaagggaaacaatcaacagagtgaagaaacaacccacagtatgggaatatggccattgtagaatggctgttattacaaagaccaaaaatgacagacgttggcaagtatgtggagagaaaagaactcttatacattcaataaacggtgctggggaaactggatgtccacatgcagaagaatgaaattagacccttttcttacaacatatacaaaaatcaactagaaatggattaaacgcttacatgtaagacctgacaccgtaaatctactagaagaaaacacatggtataactctatgatattggtctatacaattaccttttggatatgatccaaaagtataagcaacggaagaaaaactaggtaaatgaaattgcatcaaactgaaaagcttctgcacagcaaaggaaacaaaagaatgaagagacaacctgcagaatgggagaaagtatttgcaaactatacatctgataaggggttaatatctaaaatatttgaggaactcaaacaactcaatagtaagaaaacaaataacctgatttaaaaatgggcaaaggatctggatagacatttctcaaaagaagacatacaaatggccaagaggtatatgaaaaagtgctcaacatcactagtaatcagataaattcaaattaaaaccaccacgggatatcatctcatacgccttaggatggctattattaaaaagacaaaagataacaatgttgatgaggatgtggagataagtgaacccttgcacactgttggtgggaatgtgaattagtgcagccattatggaaaacaatacggaggtttctaaaaaaagctaaaagtagaactactacatcatccagcaatctcaccactgggtatatacccaaaggaaatgaaatcagtatgtccgagagatatcttccatgttctttgcagaaatattcacaatagccaagatataaaatcaatctaggcagaatacatgggagtgtatatagagaaaatgtggtatgcataaaaagtggaatactattcatccttgaaaaagaagaaagtcctgtcatttgtgacaacatggatgaacctggagaacattaagtgaaaataagccaggcacagaaatatcaatactgcatgatctcactcatatgtgtaatgtaaaaaaaaagttgatatcatagaaatagagagcagaatggtgggtactagaggctggtgggttgtggagtagtggttgggtggttggggatatgttgctcagaggatacataattttagatcagagaaataagttcaagtgatctatttttccatgtgatgactatagttaataacaatgtatcgtaatttgaaaatttctaagaaacagtcaatcaacggagtgaagagataactcacagaatgtgagaaaatgtttgcaaactatgcatctacaagagattaatacccggagtatataaggaactcaaactcaataaccaaaaaagacatattcccttaaaaatggacaaaagttctgaatagacatttctccaaagaaggcagacaaatggcaaatgggtatatttttaaatgctccacatcactaatcattagggaaatgcaaatcaaaaccacaatatcacctcaccccagttacaatggctatcattaaaaagacaaaaaataggctgaaagtaaggatggttagtatgtacaaacacagagagaatgaataagatctagtatttggcagcacaataaggcaactatagttaacaataacttattgtatatttaaaaataactaagagagtagaactggagtgttcctaacacaaagaaataataaaggcttgaaatgatagatacctcaattatcctgatttgatcattacatattgtatgcctgtatcaaaacatcacatgcactccataaatatatacaactattatttacccataataattaaaaaaatcaaaatttaatttaataacataaaatataataaagtgatcttaaaagaaatttgcccgtggttagatattacttgttacactttaattgatgatttctattataatttcatagtacttagaatatatatatatattagaaaatatcatctataggatttttgctttcatgagggtaatgatattttaagcctaaaatattagaattttcaataattttctctagtgtttggaaattattttaatcctctgtttagtgctcaaaaatgctgttcatttgtgactgattagttaaactttctaataaagtgattttacactctttatgttaaagaaacaacaaatgctggtgaagatgtgtagaaaggggaaatcttatacattgttgatgggaatgtaaactagtacaggcaatatggacaacagtactgaggttcctcaaaaaattaaaaatagaactagcatatgatccaaagaactcactactgggtattttaaaaggaaatgaaatcagtatgttggagagatacctgcactctcattgtgatggttcaatttacgagtcagcttgactggattgagggatgccaagacggctgttgaaacattgttccctgggtgtgtcggtgagagtgtttccaggggagcttggtgtgtgagacagtggactgcaacaggtaagatccactttcaatgcgggcgtgcactgtcctgttagctgggagcctggttgggacaaatagacagaagaggaggaattctctctctctgctcatcctatctcccttctgcagccagatttctttcctcctcctgtccttggacatcagactccagtttcttccacttttggactctgggacttgcatccacagcctccagtgggctcttaggcctttggcctcagactggggtctgtactctcagcttccctagttctgaggcttccagacttggagtgaatcgtgctaccagcttcttcggttctgcagcttgcagatggcctattgtgggacttctccatctctataatcatctgaaccaactacacctcataaatcctctctcatatatcctattggttctgtctctctggagaaccttgactaacacacccatgtttattgcagcactattcacaatagccaagatatggaatcaacataagtgtccatcaacagatgaatggataaagaaaatgtggtgcatattcacaatggagtactattcagccataaccaataatgagatcctgtcatgtgtgacaacatggataagcctgtaggacattacattaggtgaaataagccaggcacagaaagacaaactttgcatgtgctcacttatttgtgtgagctaaaaattaaataattgaaatgaagatagagagtagaagggaggctgggaaggttagtgggagggtgaggaggaagtggggaaagttagtgggtacaaaaaatagttagaaagaatgaataaagcctagtatttgctagcacaacagggagactgtagtaaaaaaataatttaatcatacttttaaaataaccaaaagagccaaatcatgagtgaactcccattcacatttgcttcaaagaggataaaatacctaggaatccaacttacaagggatatgaaggacctcttcaaggagaactacaaaccactgctcaatgaaataaaagaggacacaaacaaatggaagaacattccatgctcatgggtaggaagaatcaatatcgtgaaaatggccatactgcccaaggtaatttatagactcaatgccatccccatcaagctaccaatgactttcttcacagaattggaaaaaactactttaaagttcatatggaaccataaaagagcccacatcgccaagtcaatcctaagccaaaagaacaaacctggaggcatcacgctacctgacttcaaactatactacaaggctacagtaaccaaaacagcatggtactggtaccaaaacagagatatagaccaatggaacagaacagagccctcagaaacaatgccgcatatctacaactatctgatctttgacaaacctgacaaaaacaagcaatggggaaaggattccctatttaataaatggtgctgggagaactggctagccatatggagaaagctgaaactggatcccttccttacagcttatacaaaaattaattcaagatggattaaagacttaaatattagacctaaaaccataaaaatcctggaagaaaacctaggcaataccattcaggacataggcatgagcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacctacttgtctgacaaagggctaatatccagaatctacaatgaactcaaacaaatttacaagaaaaaaacgaacaaccccatcaaaaagtgggcgaaagatatgaacagacacttcccaaaagaagacatttatgcagccaaaaaacacatgaaaaaatgctcatcatcactggccatcagagaaatgcaaatcaaaaccacaatgagataccgtctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaggacacatgcacacgtatgtttatagctgcactattcacaatagcaaagacttggaaccaacctaaatgtccaacaacgatagactggattaagaaaatgtggcacatatacaccatggaatactatgcggccataaaaaaggatgagttcatgtcctttgtagggacatggctgaaactggaaaccatcattctcagcaaactatcgcaaggacaaaaaaccaaacaccgcatgttctcactcataggtgggaattgaacaatgaaaacacatggacacaggaaggggaacatcacacaccggggactgttgtggggtggggggaggggggagggatagcattaggagatatacctaatgctaaatgacgagttaatgggtgcagcacaccaacatggcacatgtatacatatgtaacaaacctgcacgttgtgcacatgtaccctaaaacttaaagtataataatcataaaacataaaataaagtaaaataaccaaaagagtataatttggttgtttgtaatacaaagataaatgcttgaggagatggatactccatttttaccctgatgtgattatgtactgcatacctatattagaacatctcatctaacccataaatatatacacctactatgtaaccacaaaaataataaataaaaataagataaatataaatttaaaagttgatgttatagaggtagagagtagaacagtggttaccagaggcaggggaggcgaggagggaaggagagatgggaagaggttggtcactgggtacaaagttacagttatggttagataggaggattaagttctggtgttctattgcacaatagggtgacaatagtcgacgataatatgttgtatagttcaaaatagctagaagagatgattttgaatgttctcactaaaagaataagagggggaatactacaatcaatctatgcctatatatttgataacttatatgaaccaatttcttaaacccacatggtaaaaaaaaacaaactaattcaaagaaaagtagataatctgaatagcctggcatgcattaaagaaactgaatctgtaatttaaaacttttcaagaaagagaactccgggccagacaatttcactcatgaattctatcaaacatttaagtaagatgtaatacaaattttacagtctctttcagaaaattaaggagagaaaatgaccccactcatattatgaggatagcatcatcctaataccaaactcagacagagatattacgagcaaaaaacaaaatagcaatatctcacataaacataggtacaaatattcttactaagatattagccaatcaactctagcaatgtataaaaaagataatgcatcaagatcaagtggagtttatcccaggtattcaaagttggttcaacattcaaaaatcaatcaatgtattttatcatattgtcatactaaatacgcaacatcgaatgatcatataaataaatgcagaaaaggcattcaacaaaattcaatattaattaatgataaaattcccaacaagttaggaatagaaggaaatttccttattctaataaaggctatccatggaaaacctacagtgaaccactgagtaattttcccctaaaatcagaaataagtcaaggatgtcctttctcaccactactattcactgttagtcctggaagtcccagctagtgcgataacacatgcacacacacacgcacacgcgcacacacacacacacacagagagagagagagagggagagagagagagaaatgaaaggcatacatattataaaggagaaaaatataccccattatgttgaaaaccccaaataatgtacaataaaactccaaaagactcttccagaagactcctagacttgataaagaacttcagtaaagtttcaggatacaaaatcaatgtacaaaacacagtagcatttctctacaccaatatcattcaagctaagaaccaaatgaagaacccatttacaatagccacaaaaaataaaacacctaggaatacatttaatcaaggaggtgaaagatctctacaagaggaactacaaaacactgatgaaaaaattgtgtatgacacaaataaatgaaaacacatcccatgctcatggatcaaaagaaccaatattattaaaaatgaccacactgctcaaagcaatttacagattcagtgcagtctctatcaaattaccaacacaatttttcacataattaaaaaaacttaaaattcatatgaaaccgaaagaagagtctgaatagccaaaccaatcctaagcaaaaagaacaaagcttgaagtattacattctgactttgaattatactacaaggctatagtaaccaaaacgtcatgatattggtataaaaatagacatatagaccaacggaacagaatagtgaacccagaaataaagtacctattaacaactgatcttctgcaatattgacaaaattaaacaatagagaaagaacaccctcttcaatatacggtgctaggaaaactggctagccatatgcggaagaatgaaactggacccctgtctctcaccatatacatgaattaactcgagatggattaaagatttatactttagacatgaaactgtaaaaatcctgtgagaaaatgtaggaaaaattcttctggacattggcctggcttaggcaaagaatttttgaccaggtcctcaaaagcaaatgcaacacaaacaaaaataaacagacgggactcagttaagctaaaaaccttccacacagcaaaagaaacaatcaacagagtaaacctacctaatgagaaaaaatatttgcaaattatgtatctaacaaaggctaatatccagaatctacaagaaactccaacaactcaacaacaacaacaacgacaaaaacaaaaacaaaaaacaagtaacgccattaaaaagtaggcaaagggcatgaatgggtgttttttgaaagacatacaagtggccaacaaacatatgaaagatgctcaatatcactaattatcagagaaatgcaaattaaaaccaaacaatactatcttacaccagtcagaatagctattatttaaaaatcaaaaaacaacagatgttggtgaggatgtggagaaaaaagtaatgcttatgcactgttagtgggaatgtaaattatcacatttatggaaaacagtatggagatttctcaaagaactaaaaatagatttctcaaagaactaaacatggtaaaaaatgaaataccatttgatccagcaatctcactactgggtatctacccatctgcattttacatatacgtggaatactatgcagccataaaaaaataatgaagtcgtgtgttttgcagtaacatgagtggaactggagtacgttatcttaagtaaaataattcagaaacagaaagtcaaatatcacatattctcacttgtaagtgagagcttaacaatgggtacacatggacatatagagtagcataatagatattggagactacaaaagggtgggaagttgacaagggttgaaaaattacctcttgggtacaatgttccctcttcaggtgatgggtacactaaaagcccagactccaccacgatgcgatatatgcatgtaagaaatctgcacttgtaccctctaaatccatttttaaaatcgaaaaatatcaccgtaagataccgcttcacagccactggaatgactattataagcaaacaaagcaaagagcaaacaagttttggtagggcctggtgggaggtgttttcatcatgggggcaggtccttcatgggtggcttggtaccactctcatagtaatgagtgagttctccctctgaattcattgcaagagttggtcgtttaaaagagtgtggcatgtccttggaacagctacaattcatacattgttgatgacagtgtaaaatggtacaagtactttggtaaaacttgttgcagttatttatgaaactaagcattcacctactctatgacccagcagttccactcctaggtatttaccttagtgaaatgaaaatgaaaacatattaaaaaaaacacttttacatgaatgttcacagcaactttattcataataacctgaaactggaaagagtccagatgtgtattcataaaagaagagataaacagaacaggcaaaaatctaatctatagtggtaaaagaaaatcaaactgtgggttcctctgagatgtatgtgcagaagtatgagagtacttcctgtagtgatagtaatattttatatcttgataagggtttgggttaaataggtatatgcattggtcaaaactcagtgagtgtatatttaatattttaaacatcattgcatatacattgtaactttaaaaagctgtaagcaaatattgaactctacttaatgatataaatgttgaagtattagggagatatgtactgatatctgcaatgtattatactttaaaattcactgaaaataagattaactgatgaatgaatagatgggaagataggtgataaagcaagtatagaaatatcttaatggtagaatctagatgtaagtctatggcttttctgtgttaaatgttttcaacttttctatatgtttagaaatgttcataataaaatgttgggaaaatagagttactactcattgttttaggcacttagatatatgagagataacagagggagagtttcccagaggaacttatccaagggaagtaaattaatatttacacagttcctcctacaagccaggggtaaaggtaaggataacaatttatttttaacttcacaacaagtgggcacagaaggtattattattgtaactggaaactcatgactagcaggttaagtaacttgtccaaggccaaaaatcaataaatggcagacaggatttcacactgaactccttctgattacaaagcctgtactctttgtagtatgtcaagttttgcagctatcttcaccctgcctcttcaccccatatctccttccctgcttttttgtttttccctagtacttatcacaatttgatatattatatatttgcttatttatttttaattactctgtcgtcactataatgagaattccaagatggccaggaatttttgtctattgtgcctacagtttcatctgcagtgtcaagaacagagcatgactcttggtagatgctcatgaaatatttgctgagtaaactgaattaatgcacagtaacagtttgcttggaataagcagaagcaggagcggtaatccatctgcaaaaatgcatagtaaaaagcttggctgcaagatgcaaaataatgggctccagaaacccaaagcagtttggaatagctagggaagaatgtatggaaaacatgaattacatgctagaagagtaagaagggatcagatcatacagaaccttaaaagccataaggaaggactctagtctttctctgaaagacactggggaggtttagaaggatcttaacatgggagcagaagataagactcagcatgaaaaattaatggaagagggctcacaatggaagcaaggacatcagttacaactttagccatgggaaagaaaagtgttctcactgcaagaagaggcattgtagatagaaagcaggggatagtttgagaaaaatataggagattgagttgataagactggttgtgtaatataagggagagggaaaaattaaatatgatgtttggtttatggcttgggaaacttagtggatggtggtaccattcaatgaaaatgggaaaacaagtggagaagtaggtttaaaatgagtagaagtgatgagttcacgtttgaatatgatatgttttatattctacaaaatatctaagttgtgatatcagtagtcaattgaatacacaggtcaagagctttgcataaatctgggctggatacataaatgttgttgggtaacctagctgtttggtcactgaggataatttaataactctttttcatttaataatgttttcatttaaaaaatactacctctaatatttgaccccacccctaaaataaacctagtattctttggttggtggctatttactattccatgggaattataagaagaatacaaactgtttgataataaaaagctatagaatagcaagattaaaatgtagcagatataagaatcttagggatttttgttacattagaaggctaatctttggcaaatatattacagttggggatagttctttgatactcacctgatcaaatacagctctttattccatgggtagatatttaagactggcccaatcccaatcatgtggttgtgacattctccaacatcttcaatatattcatgcttcaatggcactttactgaggagttcaaattcctcaggtgccttttgaagtacctgttctgctgcatagaatccatctactagcagtgtcctgccaccagttccttcatgtttaagacaatgaaacacttgaatgctaaagagagaaaagaaaattcttctgttcagtggaagagagaacatatcaaaattctagaaattatatataaaatgattactgaaactacttgtcattttcttttcatttcctaattggaaatctcatttcttaattgtttttctctcataggcagttgtacttttttgtgttttgaaatattaatgccactagaggtttcttctaaacatatctaacatatattgaagcttatatgtgctgggccctgggaatacaggcatgaataatatataacctatattttcaagaagctcatagtctagtaagaagaactaaagcaaataaataccaaataaaatatgataggtactataataaagttgcatacaagatatagtggggtcataaacaaaggaatgatctgttctagcggggtgttgtataaagaaatgttttggagaagaatgaaaattgttttgactaatcttaaagaatgagcaagaattggagtagaaggagattgagatgaggagaaggcattctaggcggagagaaagcatgaccaaagataccaatgtaaaacaacaaggagtaagaagttcctattggcatagcacagagaaccacaaaatgattttaaactgtgaaactctacggccatatcaatattttaaagagtccattatgttgatagtgtggaacatggactggtgagaagcaacgtgacaaaaaacttggaaaccaacttgaacaactgaaatagtaaagaaaaatattgagagcttgaactcagaaaggggcgttatagagaagaagacacacctgagagataccgagatagaagtagcagaatttgataactgaaggataggcaagaatctagaataactccaggtttctcacttgggcacctgaaaaatgataatgctatttactaagaccgagattacagacagatatgctgttgaatgataatgaggaagtatgagaggttgaggaaggagttcagtttagaggcatgttagaacagctaatcatatacagtttctgaatatgttaacagggaaaggtaaggtgactattaattgactggaaaactaaggtagaattttcaaacttatgagggaaaataaaattaatagtaatttaatcaaatatgcaaaactaagaaaaagtaaaaagcaaattaaaataagaaataaacaaaaatatggagtaaaatcaaggacaatctaatataatataaatacaattaaaaagagaaaggtaagcctggccatattgaaatttctgtgaaacttctaggtcagggttatttagttaccagttaaagatgtttaaggaagagaggtggattttgttacaagtgatagctaaagccaagagcatggaagaggtcgtttggagagatcatttcaagtaagaaaagagggataaggagaaaaccttgaggaagaataatatttaggaaatagacaaaagaagccagcaaaggaggctgaggaaaaatggtcagatatataggaagaaaactaggaaagaaggaatatttaagaaatttagtagtggttaatggtatgtctcagggatcaagtaagatgacagtacacactggatatgacaattagttgctggtgacgttagagagagtaactttaattgcggtgaggggtgggttgggaaaactagatgcctatgggtttgaggagtaaatgggaagtgagaatgaaaatatattgaatgtagctattattcttttaataatcttagccatgaagtggaagaaaaaaacatggctgtagctaaacggagatagagtccaaggaagtacaaaaatagagaattaagatatgggaggctgataagaaggagtcaataggtatggaaaggctgaagatagaggagagagaaatccccaaggaagctggaaaggatgagatccagagcaaagatagctttagagagagtaaagcatataacaatgaagatagtgattaaaatgaataaaatgatgaaaattatagctaatatttattgaacacttagtttgtgtcaggcagtatgatcatataatttaattccttagcaatgctaatggataggttagtttgtgtcaggcaatatgatcatataatttaattccttagcaatgctaatggataggttttatattactagtcccattttacagatgaggaaactgaagtacagagaaattaagttacttgtccaagatcacaaatctaatacatgttgaggctggaatgcaaatctgggtctggttgatgccatagcctgaactcttaagtgctattaccatactgctaatttacttggtccttgccattgattacaaacaattaaactaaagccacaaacagttgtttatctctggtgttggtcataaagggaagagctagtcagtatttgaacctcaacccctgtacagctgcttcttatctcatttcctcttttttccttctgtatccactagaatgaggatgcagggttgttgatctctccatatattgataacatttatcaggatatctaaaagctgctttgttcttccttccctgaatcaaacattcttaagttataaacccttaaaggaaatcagtgtaaccatgagcaattgcatattatcatcctctcatatagtctccataaatctatgtgcactcattttactcatatctttgtgtctcaggctcaccatctaaatgcagaagcaagatcaagaacacggaataaccacagaggtgcctctactgaagagcaaatggtaggaaaattgagtatagtatgtatcatctttggttcaaaagcatcttattccgtgtgaagaagttattcttccatcattcctcctctccaacttcttgtaaatcagattcaaattcttcttaatgccatactcaaagcagctgtgtttgcatgacgacccttttgcaatatgttaataactaaatgcaagaaatctgtacaaattccaaaactaatggttaggcaatacttttttgggggataatttataattactttgaaaaatgtaaaattacattttaataattaacaaaattaggactccatttatatagtaagatgagttttctttttattttattttattttattttattttattatactttaagttttagggtacatgtgcacaatgtgcaggtttgttacatatgtatacatgtgccatgctggtgtgctgcacccactaactcatcatctagcattaggtatatctcccgatgctatccctcccccctccccccaccccacaacagtccccagagtgtgatgttccccttcctgtgtccatgtgttctcattgttcaattcccacctatgagtgagaacatgcggtgtttggtttgttgttcttgtgatagtttgctgagaatgatggtttccagctccatccatgtccctacaaaggacatgaactcatcattttttatggctgcatagtattccatggtgtatatgtgccacattttctttatccagtctatcgttgttggacatttgggttggttccaagtctttgctattgtgaatagtgccacagtaaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttcttcacatcctctccagcacctgttgtttcctgactttttaatgattgccattctaactggtgtgagatggtatctcattgtggttttgatttgcatttctctgatggccagtaatgatgagcattttctcatgtgttttttggctgcataaatgtcttcttttgagaacttaaaaatattttattcctaggagtctgatatagtttggatatttatccccaccaaaatctcatgttgaattgtaatctccagtgctggaggtagggcctggtggaagtgtttagctcatggaggtggataactgatggcttggtgctgtcttcagatagtgagtgagttcctgtgacagctagctgtttaaaagtgtgtggcacctcctccctgactctctctcacttgctcctgtttttgccatgtgaactgtttgctccccgctcaccttccaccatgattggaagctccctgaggcctccccagaagaagatgctgctatgctttctgtatagcctgcagaaccatgagacaattaaatctctcttttttttttttataaattacccagtctcaggtatttatttatagcaatgcaagaatggcctaatacagaatctaaaaactgagttaaggtatttcaaaatgatcatgtttctaggggaagagaaagtcatacaaatctgcaggagcagatatgatcttggttcgaacagaatggaaaataattaagaaaccactcaagactatcacatataaagactttacactgtaaaagtctaatccacctacccacagggctcttgaaaataggtagtgtcagtgtgccgatccagagctagcttggtgtacgcagtgtcacctctggagaagtctgaagtgaaataccacatcctcccataaatggtttctctgttagttgaaataaagaaagacctgttagctatttgaaatgttcattcttgtctttcaaaactccttccaataccttctttagttactcacaaataacagtagatttttttggttccagaatttaatccataaggtgaaaatgacagttgaacatgctagtcttgacaattctgtcacttattaacattctagaaagttggggagaaaactgtggaagtataatattgtattatgaaagcttggagaatcatcccactctgattatgtgcccagttttcatagccttcataaattcaaggttcttttctatgctcacctttctttcacagaaaaagatatagctgcttctggaagtgatttttttattttattttattaattattattatactttaagttttagggtacatgtgcacaatgtgcaggtttgttacatatgtatacatgtgccatgctggtgcgctgcacccactaactcatcatctagcattaggtatatctcccaatgctatccctccccccttccccccaccccacaacagtccccagagtgtgatgttccccttcctgtgtccatgtgttctcattgttcaattcccacctatgagtgagaatatgcggtgtttggttttttgtccttgcgatagtttactgagaatgaggatttccaatttcatccatgtccctacaaaggacatgaactcatcattttttatggctgcatagtattccatggtgtatatgtgccacattttcttaatccagtctatcattgttggacatttgggttggttccaagtctaactttatttactatttttatagctgttgtcttttattagtaccattttttcaataatggtggtcatttcctaatattttggataatccaatttgcaaggatgactgaagagttctcatattatttataagacacagaagtgattaatgtagatcctcactcatcttttggacatggaggaataaagaaaagagaaaaggatagtttgtgttagcaagtatttagtgagacttgctgtaccattgttgttgtgtctctccttgaagtatacatcatatattttgattttgtaattattttcctgttcggctcaaatctgactaaaggtcactttaattctttagctttcaaagttcatcttattttctgaacccttgaagttcaaataggaaatgctcttccttttgaactatcatccctaaaactgtctcaatttatcacttaccagcacagtttctttcacttgaaagttctcaaactgtgattcaaactgaatggctcacagatgctgttgattatgctctaccagcacagggaagaagacccagcatactatctactacaaaatgagctatatctggatcttattaagtaaaaggaaagtactaattataataaagtaggttgacatcacacttaatactatagaagatcaatctatataccacccaaaagtgcgtaatggtaatgaaaaaaacaatgtatttaggattaggaaacctgggctatttgaattcaagttctattgtttactagtagagcactcctgggcaagacacttggtatatttgagtgtcagtgcctcagcagtaaaacggggacaaaacacacactgatcagggttcctataataattaaaagaaaataatgggtgggaatgtgctggctgaatgctatatagccttttaaggcagtgttattaacaatcagtctctgaatcaagccacaggaatcacagaaggtcaaattgaacagatgggaaaatagaggacagtgggggtcgagggggtgtgtgtgtgtgtgtgtgtgtgtaatggacatgcctatggtcacacaactacttgatggtagaactcagactactatccagttctccttacagtcagtgtttttttccagtgtacaataatacctgtcacttgggatcactgggctagaaacatattaccaatgactctgcagtcatcattatattttacacataagtgtatttagagattagaaatccagacctcaaataaagtactgcaagtgagagtcccttattcatgctacaaaatattctggattgaaaacgagggtgaccatacctgttacatttatttattggtgttcatgctctggaaattaattataatactgtggattttaggaaacaaatgaattacctgattaagctgatcctttctgccaacttctctgtgtgctcttgagtgggagggacattttctacgaatgcaattccatagagcagaaagttttgcagaaacttcttcagtccctcgttggtttctaagaagctctggcaatctaccgatggaacttgggcttgctggtagatttcagcattccatagtattctaggctggatgactttttgtttctgcccttcatagctgtttttcaccagccaattcaaatcatatttagtcacatgaccatctggcccttttaaggggaaaaataaaaggcactataataattacaaataatgtcaatatttgtaattggttacaactagttaagaatctttttcctagcaatcagttatccagtactgtattgtttatgaaaccaaattaaaatgaatgcctagaatgtttctgagaaagaaatatgtgtggtttgagtggtatgcatgaataaatgaatgaacaaataaatcttcccagaggctaaataagtttacagaattatagttatatagtaaaagatcttctggaaaattcatcaagtcatcaaagaatgataatccaagtaggcttttacaagcctacttggcactctctccccttgcccccatccctgtcttccatctatataggaactcagaatgtttgagctagaaggggctaatctttattttacagatggagaaaaagtcagtgactcactcaagatcacacaactaagtactataggtggaactagaaccccaccttcttgctgctacaagttcagtactattcaatgctgccttcctcttctacatgatgtaggacattgctgtctaattatatgacatcaacacaatacaataaaattactttgtaagtggcttcacctgctgtgcacaccccacccaaaaaaagttgaaaaccaaccctgaaatgctttagaaaatcttcaggataagcaaaggaagcagcagaaggagtgaaagactatgttgacaacttgtctctcctttttacttctctctcttttcctccctccccttggtaaaaaagtatcacactttggataatttggaaagcataaaaaagtatgaggaaattaaaagtcaccatgtttatcattctatcacccagatgaaactatgattgacagcctggcatcattccttccagtttttctgtacattctcttattttatgtaatttatgtatataaatatagtttatgtaatttatatatataaaatttgggactctgccattgtcacttaacattttaacaatttttaaaattaaattttatcattttaaaaattcaaccttcattaaaattaatttttaaagcttacaaaatatacattaccaagatttacctaacccatctgttattctgggtatgtacatttatttttaaaaaatttcctattatttattagtgatcatctttaaccatatttctataatttagaaatagaatgtatattacatttcttaaaagttcgtatctttgtatttagaaatttcaaagatataaacttttaagagttctgatatacataatcaaattactttttagaaagtctacttatcttcattccctccaacagtacatatgtgtccatcaaaatggagtattcttatttttaaaatatatttttttctaatttggtaactaaagtggaactgctatcttgtaataattttaacttatttgcttactaaggctaataagaatactttctatatttgttagacatctatgtttctttaatgcagggactaccaaactatggttgatgagtcaaatctggtgcttggttttgtaatgcctgtttcagaacacatgctgtccatgttgttacatattgtctatagctccattcactcatatagcccacaaagtttgaaaatatttaccatctggctctttatagaaaatgtttgctgactcctgctttaatgatttgtctgttcagtcctttctcacatttttctattggaacaattgtacttttcttcttttttttttttttttattatactctaagttttagggtacatgtgcacattgtgcaggttagttacctatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagccctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtcctttgcccactttttgatggggttgtttgtttttttcttgtaaatttgttggagttcattgtagattctggatattagccctttgtcagatgagtaggttgcgaaaattttctcccatgttgtaggttgcctgttcactctgatggtagtttcttttgctgtgcagaagctctttagttgaattagatcccatttgtcaattttggctttggttgccattgcttttggtgttttggacatgaagtccttgcccatgcctatgtcctgaatggtaatgcctaggttttcttctagggtttttatggttttaggtctaacatttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcggtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgctcatggtggaaaagctttttgatgtgctgctggattcggtttgccagtattttattgaggatttttgcatcaatgttcatcaaggatattggtctaaaattctcttttttggttgtgtctctgcccggctttggtatcaggatgatgctggcttcataaaatgagttagggaggactccctctttttctattgattggaatagtttcagaaggaatggtaccagttcctccttgtacctctggtagaattctgctgtgaatccatctggtcctggactcttttcggttggtaagctattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggattggtggtgatatcccctttatcattttttattgtgtctatttgattcttctctctttttttctttattagtcttgctagcggtctatcaattttgttgatcttttcaaaaaaccagctcctggattcattgattttttgaagggttttttgtgtctctatttccttgagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtgatgtctttgttctcgttggtttcaaagaacatctttatttctgccttcatttcgttatgtacccagtagtcattcaggagcaggttgttcagtttccatgtagttgagcggctttgagtgagattcttaatcctgcgttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatgtaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgttgagcacttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgacagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctggttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtacaccggagctgttcctattcggccatcttggctcctccccccaacaattgtacttttcttacaatttagcaaaagcaccttacatattaaggatatttagtcttcggcatacattttgctaatattttgcctgtttttaaataaacctttctatggcattttttttctattgtagagaaattagtagtcaatgtatgcatcataagcatgttttttcctccaatgctttttcttttaacttttttatttggagataatagattcacaggatgttgaaaagaaatgtgtaggaaagtcccatgagctcttccccttccttgatgttaacttgttatataaccacactacaatacccaaaccaagaaagtggtattggtacaatccattgggcttattcagatttaaccagttaaacatatattcatttgtgtgcatagctctatgcagtgtaattacatgtgtaactttgtgtaaccaccaccaaaatcaagatactcaaccatatgactccttcgtgttacccttttacagctacatccgccacctcctacccccgaatccctaactcctggacaccaataatctgttctctacctctataattatgttatttcatgactgttacaaacatgaaatcatgcagattggctttttcacttcagcataatgtaattgaggttcttccaagttatgtatcgaactagttccaataaagttgctgagtaggattttattgtatggatggtttgtttaaccattaacccattgggtagtttccaattcttggctattacaaataaggctgatgtgaacattaatgtacagggttttatgtgaacataagttttcatttcttcgggataaatgcccagaagtgtgatttctgggttgcatgtttagttttttttttttaagaaattaccaaactgttttccagagtgtaccattttacattcccataagcaatgtatgagtgatagaatttctctgcatcttctctagtatttggtgtagtcactgttttttaatgtagtcattctgataggtatgtagtgcaatctcattgtgatactaactttcatttctgtaacagctaataatgttgaacatcttttcatgtgtttattcgccatctgtatatcctattcaggaaaatgtctgagcatatcttttatccatttttaaattgtattgcttgtttttctgctgagttttaagagttatttagtcctagcgccagtcaggaccttaagatgttctcatatgttcttttcttgaagttttatagttttatgttttacgtttaagtccgcaatctactatgattttttttttatataaggtgtgagacttgagttgaggttcttttattttttcattatggatgtccaattgctctggtaccaattactgaaaagattatccttcctctattgaatgacttttgcacttttgccaaagataagttgactatatttctgtggatctatttctgggttctctattctattccattgatctatgtatctgtccctccaccaataccacattgtcttgattactgcagtctggaagtgatttcttcccacttaattcttcattttcaaaattgttttgcctctcctagggcctgtatatttccatttaaattttagagcaagcttgtttataattataaaaaaaatcttgcttatattttgacaggaattgcattaaaactatagatcaatttggagaaaactgacatcattactatgttgagtcttccaatccatgaacatgatttgtttctccatgtatttatgtcttctttgatttctttcatcagcatttaataatttttatcatacagatcctatacatattttgttagattatacctaaatatttaaatttatttgaagctatttttgaaatggtcatttttcatttcagtttctgcatgtttaagtatatagaaatatgattgatttttgtgtgttgatcttgtgtcctctgaccttactgaactcatttattagttttcacggttttattatagattacttgaggtagtctatgttaggatgtcatgtatctgcaaataaagagttttatgtatgaattttattaatttttcttgacttactataatagaattttcagtactatgataaataagagtggtgagagtggatgttaaataatagtggtaagaatgggcatccttgccatgttccctgtcttagagggaaagcattaagtctcactattaagtataatgttagctgtggattgtaacaattttatttgaagagaaaaataaaatgtttcaaaaaatccttccaaaacaagaaaaaaagaaaagtaagtaataacctatttttgaaaggaacaaaccattttccacaaaataactgtccttcagaagagtacccccaaagaagatcaagtctcctgtccactcacaagtgaaaaagagtgtggtctcatccagacgaatggtctttggcttgatacataaatccacactggcagtatccaggctgcgctggtgagtcttagagttgtagcacgatgctgagcggcagtggtctcgaagccagacgtaatcaaagcgcatcacggtattagcatatttcagctctagggaaaagatcacatttatcagaactatttattgagataactttaaaaaatcagcatccagaaaacttccttctaaaagtcttctaccaataagcaataagggttgaggggagggacttgccccttaccagatattaaaatatactgtagaacttctataattaaaatggtgtaatgttgtatttaaatagataaaatgatggaagagtataaaaagcccagaaatatacccaaatgcatatggaaatctggtatgtaataaagtgacagcaaaagtcattgaggaaaaaatgaattttttaaataaatggtgttgggacaactgatagaacttgggaaaagataaatttgtgtctgtatgtcatgttgtcacaaggttatcaagataaactcaaaatatataggagtactaaatttagaaaatgaaaccattcaaggatcaaaagaaggaagcataggtgcgtagaggatatatatatgaggtgatatggtttggctctgtgtccccacccaaatctcatgttgaattgtaatccccagtgttgggggagggacctggtgggaggtgattggatcatgggggcaaatttcccccttgctgttctcctgaatgtgacggagctctcacgagatctggttgctttaaagtgtgtacacttctgccttcactttctcctgctttgccatggtaaggtgtgcttgcttcccctcaccttccaccatgattgtaagtttcctgaggcctcccagccatgcttactgtacagcctgcagaactgtgagtcaattaaacctcttttcttcataaagtacccagtttcaggttgttctttatagccatgtgagaacaaacaaacacagaaaattgttaccagagaagtggggcattgctataaagatacctgaaaatgtcgaagcaactttggaactgggtaacaggcagggattggaacagtttggagggctcagaagaagacagaaaggcgagggaaatttaggaacttcctagagacttcttgaatagttttgaccaaaatgctgatagcgatgcaaactgtgaagtccatactgaggtggtctcagatagagatgaggaacttattgggaactggagtaatggtcactcttgctatgctttatcagagactggcagcattgtgcccctgctctagggatttatggaactttcaacttcagagagatgatttagggtatctggcagaagaaatgtctaagtagcaaagtgttcaagatgtggcctggctgcttctaacagtgtatgctcatatgcatttgcaaagagatggtatgaaattggaacttatatttaaaagggaaacagtatgaaaggttgtaaaatgtgcagtgaaaccatgtggtggaaaacaaaccattttctgggaggaattcaaggctgcagaaatttccataagcaaagagaagccaaatgttaatatccaagacaatgggggggaaatgtctccagggcatgtcagagacctttgcaggagcccatcccattacaggccctgaggccaagagggaaaaaagagttttgtgggccaggcccagggccctactgctctgtgcagccttgggacatggcccccatgtcctttggctctgtgtctcagcagctccagctctagccatggctaaaagggaccaaagaacagcttgggccattgcttcagaggatgcaggccccaagtggtggcttccatgtgttgttgggcctatgggtgcccagaaggcaggagttgaggcttgggaacctccgcctagatttcacaggatggctggaaatgcctggatatccaggcagaagtctattgcaggggcagagccctcatgaagaacctctactagggcagtgtggaggagaaatgtggggttggaagccccacacagagtccccactagggcactgcctagtggaactatgagaagagggccaccatcctccagaccccagaatggtagatccaccaacaacttgcactgtgcacctggaaaagccacagccactcaatgccagcctgtgaaagcacccccagggctgtatcctgcaaagccacaggggcagagctgcccaaggccgtgggaacccaccccttgaatcagcataccctggatgtgagacatggaatcaaaggagattattttggagctttaagatttaacgactgccctgttgggttttgaacttgcatggggcctgtagccccttggctttggccaatttctcccatttggaatgggagcatttaccgaatgcctgtacccccattgtatcttggaagtaacaaacttgtttttgattttacaagctcataggtggaagagacttgccttgtctcagatgagactttggacttgaacttctgagttagtgctggagtgagttaagactttaggagaccgttggaaggcgtgattggttttgaaatgtgaaaagacatgagatttgggaggggctaggagtggaatgatggaatgatatggtttgtctctgtgtccccacccaaatctcatgttgaattgtaatccccaatgttgggggagggacctggtgggaggtgattggatcatgggggcaaattccccccttgctgctctaatgatagtgagttctcatgagatctggttgtttaaaagtgtgtagcacttccccctttgctgtctctctctccttctccaccatggtaagacatgcttgcttgccctttaccttctaccaagattgtaagtttcctgaggcctcctagccatgcttcctgtacagcctatggaactgtgagtcaattaaacttcttttcttcataaattaaccattctctgggagttctttatggcagtgtgagaacaggctaatacaggaggtccttgtactattttagcaactaaccttctgttaatttgaagttatagcaaaataaaaaaattacaaaaaaaacaaagactttctatacatcaggttactcatttagaaaaggtaaataaagtgtgtgacccaatttacaaaagaaaagaaaaaaataagttatgccttcatataattcaaaaaaaataaatttctgatggattaaagtacaaaaaattaaaactgtaaaacattaaatgttgacaaccttgaggtaggaaaggctgttttaatatgacacaaaaggcacagagataaattaatctatattaaaataaataccttctgttctgcaaacaatataaaagcaaagttaaaagagaagtaacaggaaaaatatttgtagcataaaaggattaatatccagcatacagaataaacctctgtgatcattaaagataaaaacccaacagaaaaataggtgaaggatatcaataaggaaagtcaccagaagtgacgggcaaacgtatgaactgcccccagccttggtaataatcaaagaaatgggtatttaaaccaaaatgtgataccattttatacccatcagagcaataaaaattttaaaggctgattaaaatgtgttttaaaggatgtggggaaaaatgcatacttgcaaacattggtagtaggagtatatattgttaaagttatactagatggcaatcagcaagtttctatgaaaataatttaaaatgtgcatatttgacctagatattcacctctcagtatttatttttttctcttgtactttatttatttattttatcttttaatatttttttttatgtcagtagcttctggggctcaagtggtttttggttacatggatgaattgtatattggtgaagtcagagatttcagtgcacccatcacccgagtagtgtacactgaaactgatatgtagttttttattctttatccccctccttccctctccccttctgagtctccagtgtccattataccactctgtatgcctttgcataacatagcttagctcccacttgtaagtaagaacatacagtatttggtttttcattcctgagttacttcacttagaataatggccttcagctccatccaagttgctgcaaaatacattatttcattcttttttatggctgagtagtattccatggtgtatatatacattttctttatccacttattggttgatgggtactgagattggttccatatctttgccattgtaaattgtgctgtgatgaacatacacaaacaggtgtctttttgatataatgacttcttttcctttggacaaatagtagtgcacctctcagtatttatcgtatagaaagtgtcacacatgtggagctgcatataaggttattcataatagtgatggttataatagtaaaaataattagaaaaaagactaaatgtctatcagtggggaagtggaagaatcgctgaataaactgtggtttatccacattttaagatattaagcaatagtttttaaaaactgctatacctgtacctctcacattcactttcattggtattatcattctcattttaaggacaactaactaaagctcagagatgctaagtaactttgtaagaatataatcattaggtggtagagctaagacatgaacccaagtcatgcaaccccacagcctagtacactaatgtgtctcaaagtacagccttgggaatctggaggtgatacttcttttagaaaaacacagagaggagcttggcaaattttctcccccaaaagtattgataaaactggccaaactaaaaaagaaccattttaagactctggaaattgtccaaaggtatacagcaaattgagaagtatttattatatttttaatttctttagtaaccttcatactgttttccataattggtacaccaatctacattcccaccaacagtgtacaagagttcctttttctccacacccttgccaacacttgttatctcttgtctttttgataataggtattctaatgggtgtcaggtggtatatcagagtagttttgatttgtatttctcttataattagtgatgttgagcatcttttcatatacgtgttggtcatttgtatgtcttctttggggaaatgtctattcagatccattgaccattttttaattgggttatatgttttgttgctattgagttgtatgaattctttataaattttggatatgaaccccttatcacaaatacagtttgcaaatatttttcctaatctctaggatatcttttcattttgttgactgtttcctttgctgtgcataacctggttagtttgatgttgtctcatttatttattttggtttttgtatcctaagcagttggtgtgatatccaaaaaaatcattgccaaggccaatgtcaaggagctttaccacctgttttcttctaggagttttatggtttcaggtcttattcttgtttaagtcttttatccattttgagctgatttgtgtgtaggatgacaaaggtccaatttcattcttttaccttctgagtatatgcccaaaggaaatgaaagtactacctcataaagatacctgcacttccatgttcattgcagcattattcatgaaagccaagatatggaaagaacctaaatgtctgttgatggacgaatgtataaaaaactgtggtatatatagacaatggaatattattcagccttttaaaaaggagatcttgccatttgccataatatggatgaacctggaggacattatgctaagtgaaataaaccagatacagaaaaaaaatttgcatgatctcatttgtatccggaatcttaaaaaaaaagtcaaataaatatacagagagaataaaacagtggttaccagggccaagggtaggggcatgaggctaaggacacaaagtagcagatatgtagaatgatcagatctagatgtctgttatataacaacatgaagactatagtttataatagtgcattatgttttggatttttgctaaatgagtcaatggtagctgttcttgccacaaaaaaatgggtaactatgtgagatgattgatatgttaatttgcttcactatagtaaccattatactgtctatatgtatctcataatatcatgtcatatactttaaacatacacaatgcaatttcttttaaaaaggaagcatttatttacaaaaaaactactgaaccttgggtaaaaacagtgggaatctgtggtgtattttagcatggggtgctcccactcctattcctccacctctagctccaatcagcagtagttccacgaaggtgggctaaaccaagaaaaccggcagctttgctgtcaaatatgactaacttgatttggagcagagcatgcataaaacccccatgcatctgggtgttatcaaaaacaattagggaagccatactggttggagcaaacaacagaccagaagaacaggcagaaatctaaccaggctatatagggagtgagaaagctataatgggccttgaaaagctcccacacatccctagtatttggaaggttgcacatgcatgcagtgctgtatgcacactgaagagagactggaaatggctccagttatttacatgtctctggatgaaaatgaggctttttgtaggagacatgagaatgacagaaagtaaaaaccaggacaaacttctatggttagtctgtttgcatcattatagagaaatacctggggctaggtaacttgtaaagaaaagagatttatttggctcatggttctgcaggttgtacagaaagcatagtgctggcatctgcttctggtgagggcctcaggaagcttataatcatggcagaaggtgaaggggagctaacatgacacatagtgagagagagagcaagagagagtgaagaagtgccaggctcttttaaacaactggatcttgtctgaattcattactgaggggcaggcaccaagccattcatgagggatttgccctcatgacccaaatacctcccatcaggccccatttctaacattgcagatcacatttcaacatgagatttggaggagacaaacatccaaaccatatcacttgtaaatagctcaaacttcaagtgtatgcctcaaacaacacacagatcctctggcaaagggtggaagccttattacattaagttttttaagcataacctctgatcaatacttggctggcctctaaactatatcaggaattcccaacctgatgcctcaactaggcctatggacatctgggccagatagtccttttgtcatagggacaggtgtcagcagcatcttcctctccagttgtgacgacaaaaaatgtctccagacaatgccaaaggtcctctggggggcaaaatagaccccaattgagagcctctgggctatggtgaccccagtgcaatgcttaggaaaccacagttaaaaataaaaacaagaagtaaaaataaaacctgagcagagacatcagtggctacacactgcagggcacaaagactccacagaattaccccagacaacaaaaaaatacacaaaacaaacaaatacacaaaatacaaacaaatacacaaaaatatgcaacaattcctctggggacatgagaactcagtttccataaaatattatctaaaatgtccagattttcaacaacaagaaaagatcatgagatatgtatagaaacagaagggttacctacacacagaaaaaaagcaggcatcagaaaccctctgagaatattacagaaaatcctattgcctaagtcaaacatgcagatagaaggcaacttacgtcctgcagaaaatgtctttcccttctaatagtcttgagctttacaggagagaagcagaatggactattggggcatcacctccatgtacctatattatttcctcattataagccaacacttggtctttactgagtcattttgtctgtgacagcaggcatgccttatacaagtgctttcaaggtataccccaactggatgcttgaaaatgtatagatactgaacttaattgaaagactgtctgatacaactgctgatactctgaaatagggctattcatttggtggtgccctacagttggagttcttgtcctagggtgtgtggaataatatgcaaaattcgtgtgtgtgtgtgtgtgtgtgtgtgtgtgtgtgtgtgtgtgtgtagaatttctatggggtctataacctaaaaatattgagaaccctttccctagagtgacaaaagtgtttgagtaccactaacccttattcagtttggtcattgcagtgagatgatgcacagttcaacaaactacagcttgtgggtcaaatatagtatgtgacctattttgtttggcttgcaagataaaaaatggtttttacacttttaaagtgtaataaaacaaaaacaaaacaaagaaaatcactgtaatggttaactctatatgtcaatttgactggaccatggggtgcccagataagtggctaaacattaattctgtgagagtgtttctggaggaaattagcatttaaatcaatagactgagtagagtacattgccttctgcaatgcgggaataattctatctgcctgcttgaactgggatattggtcttttcctgttcttggactgaaacttacatatcagccttccattttaggcctttgaacttcgactagaacttagaaaggttctcctggttcttaggccttcagactaaactggaatcatatcaccaggtttcctgggtctcaagcttatggatggaagactggtactttttagtttccataattgtgtgagctgattcctttacacacacacatacacatgcacacacacgtgcacacgcacacacacacacacacacatatatatccccctattggttctgttctgtttctctggagaacactgactaatatagatattggtactgagaagtagggtactgctgtaacaaatacctaaaattgtggaagcagctttggaaatgggtaatggggtagaggctgaaagagttttcaggtacatgctagaaaaaagcctagattactgtgaagggattgctaatggtgtttctggtaagaggtcagaaaaaaaaagaggacagctagagggaaagcctccatgttcctagagaatataaataattgtaaacagaatgctggtagaaatgtgaatggtaaaggccattctgatgaggtctcagatggaaaagaggaacatgctactggacaaaggaaaaaaaagtgacactttttataaagtggcaaaaaacttagctgcaaagtgatgagagagcagttggttccttctgactgcttacagtaaaatgcgagaagagataaatgaattgaagaaggaactgttaaacaaaaaggaaccaggacttaaaagatttagaaaattctcagcttatccatattgcaaagaatgagaaagtatgtttgaaagagaatactaagggtgtggctgatccacatttgataaggagataagtgtgtgcatgaaccatggtcctagtcagccatctcaacagaagccataaacagagatgggattataccagcagaaaaactgccagctgggaccaaaaagaacagagaaaatgggacaaaattgaaagagttgtgcatgtgctatttattcctcaaaaaaagggaagagtgaggctaaaggcaatttagagatcatcggggctgccactcccaccacaggcccaaggggcagggctagttcttcctcaggctagagtgcagtggtgcgatctcggcttactgcagcctctgcctcctgggttcaagcgattctcctgccttcgtctccctggtagctgggactataggtgcccgccaccatgcccagctaatttttgtatttttagtagaaacaaggttttgctgtgttggtcaggctggtcttgaactcctgacctcaagtgatctgcctgccttagccttccaaagtgctggtattacagacatgagccacctggcacccggccttatttctctctttttggaatgggactgtctctattgtacctgtcccaccttcctattttggaagcacatacttatctggtttcacaggagaagaaattttgcctcaggataaattgtacctcaagtctcacccatatcaaatttaggtgagatttagttgagactttggaattttcatctttagagtggatgctggaatgagttaagacggggttgttgggatggaaggtatgtattttatgtgagaagaatatgaatttggggaatctatgggtggaatgtaatagactgaattgagtctcccctaagtccatatgttaaagctctaatccccaatgtgatggtatctggagatggagactttgggagataattaggccatgaaggtagattcctcatgatggtattagtgctcttataacaagggacaggagatggagccctttatctctccaccatgtgaagatacagcaagaaggcagagggcagccttctgcaagccaggaagagagtcctcaccagaacttgactatgctggtgccctgatgttggattttgtagcctccagaactgtgagaaataaatgtctgttgtttaagccacctgggctatggtcttttgttaaagcagcctgagccaactaagacaaccatgggacagagattgtacatggcccaaaaaaagcctaaaatatttactgtctggctgtgttagtcagttcaggctgctataacaaaattataatagactgggtagcttaaacaacagatatttatttctcactgtctggaagctaggaagtctaagatgagggttccaggccatttgattcctggtgaggacactcttcttgctgtgcagatggctaccttgttgctatatcctcaaatgatagagatagaatgtgctctctcttataatggcactaattccatcatgaggactccaccctaataatctaattagctctcaaaggttccatcttcaagtaccatcacattgggagttaggcttcaacatatgaatttggagaaaacacattcagtccatagcactggccctttacagataaaagtctgctgacctctgagataatctgtagcagaaactctttttttcatcctctccttcacttctagtgagttggcaagagtagctaatactaccaccttaatagcatttgaaacctaactaacccctgtctccatttaagctccacacatcagtcagaatactctttccaatgaaatttagcttagaatcccttaagtagtttcccattacaataaagaccaatctcctcaagattgcctacaagggtctgcacaatgtggccccggctaacctctgtagcatcttttgtcaacccttccttgcacttgatgtagcagtccatataggccaatatgacatattctctgtagcctaactcttgtacatatagtttgctctaactgaaacattcttcttcactgcctcaaccctcttcccctgcctagttcatattcaatactcatgactcagcaggcagtcattcataactctccaggttggattaagtacctttcctctttgttcttacagcaccctatgtatttcctaaaagaatttctcatcttgtcttatgcttgtttatcattgccacaagactgtgagtatcttgaggatagggaatgtgtcttcttcctctctgcatgctttgcacttaggacaatgcctgaatcctggtaggtattcattaaatgtttgttgaataaatcaatggtaaatcaagcagtggtgcagctgccttactggtaactccaatacaggccacatatctacaaatgatcttctcctgctctactagatagctagtaatcctgactatatgctatattccattttcaggttaagagttgctagttatataagcagtgtagtagtggaataaactactgtgtggctagacttgccttttagtaggcttcaatatatcccctcattttagttaagttggtatgcttactgtccttttgctgactggaatccattcttgccttttcacttgtaacttttctccttgaaatcacaggagaaattaattaaaggactttctgattaaatgaccaccttctccttcaaaatatagctaaaaattcatttattcaaggcagcttctttgaataatgtatttcctctttgaaattaaatatttgataggtatcaactcaatttacatttgtgtctggcataagctaattatgcttcttatatttatttacttattttattcatttcagggactctacatcttacattgagaaagggaatcttccatctttggttctctaacagttcttagctcagttaataaaattaacactcagcaaatgcttattaattagatcttatcaaaattttaatacagaaaagaaatttgaaactcaccttgattcatctcttttataacccacatttaatcaatcaccaaggtctgttgattccacttcctaaatctttctgaaatccatataacctctccatttacactcctttctcctgccacattcaggtattcatcatctatagacactgggacactataaaaggattttaaaaatcaaggcagtaaaatcagattggagtttagaaagagcactctagtttcaggatggataatggatcatcaggagagcaagacaaggctgcagtaatcctgttaggatagttacctcctcgcttctcaatgttgtttttggaccactttttctccctccttcctctaaaacccaagcttctttgaagatcatgctttcttaattattctaatcaagtacctcttgagtcactctccatttttaatgaagaccagtttactgttgtccactttatcctttccctgtcatccttggcaacttcatcatcattaatgacagtactctcaaaattttcatttaaaacattccatactctagccacctcttattaccattccagttcaattattctggcactcctcaccccgataatccttcaaccccataaagagctccaattcattgaccctaagctccttttcactctctgtcatcttgtttcctttaatgtcctcacttacctccttaatgtcctcacttccctccttacagagcccatattccatggtccatcattttaatcaattccctgcaaacattcttaacttccttgtcccctctctctgtgccatacttctctgacaaagccccaaccatggtaaactcaagttcctacctcctgtgcagccaagcagctgaaaattgctggagaaaaatttttcttttatgttttatttttttaattgacaaatactgtgttttgttatcttgtaaacatgatgttttgaagtatatatacattttggaatggctaaacctaaccaattaataaatggattacttcacatagttattatttttgtggtgctagtatgtaacgtcaactctgtttttcaagaatacaatatcatcattaactatagtcattttgctgtatgatagatctcttgaaatgtattcctcctatctaactctaattatgtatcctctgaccaacatgtctccatcttccctcccctcaatcaccctagcctctgataactaccattatactcacttctatgagatcaaattttttagattccacgtatgagtgagataatgcagtatttgtcttcctatgcctggcttatttcctttaacataaattcctccaggttcattcacgttgctgcaaatgacaggatctgactctttttatggctgagtagtattacattgtgtatgtatacctcacttttttcatccactcatccattgatggacgcttatgatggagaaaattttaaaaactgcactggctagtatcattttaaactcatcatgaaaaatctcaaattagtactcaatatagccaaataattcttgcataatttcctagtaaaatcactcactctctaagaagactgtgtcataccatctccccatcctcaaactgccaacacctcctcacccttcacactttcaactgatgaccttgcttcttccttcaaagaaaatgtagaagcaataagagaatcttcacaaactgatgccccatatccaatcacttacctgcatctgtgcccatatattccacctttctttctgttacaatcgttgaaatatctgtgcatctaatcaaggtcaatacttccatttatgaactagattctatctctttttcatactcagagactatgctcctgaagcagttctattcctctcttttgcatcaccaaattttccttccctattggatcatcctcattagcaaacatgtaatatctcccatattaaaataatattccaggagtgccatcagcaagatggcagaatagaaaaaaaagaccctccttcccccatggtttgaataacaatttatggaacaattgcctttatgacaaattcagaaatgagttaaaaggttgctgcaccccaggcaagtgcaaagccaacctcaccaaaacccagtaggaaaattcatggcatttcttcaccagagactcttctcccagcttggtgcattgtaactgagaggaaacccctacctcctgacttatcctaggggggaaaagaagttgaatgtccaacattctaacttttcagggtgttatctaaaagattggtttctgtcttgcctgaatctaagaactgacagcaatgggatgccaggttgggggcctgctgagaacaaaggtgatcaatgtggcttggcctggcaccagagtctgtagaccacagacagacattatgtggagctccaataccctagtttactacagaaacagagagatggcagtatcacagacagacatcaaggggaactcctgaatagaaactgataaatctcttcaactagatgattatatgcacaatcccagaagagtatgccttcccaggaaaggattaggaggtctctggattctttaactgggctaattggagaatgtcctccttgtatgcaaccagaccacaaagactgagaaaggtagctgagctttcaaatgttaaagtctcaacaagatatagtaagacatacgaagaaacaaagaaatgtggactattcaaaggaataatttaaacctccagaaagcacccctacagacatagagaaatataaattaccaaaaactcaaaataagcatcaccagaataattaaagaattaaacaagaacatagataggcaactaaacaaaattaggaaactgacatataaacaaaataagaatatcaacaaataaataaaagtataaagaagaatcaaacagaaattctggaactgaagtatctaataatcgaattggagaaattcactggagggattcgatagcagaattgaccaggcagaaaaaagaattagtaaactcatcgatagggctttgaaattattgagaaagagaagaaaaaaacaacaaagaatgaagaaaaatgaggagagcctaagggatttatggggcaccaacaagcagaacaacatacgcatgatgcaaatcacaaaaggggaaaagagaaatgagtagagagcttatctgaagaaatgatggctgaaaactctccaaatttgatgagagaaaaggacacacaatttgaataaacaaacaactccagttggaataaatctaaagagacctacactgagacccatcaaaatccaactgtcaaaagtcacaaagacagaatcttgaaagtggcaagaaaaaatgactcatcacatataagggagcttctattaaactatcagctggtttctcagcaaaaccttgcaggctagaaaggagtgaaataatatattcaattactgaagaacaaaacctgcccaccaagaacattatattttgtaaaactgtccttctaaaatgaaggagagattaagacttcccagataaacaaaaggagaggaagttgatcaccactcaatctgccccacaagaaatgctaaagggatccttcaagttgaagaaaaaggatgataaatagcaacacaaaaccatatgaaaatataaaccttctgataaaggtttattgtgtagaattgtaatataagtgtgtaaatcacttttaaatatggtataaattttaaaaacaaaagtaacaaataattatagatctatgttaatggatgcacattataaggaaaggatgcccaccctcaatattactattgttgaagtactgggattcctagctagaaaaattagacaagaaagagaagtaacagaaatctaaattggaaaagatgaagtaaaattgtctgtattcacagatgacatgatcttatatgtagaaaaccctaaatattccatatgcaataaaaagtattataactaataaatgatgtcagaaaatttgcaggatacaaaagcaatacataaaatgcattgcatttctatatattaatggtgaccgatctaagaagaaaaattaagaaaaaattccctttatttattttattttattttttattatactttaagttctggggtacatgtgcagaacatgcaggtttgttacataagtatacatgagccatggtggtttgctgcacccatcaacctgtcatctacattaggtatttctcctaatgctatccctcccctagaccccactccctgacaggccccagtgtgtgatgttcccttccctgtgtccatgtgtcctcattgttcaactcccacttatgagtgagaacatgcgatgtttggttttctattcttgtgttagtttgctgagaatgatggtctccagtgtcatccatgtccctgcaaaggacatgaactcatccttttttatggctctatagtattccatggtgtatatgtgccacaatttctttatccagtttcacactgatgggcatttgggttgtttccaagtctttgttattgtgaacagtgctgcaataaacatatgtgtgcatatgtctttatagtagaatgatttataatcctctgggtatatacccagtaatgagattgctgagtcaaatggtaattccagttctagatccttgaagaatctccacactgtcttccacaatggttgaactaatttacactcccaccaacactgtaaaagcgttcctatttctccacatcctctccagcatctgttgtttcctgactttttaatgattgccaatctaactgatgtgagatgatatctcattatggttttgatttgcatttttctgatgaccagtgatgatgagcttttttcatatgtttgttggctgcataaatgtctgcttttgagaagtgtctgttcatatcctttgcccactttttgatggggttgttttttttttcatgtaaatttgtctaagttctttgtagattctgaatattagccctttgtcagatggatagattgcaaaaattttctcccattctgtaggttgcctgttcactctgatggtagtttcttttgctgtggagaagctctttagtttaatcagatcccatttgtctattttggcttttgttgccattgcttttggtgctttagtcatgaagtctttgcccaagcctatgtcctgaatggtattgcctaggttttcttctagggtttttatggttttaggtcttatgtttaagtctttaatccatcttgagttaatttttgtgtaaggtataaggaagggatccagtttcagccttctgcatatggcatcaaaaaggatgaaatacttaggaataaacttaaccaagttagtgaaacacttctacagtgaaaactacaaaatgttgctaagataaatcaaagaaaggtacaaataaatgaaaaggcatctcctgcttatggattggaaggcttaatgttgttaaaatgtccatactacccaaagtgatctacagattaaatgcaatgcctatcaaaactccaatggaatttgttgtagaaacagaaaaaaaccttcctaaaagtcatacggaatctcaagggaccctgaatagtcaaaataatcttgaaaaatgagaccaaaattggaggcctcgcacttcccaatttcaaaacatgcaacaaagcaacagtaatcaaaatagtattgatgtatgaaaaagtctttatctctcacttttgaaggatcattttgctggatatataattctacattggtagttgtcccccctttaacactttaaggttgtcattccattgtgttcttgcttgcacagttcctgatgagaagtccactgcaattcttatctttgtttctctgtaggtaaggtgtttttctccccactaggctgccttcaagaatatctctttgtctttggttttctgcagttttaatataatatgcccatgtgtgaggtcctgcttgtttattttaaggggtgtgtgtgtgtgtgtgtgtttatttataatgcatttgttaatgtgtctatttttatgccagtatcatattgttttgattactattgctttgtaatatattttgatatcaggtagtatgatgcctccagctttgttctttttgctcaagattgctttagccattcagggtcttaagttgaaaacttttcctttcagatcaggaacaagacaatgatgttcactcttcctactcttactccacatagtactggaagtcgtagccagagtaattaggcaagaaaaagaaataaaagacatgcaaataggaaagaaagagatgaaattgtctctgttcactgatgaaataatcttatatatagaaaaccctaaagagactaccaaaaaactgttagacttaatgaattcagtaaaatcaacatacaaaaatcattaatgcttctaaaccctaacaatgaactaactgaaaaagaaatcaagaaaacaatgctatttgtaatagttgcaaaaaaatacttaggaataaatttaaccaaggagattaataatctctacactcaaaactataaaacattgattaaataaattggagaacacacaaataaatgaaaaaaattccatcttcgtggattggaagaattaatattgttaaaatatctatactattcaaagtgatctacagattcaatgcagctcctgtcaaaatttcaattacatttttcacagaaatagaaaaaatcctaaaattctgactgataatttcaacacctgtgtcatatgtaagtctggttctgatcttgctttgtctcttcaaattgtgttatttcttgccttagcaagttttgtaatgttgttattgttaaaagccagacatcttgtatagagcaatagctactgaggtaaataggattttaccatgaatatttatattaatctggcctggagttaggttgtgtttgatgtttgttgtctctgtgggtaccagaagcattaaatttctctagtgattttgcttttgtcttctctcttggccttggcccttccctttgtgctgtacctcagagacaggctgtctcttgcagctcttccagctgtaatccactgtcattttaactggaggcttattagcttgttgtaggatgtggggggatgagggcattctacaatcttcagattctcagtctttggagtgcatagtgggcctgtgtcttggaagtgtgactttaacaattgtttttgtttctcttccagggtgtggtagattgaactgtaaccctcaaaaagatatgttgaagtcctaatccctggtacctgtgaatgtgaccttatttagaaagcctctttgcagatgtaatcaagttaaaatgaggtcacactggattagggtgtgttctaaatccaatgactgctatctttataaagagaaatatttgaagacagagattagatattgagaagaaggccatgtgaatatgaaagcagagattggagtcatgctggcacaagcaaagtaaagccaaggattgccagcaaccataagaaactagaaaaggcaaggaaaaactctctcccaaagggagcatggccttaccaaccctccaagactatgagaaaatacactgttgttttaaatcacctagtttgtgtaatttgttatggcagccttagaagactcatacacataggtaaagtattccctcctgccaactaatactttctgtggttctaacattcctagtctatatctttgaaaccctctcccttgtatattaaggctttcttttctttatttttttttcccttaggtaagacagggagatggagtggggctggagcaggctgagttgccttcccctagttgagaagggatttcactattgccctctgttatttttgtctttctcccaacttgtaggctaatcttaaaaataaatggctagaggtcctgtcaactccacaaaaagtattttcagaccacacaaaaggtatttatcattgcataacaatgtgaattgtacacttaaaatggttaagatagtaaattttgtactatgtgttttcttaccacgattttatcattccaatttttgatatatgtgctgccaaagcaaacatttcttaccacaagttttaaaaagtatctgtcttcacacatctcttaccaaaatgatcttcatgttgctgccaagcacaagtcagagacttggaggctgtatggtgccaatggacagctaaaggaagtaagcttttgaagttgggctgtggaagggccggatatatgactcctcccttcagcaagtcctgaagcctgctgtgtaggtgggacaatctgtggtaccacatcctagaagattggataataacaagttagtagtaatatacaacaacttttatgaggctataggaataacactacagatataattatgtaaaatgatagatttaatgatctcaatacagaggattaaacaaaggagaaattgtgaaaagttaagcataagtgatctataaccattacttacattttctcattagccactcttattttatgtcatacaatcttccttttggcctactacctaactgaagcagtgctttaaaaaattcactaatcttaaccttccaaatacatacagtcatctgcataatgacatttctgtcagtaacagaccacatatatgatggtggtcccataagattataatggagccgaaaaatcctattacctagtgacatggtaatgtagcacaatgcattaccttttctatgtttagatgtgtttacatacacaaatgctcagcgttatgttacaattgcctacagtattcagtacagtcacatgctatacaggtttgtaccctaggagcaacaggctatatatatcatatagcctggacgtgtagtaggctataccatctgggtttgttaacactctaggatgttcatacaaccatgaaattgctgaatgaggcatttctcagaatgtatccctgtcgttatcctgtcaactgacccataattgtaaaaggattatttttcatgtctcatccttctgggtctctctgcttgtgacactactaatcacccctattccgactatgtgaaactttcttctccgctggttatgtgtgctgtgggcaagttacttaaaccctcagtgactccatttcttcctttgtaaaatgaggttgataatagtatttatctcatggctttactgtgaggactaaaatacttagaattatatgttccatactaagccctacatatgtatcactgctattactatcgttattacggctgttgttaggcataaactttatgttgggaaaatgccttgataaacctgcttggagttggtgatgctgagtagcatagttttagaaaaattaataaaacaacaccatttgcataaggtcttaaaaggaattaatttgtcctgtggcagaagactgagagagctatgtgattgcagataggctgtgtggttctcaatgtgaaccttctcaattacaccctcaaatatgcagtagtgtaattaaacccacaaaatgcttatgttgagtggactggtgagtgcctgtgtgtgtgtgcgcgcatgcgtatgtgtgggtatgtgagttgtaagctgatgaaaggactgaacttcatgctgatatgggatgaaaccaatcacataaattaaagccatagctagagatataatagaatttactaatcactagggagcagtctgtaattacaggatagagaatggaaggctaaagtcaaatttattgagattttgtggctgagggcaaagaggagagcacagaaactcctctgctgataatctgggttacatttatttcttcactgtctcttgtttccaacctcctacctacagatactgtctgaaacaggggctggcaatctgtgccccacaaactaaaaatggattttatattttttaaggagttgtaaagaaaaacaaagatgagtatgacaccaagactccagaccaagaccagactagaatttcttctttgtagtctatgaagtctacaatatgtgctatctggatcttcaaagaaaaaaaatttccaactcctagtcaaatattaaattcttaatcaaatactcttctcccactacatcgaaaaatctcccaaaaatctactcttaagtatattcactcacttcattatttcacaaaataaatattactaataggtactttttttttttttgagacggagtcttgctctgtcgcccaggctggagtgcagtggcgctatctcggctcactgcaagctccgcctcccgggttcacgccattctcctgcctcagcctcccgagtagctgggactacaggcacctgccaccacgcccggctaattttttgtatttttagtagagacggggtttcaccgtgttagccaggatggtctcgatctcctgacctcgtgatccgccgcctcagcctcccaaagtgctgggattacaggcgtgagccaccacgaccagctataataggtactttcttaagtattaagatacaaacataaataaatcagcagtcctagccaccattcaagatgttcacaaactagcagggaagaaagacaagtacagggtgataactactactatttataatagttttaagcatacaacacagtgaaaggtgcaaaggagtaagaagttaaccatgcctgaggaaagtggtggagctccacatgactagtgttctttgaagaaggtttcattgttttatattaacttaaaaataaaactgattgtaaaaaaaaaaaaagatgggattgttggaggtgttggaaataatccacacaaccctgaaatatataaaataataagtaaaagcctctttctttcattatttaccaccccattctttcaaggaaactgttgatgaggtttggcatatacaatgacacatataattaaaatctccacacctgctatagacacatacagaaatacatatgtatttaaaccataaagaatggtagaaaacaaagtctctcctcccccatttcccataatctcactactcaaatgttaccagtttcaatttttagaaatcagcccaagcaaaactggatatccatatgcagaagaatgagacccctacctcttgccatatacaaaaaatacaatctaagtgaattaaagacttaaatctaagaccgcaaactatgaaactactacaagaaaacattggggaaacataccaggacgttggtctgggcaaaaatttctggagtaagacttcaaaagcacaggcaagctaagcaaaaatggacaaatgggatcacatcaaattaaaaagctactgtacatcaaaggatacaaccaacaaagtgaagggacaacctggagaatgggagaaaataatttgccaaccacccatctgacaagggattaataatcaagcaatttgcaaactggcagcaggtatctgaaattcacacaactgacaaagtattaatatcaagaatatttaaagacatcctacaggctgggcacggtggctcatgcctgaaatcccagcactttgggaggtcaaggcgggcggatcacaaggtcagcagtatgaggccagcctgactaacatggtgaaaccctgtctctactaaaaaatacaaaaattagccgggtgtggtggcacacacctgtattcccagctactcaggaggctgaggcaggagaatcgcttgaacccaggaggcaaaggttgcagtgagctgagattgtgccactgcactccagcctgggcgacagagtgagactctgtctcaaaaaaaaaaaagacatcctacaagtcaataggaaaagcaaacaatatgtgagcaaatagtatgaacagacatttctaagagaaaacacatatggtcaatatggtcaatcaattcatgaagagatgttcaacctcattaatgattagggaattgtaatctagtcacagtgagatatgatataaccatctgatcggcaaaaattaagatgtctgacaatagcaagtatagaggtcttgcacatctttcattgaattcattcctaagtgatttcttgtgctattacaagcagcattttaaaatttcaatttgtaattgctaacagtatacacaatgcaactgacttttatattctgacctggaatgctgtaatcttaataaaaacagttattacttccagtaagcgctttggaaatttctcagcattttctatataaggaatgtcatatatgaatagagttctacatcttcttttgcaaactttataccttttgtttgtttttttgctgcattgtgctcactagttaggaggagtaagcatggacaaccttgccttgttcctgatcttaggggaaaacattctagtttcatgattaagtatgttgttagccatgtttttggatttttttgttattgttattaatggcctttttctggttggggaagtttccttcaattcctagttttctgagagtatttatcaggaatatgacttgaattttagtaaatgtactttctacatctattattttatggcttgttgctttattctagtaaagtggttaattattctaattgacttcctatgttaaaacaaccttgcatttctggaataaaccccatttgattatgatatattatcctttttatacattgttggattcaatatgctgaaattttgtttcagtattttgcatctagatacatgaggaatacatggtctggtgtgtgtatgtgtgtgtgtcatctttatcaggtattttatcagatttatgctgggtttttaaaattgtactttaagttctgggatacatgtgcagaacgtgcaggtttgttacataggtatacaaaccatggtggtttgctgcacccataaacccgtcacctacactaggtatttctcctaatgctatccctcccctagcccccactccccgagaggccccagtgtgtgctcttcccctccctgtgcccatatgttctcattgttcaactcccacttatgagtgagaacacgtggtgtttggttttctcttcctgtgttagtttgctgagaatgatggtttccagctacatccatgtccctgcaaaggacatgaactcatcctttttatggctgcatagtattccgtggcgtatatgtgccacattttctttatccagtctcaaattgatgggcatttcggttgtttccaagtctttgctattgtgaacagtgctgcagtcaacatacgtgtgcatgtgtctttatcgtagaatgatttttttttggtcttgcaaaatcagttttattgtaatatgcatatatgaaaatttacccatgatgcatagtcgcaatcctaatttaacttgtcctaattaaactaatcctaaagtaactaattttacttccatttttattatgtgtgaaaataagttctttctataatgttttgtactattggtctacttgcttgcttgcttttccatccattgcaatatttgggaatggattacaaaaagatacttggataagtagcactgaaagctgttaaaaacagaatatcaattcctggagtatgtttctatctggatgcacacgaatgaaataattgaactctcaaagttcttttcacgcccttaattcaatgaagcaattcctgaagcaacacattcacatctcatagctgatttacatgtttccttttgctagccttctcttttggactaagttttctccttactaatgtcagttcaaactggtgagacttcagacaagtggtttctcaatcctgatggcacaatagagtgatgtggggaactttagaaaagttctgatgatccggccctgcccctagagactgtgattaaatattttgagtgtatatgaaccacttggttatttggttactatgtcatcaaagcaggttaaaaacgaggggaaaagccatttttttcttcagcctggctatcttgacaactaacaaattattttttaaccccaaaagaaaagaaaaatgggaccaaagatatttttacttttagtaaataaagcgcatcaactctcaaaaggtgcttggccctttaaacggcatggcaatgcacagaaagacagttgggtgaggctgcatgcccttcataaccatttcaacacctacctcgggtcccaaaataaatatttttaatattgtctcattctggactgttccaacatgcactatatcagcttgtctacatattctaatgtaactgcatacaagtttccagcagctcatgtattttctttttttttattatactaaaagttttagggtacatgtgcacaacatgcaggtttgttacatgtgtatacatgtgccatttggtgtgtcgcacccattaacccgtcatttaacattaggtattcttcctaatgctatccctcccccctccccccaccccaaatcctttgggtatatacccagtaatgggattgctgggtcaaatcgtaattctagttctagatccttgaggaattgccacactgtcttccacaatggttgaattaatttacattcccaccaacagtgtaaaagcgttcctatttctccacagcctctccagcatctgttgtttcctgactttttaatgatcacaaaataagttagagaatgttacctccacttcacttttcagttctagtatttccacttggtccttatttagaaattctgtttatcctctgaagttttccatctgttcattcattccacttatttgctcctgtaagttctctaacatatttacaataacagttttaatgtcctggtcagaaaacaccagtatctgggttatctgtgagtctgcctttattgactattgtcctccctccttattatgactatttattcattttgttatatatgtagtattttttggaatgttggatattgtggatggcgtgttttagatggttttgtaaataacctttatcagaagttactttttattcctagtttgctaaaagactttttctctcataaatggatgttgaattttagggttttttttgcatttattgatttgactgtatgatttttctcctttgtttctgtggtgagttaccttgattcactttcaaaatgtaaaccaactttgcaacgctggcataaaccaaactacaatagggtatattatccttttaatacatcactgtttacaattttctaatagtttgttcgaaattttgcatctatattgatgtgtaaaattaacccaaattttcctttctcatattttccttataatattttagttacagtattattctaactttataaaaagagttgtaaagacatctattttcttctgttctctggaaaatgtcatgtgagattgatattatttctttcttaaattttgatagaattactcagtgaaggcatctgagtcttggctttactttgtgagatgggtttgagttacttaatagttataggtcagtgcagaaatttatcttcttgtgttctttttggtaagttatgtttcctaggaatctatgtattttatttaaatttttagtatactgacttaaaattatttacaatatccaattgtaactgttctgttttatgatatataatggtagctcctgtctcattcctaatattggttatttatgctttctctctcttcttttgtttctttatccatatttctagtggtattatcaattttattagtcttttcataaaagaaactttcggtttcaataatgctgtctgtcaaatatgtctttcttacaggaaattctgttcttatctttgcttccttctacattctttaggattaattttctattgtttttccaattccctgagatggatccatatgtcattgattttttagcctttcctcttttgtggaatatgcattttaaggacacaaatttcccttacagtaatggttaaacagtatccctttaaattttaagatgctatatttccatttctcagtcagctcaaaatattttctattttacattgcaatttttaaaaatttggcccacaggttattttaaagtatactacgaattttagggagattttctaatttatttcttgttttctaacttaatgtcagtgtggccaaaaaatactataattgtttaaagtttttgagatttgctttatggctcaacacatcacgtatttttctatgtgcagaaaagaatatgtattctgcaattgttgcatgtggttgtctatatatgtcaattaggtcaagtttgttaatattactgtccaactcttctatataattattggttttctcttttttgtctgatattctatcagttactaagggatatattttaagatctctgattatgattgtgaatttattgggcatcagtaaatttttgctttgcctattttgagtgttaagtgcatacaaatcagaataattgtatcttcttggtggattgcccctgttatcattataaaatagctctatacttagtaaatatttctaccttaaagtcacctttgtctggtattaatatagctatatcagctttcttttgggtagtatctgcattctatacttcttccatccttttactttcaatcttcctatatctttccattttatatatctcttataaacaagatgtagattttgtattttttaaccattctaataatctttgtcatttaactgaggtattcagtccatttacatttattataattactgatatatttaactctactatatcactatttactttctgtttgtcttgcctattctgttatcttttctctccttgctttgttttgtactaatatggtaatttgtattattcaatttactccttgtttaattcttatacattcttttactgtttttagtgattattctatgaataataacatatatatatgacatattaaagtgtagcacaaattagagggtttatgttaactccatttatcttcctccctcaagtgctattattgtgtattttaattgcatacacatgcacgccacatgacattactatttttattcattcattcattcattcattcattcattcattcatttatagattcagagcctcgctctgtcacccaggctggagtgcagtggcatgatcatggcaaactgcagcttcaaactcctgggctcaagatcctcacctcagcctcttgagtagctgggactacaggcatgcactaccttgctttgccaagacattactatttttttaaatatgatcaatgaacattcagatctacccacatatttaacctcccccctgcacttcattcattatatatttccaagatttcatttaggatcagtttaattctgcctgaagatccttaatatttcctttggtttttggtgacaggttccctaagttatggaccatctaaaaacatctattttacttccattttaaaaggctggatatagaatttaccagataaaattttaggttgacagttaattttgtcagcattttgaaaatgtagttctatcgtcttcatgttgtttttttgaaaagtcaaagccaatctaattgctattccttgaaaggtaatactttttttttctccaaatgcttttaagacttttttttctttatttttttggcagttcttactaaatacacctagatgagggttttttatttatttattctgcttcgggttatggtactttttgaatccacgaactgatgcttgtgacaggcagatttctaagatgacctccagttacccttgctgttgtaaaatcttttcccctggagtgtgagagggattatgaatatgataaggtttcacttgcattattacattatgtatatgggacagctgactttaagaaaggggaatggcccttggttgggattacctaatgcagcaatcctttgaaagagactggtctcttcttttttttttcctttttttaattatactttaagttctagggtacacgtgcaccatgtgcaggtttgatacataggtatacatgtgccatgttggtttgctgcatctgtcaactcatcatttacattaggtatttctcctaatgctatcccttccccagctccccaccccctgacaggccccagtgtgtgatgttccccaccctgtgtccaagtgatctcattgttcaattcccacctatgagtgagaacatgcggtgttggttttctgtccttttgatagtttgctgagaatggtttccagcttcatccacgtccctgcaaaggacatgaactcatcattgtttatggctgcatagtattccatggtgtatatgtaccaaattttcttaatccagtctatcattgatggacatttgggttggttccaagtctttgctattaggaactgtgctgcaataaacatatgtgtgcatgtgtctttatagcagcatgatttataatcctttgggtatatacctagtaatggaatcactgggtcaaatggtaattctagttgtagatccttgaggaatcaccacactgtcttccacaatggttgaactagtttacagtcccaccaacagcgtaaaagtgttcctatttctccacatcctctccagcacctgttgtttcctgactttttaatgatcgccattctaactggcgtgagatggtatctcattgtggttttgatttgcatttctctgatgaccagtgatgatgagcattttttcatgtgtctgttggctgcataaatgtcttttgagaagtgtctgttatatcctttgcccgctttttgatggggttgtttttttcttgtaagtttgtttgagttctttgtagattctggatattagccctttgtcagatgggtagactgcaaaaattttctcccattctgtaggttgcctgttcactctgatggtagtttcttttgctgtgcagaagctctttagtttaattagatcccatttgtcaattttggcttttgttgccattgcttttggtgttttagtcatgaagtccttgcccatgcctatgtcctgaatggtattgcctaggttttcttctagggtttttatggttttaggtctaacatttaagtctttaatccatcttgaattggtctcttcttagtgaaagagacttgaagcaagaaagggagttgatgccaggaagatttttcattggctttgaagatggagataactacgtggcaagtaaggcaggcagtctctagaagatgagagtgagttacagctgacatgcagcaatgaaacagggacttcagtcctatggttacaaggaactgaattcagccaaccagaaaggaatgtagcctggccaacattgtgatttcagcctttaatactgtgaccagagaactcagtcatgccacacctggacttctgtcctattatcgggggacctgccccgataatcacgtgggttcttttctagtttcctaagcatcggctggcttgagaaataaaaggacagagtacgaaagagagaaattttaaagctgggcgtcctggggagacatcacacattggtaggatccgtgatgccccacaagccacaaaaaccagcaagtttttattagggagtttcaaaaggggagggagtatatgactacgtgtgggtgacagacatcaagtacttaacagggtaatagaatatcacaaggcaagtggaggcagggcgagatcacaggaccacaggacggaagcgaaattaaaattgctaatgaagttttgggcaccactgtcgttgataacatcttatcaggggacagggttttgagatcaaccggtctgaccaaaatttattaggcaggaatttcctcttcctaataagcctgggagcgctatgggagactggagtttatttcacctctgcaatctcgaccataagagacaggtacgccccgggggggccagttcagagacctacccctaggtgcgcattctctttctcagggatgttccatgctgagaaaaagaattcagcgatatttctcccatttgcttttgaaagaagagaaatatggttctgttctgcccagctcaccggcagtcagagtttaaggttatctctcttattccctgaacaactgctgttatcctgttcttttttcagggtgcccacatttcatattgctcaaacacacatgctgtacaatttgtgtagttaacgcaattattacagggtcctgagacgatatacatccttctcggctgacaggattaagagattaaagcaaagacaggcctaggaaatcacaagggtattgattggggaagtgataagtgtccatgaaatctttacaatttatgtttagagattgcagtaaagacaggcataagaaattacaaaagtattaatttggggaactaataaatgtctataaaatcttcacaatccacgttcttctgtcatggcttcagccggtccctccgtttggggcccctcacttcccgcaacaacctatagaactgttagctactaaatggatgttgttttaaaccactaagtttgtggtaatttgatatgcagctatagaaaaataatgcaatgctgtattacttttcaaaaattcctcatcatcacgtcttcaaatattgtttctgtaccattctctctcctttttttctaggactcctattgcacatatatcagatctttacacatattaggtgccagacactgttaaaggtgctgaaaatatatcagcaaccaaaaatattcctatcctcatgaagcaccttttaatgacatcctgatcccccctacacctaaactgtttcctcccacagagttcctcctcacagtaaattctagtctcattcaaccagttgcgtaactcaaaaatcagtgcttcaaactcaatacttcattaaaaaaagttttccccccagtcaattatcaagtcatgataacttttatcccctaaatgattctcaaacttcacccaccgtagtgtatctctacttgccaacatgcctgtccaggcccatcattatttctcacttaaagactgcaacagccttctaattgacctatccactcttgccctcccttcaaactttttgcacatggtaggaagagttaactaaaatatgtcagtgtgtcactccatttgaatatctccctaggcttttcaatgtaaaatccaatgtccttaatgtaatgccttctactacctggttctgagctacctctcagcctaacttcctgctacttacctccttgtactttattgcttaaccccagatttaccatgttctttcatatttgaagaaactcatgttcatgctctttgttcaaactggaagcccttcccttcctattctgccttttattcatcttttaagaatcagtctagatatcatctcatctaagaagtcttctctaaactcccagaataaaccagtagctttcttttgttctctcataatagtctttatgtgtttcttcttaatacattatgttgaaatgatatgtttatatgtctttccccctaataatgctggatgttcctcaataggaaggcctatctgtctcattcattttgataccctaacatctagcatggttcctagtacttagcagaactccataaatgtttgtgaaaattgaattgaattattattcttccagcatcatagcccctttaaatctaaaatgtttgcttaatcttaatgtctgcttaagatattttgcttaagtaaataatattgactgggtcaatccaaaggtagggtatacagcagatcatcaaaaaattcatcctttgcctatgatatgttaatcagcactctttgaatatggtgatttaattaattaatacataattatattacttttataacccatattatcttgtccagaaggttatcataaatgacttattagtcttgctgaaatttcattcattcatttaagatatgtaattatgtctgccatatttccataaactacctctaatagccttgtcagaaataagaaccaggtttgtgttgaatggctttgttgataactgtaattttttaagtactcgcttatttgaaaatttgttttagaagctaacttaagagacatttagctcactgattagaagattgaagactccccctttttctttgttagcctcagtaatatatttatataaatccaatcttaaagcacctttcctattttccttaatgccttcgattactgagagtagtttagtaatatcaactgagttacaatttacccattccaggacacatgtactttttctttctgagagtatagttaaaatattgttcttgttgtctttacaaatatgcatttctacaagcctgaggtaattttggaccttatccttccaaatactaaccctttaggcacatgtcaccagttatatttatccttgtgtttgtgccctttttcctatttcttatatattatcttttaaaaaaaagaaagtatgaactcattgtaaaacttcctatgtggccccatggttttcctcttttctcctttaatagaataatttgctgtttcattgtcaaaattatgtttttgagagcttcccaacctttagagtctaaagccatcgtaatgtaaattaaggtccaaaaagtatcaatcataataacagaaacttttggagatcagccatagctagaaattctagtcagagtaggcaattacataataggtcaatctgaatcttttcatggttattactaaggaagaagcattacctcctgaaaggcttaaagccaagagtgcatttagctcctgtcaatttttccttccaaatgtctttcagatttgtccttctctttccattcctatagattccttcatcacctcatacctggcctattgccatagactagatggtttccttgccttcagtccatccatattccaatccattgtccatacactattgccagattaatcttcttaaaacactttcatcatgccattctcctgcctaagacttagctcaaatgtcaccttcttcgtaaaatattcccagctcccttaggaagagttagcaactgcctactcagtgttttcacaggtctctgtgcataaccttattagtgcacttaaaacatgtatgacaatcatttctttaattatttttcttacctcaattgctatgagctccttgaggagaggcaaaggtttgagccatctctttacaattgcactcagggcgttacataatctatcttgccccacccatgtcaggaccatcacatatactgccttctctgcttaccatgctctccccttcattcttcctgctcgttccttaggtctcagattaaatatcaattcattgagaaaccttcgctgacactcttattaactaattaattagttaatcatttgaacaaatatttgtcgggtgtctactttgtgctagacattgttttaggcactagggatataccagtgaacaaagaagacaaaaagtcttgctttcaagtttatcttctagtgggagaaggtagataattaagtataaacataataagttatatatagtaagctataaaaaatagcaggataaagcagtgtgctggaagttggactttgaaacatggtggtcagggtaggcctcattaagaaagatgacatttgatcaaaggaggagttagtcataaggatatctggggtaaagtagactaggcagaggggatagccaatgcaaaggctctaagttgtgattatatctgttgtggccaaaagaaaaaaaaaagaaagaaaaaacattgtagctggagctcactaagcaagaagtaaaataatagatgaagtgagaaaggtaggaataaataggtcaggtcagatcatgtagggccttataagctaatatataaaaactttagtttttactctgatagaaatgatgaaccattgtagggttttaaaactaataggtaacatgatgacacattttaaatgaactgttctggctgttgtattgagaataaactgtaaacaggccaaggaaaggagggatacctgttagtaggctattacagtactggatttattgaagtaatccaggcaagaaatgatagtgacttagactaaggcagtagcagtgaaagtggtgaaaaagggtcagagtctgtttttttgaaggcaaaaacgacaggatttgctgatgaattgaaaatggggtgtgagataaagaggaatgtattagtccattttcacactgttataaaggactacctgaaactgggtaatttataaagaaaagacatttaattgactcacagttctacatggttggagagacctcaggaatcttacaatcacagcagaaggtgaagggaaagcaaggcacgtcttacatgatggcaggagtggggggaattgccacacttttaaaccatcagatctcatgagaactcactcacaataatgagaacagcaaggggaaatccactgccatgattcaatcacttcccaccaggcccctcctctaacattggggattacaattagacatgagacttgggtggggacatacagccaaaccatattatcccacccctggcccctcacaaatctcatgtccttttcacatttcaaacccaatcatgccttcccaacagcccccaaagtcttaactcatttcagcactaaaaagtccaagtccaaagtcttatcggacacaaggcaagttccttctgctatgatcccataaaatcaaaaacaagttagtcacttccaagatacaatgggggtacaagcattgggtaaatgctcccattccaaatgggagaaattggccaaaacaaaggggccacaggccccacacacgttcaaaacccaacagggcagccattaaatcttaaagctccaaaataatctcctttgactccatttctcatatccagggcatgctgatgcaagggttgtgctcccacagccttgagcagttctgcccctgtggcttagcagggtacagccactgaggctgcattcacgagctggcattgagtgcctgtggcttttccaggtgtacagtgcaagctgttggtggatctaccattctggggtctggaggatggtggccctcttctcatggctccactaggcagtgcccagtgtggactctgtgtggggcctctaaccccatatttcccctctgcattgccctagtagaggttctccatgatggttctgcccctgcaacagacttctgcctggacatccaggtgtttccatacatgctctgaaatctaggcagaggttcccaaacctcaattcttgccttctgtgcacccacaggcccaacaccacatggcaattaccagggcttggggcttgcatcctctgaagcaatgtaccatggcccctttaagccacagttggagctggagtggctgggatgcagggcaccatttcccaaggctgcacagagcagggaggccctgggcctggcccatgaaaccttttttttttctcctaggcatctgggcctgtgatgggaggggctgccgcaaaggtctctgacatgccctggagacattttcttcattgttttgaccattaacatttggcttctctttacttatggaaatttctgcagcaggcttgaatttctccccagaaaatgggttttttggttttttcctttctatcatatattcaggctgcaaatttgccaaacttctatgctctgcttcccttttacatataagttccaatttcagaccatttctttgtgaatgcacatgacagtatgctgttaggaacacccaggtgcatataacactatgctgttaggaacagccaggttacttcttgaacactttgctgcttagaaatttcttccaccagataccctaaatcatctccctcaagttcaaagttccacagatctctagggcaggagcacaatgctgccagtctctttgctaaagcatagcaagagtggccttcactccagttcccattaagttcctcagttccatctgagatcatctcagcctggatttcactgtccaaatcactatcagcattttggtcaaaacccttcaacaagtctctaggaagttccaaactttcccacatcttcttgtttctgaaccctccaaactgttccaacctgtgcccactatccagttccaaagtcacttccacattttcagttatctttatagcaatgtcccactctcctggtacccattttctgtattcgtccattttcacactgctataaagaactacctgagactgggtgatttgtaaaacaaagaggtttaattgactcacagttctgcatggctgcaaggcctcatgaaacttaaaattatggcagaaggtaaaggggaagcaatgcacaccttacatggtagcaggagacagacagagcaaaaggggaagttccacacttttaggccatcagatctcctgagaattcactcacaatcatgagaacaacaaggagaaagtccacccccatgattcaatcactttccatcaggcccctcctctgacatgtggggattacaatttgagatgagatagcaggagtggggaacagagccaaaccatatcaaggaatgaatgataacccaaggtatttggactgaaaaactgaaaggatggggaagactgctggaggatgtttggaaaaacagattagaattttagttttggatctgttaaatttgagatgtctattagatttttaggtggaaatatcagagaggcagttggatacatgagtcttgagttcaggggagagatatgagctgcagatacaaatttggcagttgttccatagttggtatttaaagtcaggagactggatgagactaccaaaggaattggtatagacagagaaaagaagattaacatttgttagtttctcatagatccttttattcttcaatgcacttattacaacttgtaattatttgtttatttgtttttatttctgtgattgtttggctaatgtctggttgccttattacaagaaaatgttccaatgagagcagggtctatgccattttctccatcacaatcagcaaaataatatgttggattgcatgaattaaaagaatgttcctttttttcaaggactcaaaattaaatgctcacaagggctaggcaagtaacataaataagtcgagtataagagacaatgtgttgtagagagaggggtgaactgaagtgtccaaaaatcatagccactacttagttccagctgattatggacagataggcctagtgttgtaatcttcagaatttttgaaatgagccagatatacagattatatatgaaatctcccaaattgtaatgccaacaactgtattagttcaggtcttctaaaaaagcagatgccatgataaaaatagatgtgcaagtaatttactggggaaaagatatgtgaggggaagtgggaagagtgtctagacttggagggtcatcagaccatggtacaggtcctatccctgtggaagacagaaagaaggaagcacagtctcagactgcaatgcagatctaagaaagtttcaggaaggctgttggggaatactcaagccaaaggtggccattaaaggagtctgggtctccaaggaatgggctctcattagtattcttgccatggtcattcagtagtttggaacagttgatgggaagtgtagccttggaagaaagaaacaatgatggatgatagaacacagcagctgggccctcagtcagctatactccctttagtaggagatatgagtggcacattgtggtgggcatcacaatgactaaattcaacaatgccacaacagtatgagccaaaaacacatcttcaagccatattcagccccaatgtggacagttgtcaacctctgctctagtcactaacatatactttaccatcaatgggctagttatgtatagatcctaacataggccaaaatggattgccaatagcatctaggtagtagagtttaagttaccaggtgagaacatgaaaagcattagccaaagtgggtttaaaatgtgctgccagaatagaggtagtttcagagtatgaaggagcaaaaactacaatccaaaaggaaaaggtatgagttaaagcaaagtgtctacaagcattatacgaacataaacagtgaagtcaaaaagcagaaatagtttataataattgactaagcagagcatttcagatcttttgtctgtgaaaggagaataagcactgttatatgtatttactgtcaacaatatgctgtgagaggaaagggaagaccttaaagaatttggagtctgaaaggcagtgacaactgtggcctttggtgagagacaataatatcaggcagggcatagccaattacatcagtgtatctaccataatgggtatggcttgtggtactgaaaagcagggcaggacaaggttgaagtaaagtttaggtcaaacaaaggtggtctagggtcaagagtaggtgaaactaccccttgagtttcctggtatgtccttgattccaatgcatggacttcatgtttccatgtaccaaaagacattatgtcagatgcactgccatgaaaggtcttaaaaggacttctaggggctgcagaggcacactggggtggcattataatatgggcagaaaagtagggcttggacttagcccatcaagacttacaaatggcagtgaaagttcagttcctccaatccacagtcacacacacacacctcatccacacatttatttgccaggtgccaagtaaggtttttctgaatgtccaccatgctctgctgagcacaggtgttggtatactgttgcttctgaatgaaatctattgactctactgctaggtggaagaggtgcctcgatactctggagatactgacttgaaaatggggaccacccacttgccctttggggggtagcctttggctgctgtgagtttgtagtaaaagtataggcaaggcaccccatcaccccgtgggggtctcctgcattgctctgttggagaagtccctttctcagatgcatagatgttgtgggataagatacggtataaatgaagagccccctaaatgccttaggttgctttgaaaacctagggaccattatgaatctgagacactatgatgaatagctagaaaaaaaatgttccaacagaagcaatgctgtatggttaacacctttaaagtaaagcctgaaccaaggctatgtgcatctgtgtgttttccagggacagtagatgcagcaaagtgacttcaaggttagtgattatactcctggattctgttatctggccagttagcattcttaatttgaagaaacacagtttcttatctctgggccatactttgcagctatattgtctactggggcaccattatctcctccaagggtatactatgttgccactagaatcattgtatcaaagatatatttttctaggaggcagatgtcacaatccaagaaggatttcttccagtctaagcaggaaggttgtgagcaatgctaaaaccaggaaataaaccatcaaggactgtccaaggatgacctactaacatggcaatataagattgtagtcagggggacagaaggtaacaatgagtgttcaacatgaaggataaggcagatatacaacagaagaacagacagcaaagttggttcctgggagagtaaagtaagagatgggccaatgttagattgaatggttcattatttccctgtgaatggccacttaaggtaccagaactccctttttatgggttgaggtacacgctgagagagtaggtatatgtgactaaaagagacacactaacctactcaggagatgtcaatggtcctgttcatggtgttgctcataatacttcaacctgggatgctctcttcactctatataaaatctctcttcattcttcaaagaccatttcaaaatctgttcattcaaagaagtcttcctcacttcatttggactacacagatttctatctttcctgatggccagtgatgcatactatttgaaccaaacgtgctggtgttatcttgattttaactgtcctcctaattggttcatcaagtatgtaagctttgattctctagctaagctgcaaatcccatgagtttggagagtaaatttacttgtaacctccacagtgtcaaacatatactaagaacttaatacatttttatgtgaattaacaaatcaagatccaacaatcattggttgcagaataatcagaaatgtctggggaatggccgcagttggaaactctagtcagagcagcaactgcatatgggccaacttcgatatctttatggttactacaaagaaagaaacagcatctcctgaaaggctgcaagccaacagctagagcatttgacttcctgaatgactggcagttacatctgaacataatgactgcattaggaattgaaataaaaacaatttttcctatactttttgtgcagtacaagaagcaatctaagaacttgaaatcccaaatgtctatttatctcaagttacaaaataaaacgaaacaagctatccaattaaaaaaaataaatcacccataatagatacctaaaataaatacaggggacacaggaatagctgagtgaggagttcaataaagttattcaaaatgcaaaaataaactggacaaagttgtcaaaaacaaccacatcatgactctggaaaccgacaaaatcatacaacaaattgagaagtattaattcaagaaaaactattgaatcttgagtacaaatggtagaaatctatggcattttaacctggggtcattcccattccttccaccagccctgtggcatggtcattttaaatgtacagtggaagaccgaagaactgaaagctccactgatggagggtgctgccatcatttgtagaagatcacaataaaacccatatccacttcagaggtcaggcagccaagatggccgaataggaacagctccagtctacagctcccagcgtgagcaacgcaaaagatgggcgatttctccatttccatctgaggtactgggttcatctcattagggagtgccagacagtgggcgcaggacagtgggtgcagcacactgtgcacaagccgaagcagggcgaggcattgcctcactcaggaagcgcaaggggtcagggagttccctttcctagtcaaagaaaggggtgacagatggcacctggaaaatcgggtcactcccaccctaatactgcgcttttccgacaggctgaaaaaacggcgcaccaggagattatatcccccacatggctcagagggtcctacgcccacggagtctcgctgattgctaccacagcagtctgagatcaaactgcaaggcagcagcgaggctgggggaggggcgcccaccattgcccaggcttccttaggtaaaaaaagcagccgggaagctcgaactgggtggagcccaccacagttcaaggaggcctgcctgcctctgtaggctccacctctgggggcagggcacagacaaaaagacagcagtaacctctgcagacttaaatgtccctgtctgacagctttgaagagagcagtgattctcccagcatgcagctggagatctgagaacaggcagactgcctcctcaagtgggtccctgacccctgacccccgagcagcctaactgggaggcaccccccagtaggggcagactgacacctcacacggctgggtactcctctgagacaaaacttccagaggaacgatcagacagcagcattcgcggttcatgaaaatccgctgttctgcagacaccgctgctgatacccaggcaaacagggtctggagtggacctctaacaaactccaacagacctgcagctgagggtcctgtctgttagaaggaaaactaacaaacagaaaggatatccacaccaaaaacccatctgtacatcaccatcatcaaagaccaaaagtagataaaaccacaaagatggggaaaaaacagagcagaaaaactggaaactctaaaaagcagagcacctctcctcctccaaaggaacacagttcctcaccagcaacggaacaaagctggatagagaatgactttgacgagttgagagaagaaggcttcagatgatcaaactactctgagctacaggaggaaattcaaaccaaaggcaaagaagttaaaaactttgaaaaaaatttagatgaatgtataactagaataaccaatacagagaagtgcttaaaggagctgatggagctgaaagccaaggctcgagaactacgtgaagaatgcagaagcctcaggagccgatgcgatcacctggaagaaagggtatcagtgatagaagatgaaatgaatgaaatgaagcgagaagggaagtttagagaaaaaagaataaaaagaaatgaacaaagcctccaagaaatatgggactatgtgaaaagaccaaatctacatcgtattggtatacctgaaagtgatggggagaatggaaccaagttggaaaacattctgcaggatattatccaggagaacttccccagtctagcaaggcaggccaacattcaggttcaggaaatacagagaacgccacaaagatactccttgagaagagcaactccaagacacataattgtcagattcaccaaagttgaaatgaaggaaaaaatgttaagggcagccagagagaaaggttgggttacccgcaaagggaagcccatcagactaacagtggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaacagctcctgaaggaagcactaaacatggaaaggaacaactgataccagccactgcaaaatcatgccaaattgtaaataccatcgaggctaggaagaaactgcatcaactaacgagcaaaataaccagctaacatcataatgacaggatcaaattcacacacaacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggacggagaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatgctaaatatatatgcacccaatacaggagcacccagattcataaagcaagtcctgagtgacctacaaagagacttagactcccacacaataataatgggagactttaacaccccactgtcaacattagacagatcaatgagacagaaagttaacaaggatacccaggaattgaactcagctctgcaccaagcagacctaatagacatctacagaactctccaccccaaatcaacagaatatacattttttttcagcaccacaccacatctattccaaaattgaccacatagttggaagtaaagctctcctcagcaaatgtaaaacaacagaaattataacaaactgtctctcagaccacagtgcaatcaaactagaactcaggattaagaaactcactcaaaaccgctcaactacatggagactgaacaacctgctcctgaatgactactgggtacataacgaaatgaaggcagaaataaagatattctttgaaaccaatgagaacaaagacacaacataccagaatctctgggacacattcaaagtgtctagagggaaatttatagcactaaatacccacaagagaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaagactcttcaaaaaattaatgaatccaggagctggttttttgaaaggatcaacaaaactgatagaccgctagcaagactaataaagaagaaaagagagaagaatcaaatagacgcaataaaaaatgataaaggggatagcaccaccactcccacagaaatacaaactaccatcagagaatactacaaacacctctacacaaataaactagaaaatctagaagaaatggatacattccttgacacatacaccctcccaaaactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtactattccttctgaaactattccaatcaacaaaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcaggctaaaaactctcaataaattaggtattgatgggacgtatctcaaaataataagagctatctatgacaaactcacagccaatatcatactgaatgggcaaaaactggaagcattccctttgaaaactggcacaagacagggatgccctctctcaccactcctattcaacatagtgttgtaagttctggccagggcaattaagcaggagaaggaaataaaggctattcaattaggaaaagaggaagtcaaattgtccctgtttgcagacgacatgatcatatatctagaaaaccccattgtctcagcccaaaatctccttaagctgataagcaacttcagcaaagtctcaggatacaaaatcaatgtgcaaaaatcacaagcattcttatacaccaataacagacaaactgagagccaaatcataagtgaactcccattcacaattgcttcaaagagaataaaatacctaggaatccaacttacaagggacgtgaaggacctcttcaaggagaactacaaaccactgctcaatgaaataaaacaggatacaaagaaatggaagaacattccgtgctcatgggtaggaagaatcaatatcgtgaaaatggccatactgcccaaggtaatttatagattcaatgccatccccatcaagctaccaatgactttcttcatagaattagaaaaaactactttaaagttcatatggaaccaaaaaagagcccgcattgccaagtcaatcctaagccaaaagaacaaagctggaggcatcacgctacctgacttcaaactataccgcaaggctacagtaaccaaaacagcatggtactggtaccaaaacagagatatagatcaatggaacagaacacagccctcagaaataacgccgcatatctataactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctataagaaaacctaggcattaccattcaggacataggcatgggcacggacttcatgtctaaaacaccaaaagcaatggcaacaaaagacaaaattgacaaatgggatctaaactaaagagcttctgcacagcaaaagaaactaccatcagagtgaacagacaacctacaaaatgggagaaaattctcacaacctactcatctgacaaagggctaatatccagaatctacaatgaactcaaacaaatttacaagaaaaaaacaaacaaccccatcaaaaagtgggcgaaggatatgaacagacacttctcaaaagaagacatttatgcagccaacagacacatgaaaaaatgctcaccatcactagccatcagagaaatgcaaatcaaaaccacaatgagataccatctcacaccaggtagaatggcaatcattaaaaagtcaggaaacaacaggtgctggagaggatgtggagaaataggaacacttttacaccgttggtgggactgtaaactagttcaaccattgtggaagtcagtgtggcgattcctcagggatctagaactagaaataccatttgacccagccatcccattactgggtatatacccaaaggattataaatcatgctgctataaggacccatgcacacgtatgtttattgcggcactattcacaatagcgaagacttggaaccaacccaaatgtccaacaatgatagactggattaagaaaatgtggcacatatacacaatgaaataccatgcagccataaaaaatgatgagttcacgtcctttgtagggacatggatgaaattggaaatcatcattctcagtaaactatcacaagaacaaaaaaccaaacactgcatattctcactcataggtgggaattgaacaatgagaacacatggacacaggaaggggaacatcacactctggggactgttgtggggtggggggaggggggagggatagcattaggagatataactaatgctaaatgacgagttaatgggtgcagcacaccagcatggcacatgtatacatatgtaacaaatctgcacattgtgcacatgtaccctaaaacttaaagtataataataataaaataaaataaaataaaataatacaacagagcacacacacacacgaaactcatatccagtggcattgctgaaaacaatagcaaaatcagtggcaagcaatcaaggaaggccaatatgacagctagcctaaagcctccataatggttgtagagagccacaggccagaaggcctgccagcaagaaatttaacagggatatccaggtaatgagacagccaaagtaggccttgaaaagttctgacatatcactgggggtttggcagactacgtatatttacaaactgcacacttgcttatgaaaggtcagagtggatcctagatatgcacttgtccctgggagaacatgagtccttgtccacacagaaagtaagagtgagacaggcttgtaaacagcctgaactttgaatttgtttcccatcccacatgcagatccacttttcaaagggtagaaacttagccttactggttaaagattttaattgcaatctctgaccaaccattaactgaccactaagctatgctgatacagaggtaatattgtctaaaacgtccagttttccttaaaaaatattagacatgagtgtgtattccatacatggggtgaaaacagcagtcaacaaaaaccatttctaggggctcagatgttgcacgcaacagacaaggacaaaaaatgtactcaaagaacaaaagaacaaaataaaccatgtttaatgaattaaaggaaattaggagaacaattacttagcacacagaacatcaacaaagagacagaaattataaaaaaagaaaaatggaaactctggaattgaagggtataataactgaaatgaaaaattcactagggagactacacagattgctctgacagaagaaggaatcaacaagcttaaagatagattaatagagataacttgatctgtagaacagaaagaaaaaatttaagaaaaatgaacagagctacagagacctgtgggatagcaccgaacacaacaacctgtattagtttactaagactaccataaaaaagtgccacgaactgggtggcttaaccatcagaaacatattatctcacagttctggaggccagaagtctgagaccatgtgttggtaatgttggttccttctaagggctatgagggaaagatatgttccagaccactttccttggcttgtggatagccatcttctccctgtcttcacatcatttcccctctgcatgtatctgtctccaaattttccctttttataagaatataagttaaataatttcattttaatttgattacctctgtaaagaccttatcttcaaataaggttgcattctcagatatagagggttatgactttaacatacgaattttggagggacaaaattcaatgcatatcgtaacatatgagtcattggagtccaagaaaaagcagagagacaaaaagggacagacaaaatatttgaaaatataattgtcagaaatttcccaaacttgatgaaaaatattaatctacacatccaaggatctcaacgccaaggatgataaacacaaagaaatctacatactgaaaaatcacaataggctgttgaaagccaaagaaaataagcaagtttcaaagaaacaaaagaaaaaatgagcaaaccaaatccagcagcacaataaaaagctaatccaccgcaatcaaatagactttacccctgggatgcaagtttggttcaaaatatgcaaatcaataaatgtgattcatcacataaacagaactaaaaacaaaaactacatgattatttcaatagaagcagaaaaggcttttgataaaattcagcatctgttcatgttaaaacaaattaggcactggaggaagatgcctcaaaatagttaacagccatctataacaaacccacagccaacatcatactgaatgagcaaaagctggaagcattccccttaagaaccagaacaaaacaaggatgtccagtttcaccactcctattcaacatagtactgggagtcttggccagagcagtcaggcaagagtaagagataaaaggcatccaaataggaagagaggaagtcaaactatctctgtttgcagattatataattctatacctagaaaaccccatagtctctgccaaaacctcctagatctgatttaaaaaaaaatcagcacttcagcaaagtttcaggatacaaaactcaatgcacaaaaatcagtagcatttctatacaccaacaacatctaagctgagagccacatcaagagtgcaatcgcattcacaacagccacaagaagaataaaatacctgggaatacagctaaccaggaaggtaaaaaatatctacaatgagaattacaaaacactgctcaaagaaatcatagatgacaccaacaaatgggaaaacattccatgttcatggataagaagagtcaatattgttaaaatggccatactacccaaagcattttacagattcaatgctattcctatcaaactaccaatgacattcttcacataattagaaaaaaaatctaaaattcatatgaaaccaaaaagtagcctgactagccaaaacaatcgtaaggaaaaagatcaaagctggaggaatcacattacttgactttaaactacactacaaggctactgtaagcaaaggagcatggtactggtacaaaaacaaagatatagaccaatggaacagaatggagagcccagaaataaagttgtgcacctataaccatctgatcttcaatgaagttgacaaaagcaagcaatgaagaaaggattccctattcaataaatggtgctgggataactgctagccatatgcagaagattaaaactggaccccttccttataccatatacaaaaatcaactcaagatggtttcaagacttataaatgtaaagcctaaaactacaaaacccctggaagataacctaagaaataccattctggacacaggcccagtgaaagatttcataacgaagatatcaaaagcaattgcaatgacaacaaaaattgacaaatgagacctaattaaactaaagagcttttgcacagcaaaagaaactatcaacagagtaaatagacaacacacagaatggggcaaatatttgcaagctatgcatctgacaaaggtctaatatctggaagctataaggcacttaaattaacaagcaaaaaccaaacaaccccattaaagagtgggcaaaacacatgaacagatacttttcaaaagaagacatacacatggccaacaagcacataaaaaagtgctaaacatcaccaaatcattagaaaaatgtaaattaaggcctggtgcagttggctcacacctgtaatcctagcacttttgggaggccaaggcgggtggattgcctgagctcaggagtttgagaccaggctgggcaatatggtgaaaccccatctctactaaaaataaaaaaaattagttggccatggtggtgtgcacttgtagtcccagatactcagggaggctgaggcatgagagttgcttaaaccaaggaggcagagactgcagtgagctgagatcacaccacggtgctccaacctgggcaacaaagcgagactctgtctcaaaaaaaaaaaaaatagaaaaatgtaaattaaaaccacaatgagataccatctcacaccagtcaggttcatagtggctgattagatgtagctagtatatgccccttccatggagataatactaacagcccagctctcaaagaactattaggttggtgcaaaagtaattgcagtttttgccttaacacatccagccctggtgccactgccactgctgccaccactggccaaggagggaaagaagagatcaggcactttcacacactctgaggacgaatcccatccctgctgctgctgcaggctgctgtgaaacgaaagagaaagaaaaccatgtaacacacaggtgcctgcctatgttgctcccactgatagtggtcccaccctatatggtgacaggactacagctgctaccattgagagcccagtccccaaagaactgcatcctgccctggggctaatgctgccactgccaccatcaggcccaggagggagatgggggaggcctggcacttttacatgccccaaggaaaagttgtactagtgctgctgtaggctgtaggaccaaggtatgagcaggctgtgtgccccacaagtgcctgcttgcactgctgacaatgacaatggccccatcctcccagatggcaggcccacagtgcagccaccactgcccccacctgaatatcctgccggcagcctggagacaaccctgcccctgcctatcacagctatagcctgaatacactaaccagggtccctgagggcaagtacactaacccagtcctatgcccccagtactcaagtatgctatccagaggcctggggatctctcagcccagtccataccagtggaacctgagtactcttcccagggtctgaagttgggctgacccaacataccaataccaccactgctggcaaacaccaacacatatcacctgtgtgccaggagattggcccacccaacccattgctgccacggcaaagacgagcttcaaccacataggttgtaggaggatgccccatcaatgctattgccattgcccacatcatgcccactgcacaggggcctgagaacctgcccataaacccggccaaacattgtcactgctgacatctgaacaagccacccggaggcccaagaattggcctgccttcacctgttaacaccagagccagaatacatggctctggggttcaaggacaggcaagctcagcccactgctgccaccactggggccccaaaactggcacacttcacatcacagccccagaaaaactttgccctagaaaaccctaaagactttctccaaaaaacttgtagagttgatttcagtaaactttcaggaaacaaaatcaatatacataaattagtagcatttctatatgccagtaattatccagctgagaaacaaattaagaaggaaatcccatttacaatagctacaaaaaataaaatagtaaggaatatatttaaccaagaatctctacaaggaaaactacaaaacactggtgaaagaaattgtacatgacaaaaatggggaaaaacatcccatactcatgggtcaaaagaatcaatattgttaaaatgaccatactgctcaaagtaacctacagattaaattgcaatccctatcaaggtacccacatcatttttcacagaattagaaaaaaattataaaattcatatgtaaacaaaaaagagcctgaatagccaaaggaatcctaagcaaaaagaacaaagacggaggtatctcattacctgacttcaaattatactacaaagctataggaaccaaacagcatggtactggtataaaaacaggcacacaaatcaatggaacagaatagagaacacagaaataaaaccacatatctacaaccaactggtctttgacaaaggtgacaaaaacacacaatggggaaaagacaccctttatttttctttttcaacttttgttttagaattagaggttacacgtgcaggtttgttacaaaggtatattacataatgctgaagtttggggtatgactaaatctgtcactctggtagtgaacatagtacccaataggtagtttctcagcctttagccccctctttctctcccacctctagcagtccccagtgtctgtctattgttcccatctttataggacatcattttcaataaatggtcttgggaaaattggattgccacatgcagaggaatgaaactggactcctatctctcaccacataaaaaaatcaacttaagatggagtaaatacttcaatataaaaccagaaactatacaaatactggcagaaaacccagggaaactgctggatattggtctaggcaaagaattcacaactaagacctcaaaatcgcaagcaacaaaaaaaaaaaaatagaaaaatgggacttcattaaaaagctcttatacagcaaaataattaatcaaccaggtgcacagacaacctggagaatgggagaaaaatatttgcaaacgatgcatccaacatgaacctagttctcagcagccagcactcaaattcacaaggaacatgaacaactcaacaacaacaaagaaaacaaataactccattaaaaagtgggtgaagaacataaatagacatttttcaaaagaagacatacaaatgaccaatagacatatgaaaaaatgctcagcatcactaatcactggagaaatgaaaattaaaaccacaatgagatatcatcttacaccagtcagaatggctattactaaaaagtaaaaaaaaacagatgttggtgaggatgctaaaagggaatgcttatacactgttgatgggaatgtaaattaatataacctctacagtatggagatttctcaaataagtaaaaatagaactaccgtttgatccagcaatcccactaataggtatctacccaaaagtaaaaaagccattatataaaaaggatacatgtacttgtatgtttattgcagcactatattagtccgttttcacactgctgataaagacatacctgagactcaacaatttacaaaagaaataggtttaatggacttacagttccacgtggctggggaggcctcacaacgatagcagaaggtgaaagacacatctcatgtggcagcagacaagagaagagggcttgtgcagggaaactactctttataaaaccatcagctctcctggtaccatttcttctgaaactattccaatcaatagaaaaagaaggaatcctccctaactcattttatgaggcaagcatcatcctgataccaaagcctggcagagacacaacaaaaaaagagaattctagaccaatatccctaatgaacatcgatgcaaaaatcctcaataaaatactagcaaaccaaatctatcagcacatcaaaaagcttatccaccatgatcaagtgggcttcatccctgggatgcaaggctggttcgacatatgcaaattaatacatgtaatccatcatttaaacagaaccaaagacaaaaaccacatgattatctcaatagaagcagaaaaggccttcaacaaaattcaacagcccttcatgctaaaaactctcaataaactaggtagtgatggaacgtatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaataaaaggtatttgattaggaaaagaggaagtgaaattgtccctgtttgcagacaacatgatgtatatttagaaaaccccattgtctcagccccaaatctccttaagctgataagcaacttcagcaaagtctcaggatacaaaatcaatgtgcaaaaatcacaaacattcctatacaccaattacagacaaacagagagccaaatcatgagtgaactcccattcataattgcttcaaagagaataaaatacctaggaatccaacttacaaggaatatgaaggacctcttcaaggagaactacaaaccactgctcaataaaataaaagaggacacaaacaaatggaagaacattccatgctcatggacaggaagaatgaatatcatgaaaatggccatactgcccaaggtaatttatagattcaatgccatccccatcaagctaccaatgactttcttcacagaaattgaaaaaactactttaaagtccatatggaaccaaaatagagcctgcattgccaatacaatcctaagcaaaaagaacaaagctggaggcatcatgctacctgacttcaaactatactacaagactacagtaaccaaaacagcatggtactggtaccaaaacagagatatagaccaagggaacagaacagagccctcagaaataataccacacatctacaaccatctgatctttgacaaacgtgacaaatacaagaaatggggcaaggattccctatttaataaatggtgcttggaaaactggctagccatatggagaaagctgaaactggatcccttccttacaccttatacaaaaattaattcaagatggattaaagacttaaatgttagacctgaaaccacaaaaaccctagaagaaaacctaggcaataccattcaggacataggcatgggcaaggacttcatgactaaaacaccaaaagcaatggcaacaaaagccaaaactgacaaatggatctaattaaactaaagagcttctgcacagcaaaagaaactaccatcagagtgaacagacaacctacagaatgggagaaaatttttgcaatctacccatctgaaaaagggctaatatccagtatctacaaagaacttaaacaaatttacaagaaaaaatcaaacaactccatcaaaaattgggcaacagatatgaagacacttctcaaaagaagacatctatgcagccaacagacacatgaaaaaatgctcatcatcactggccatcagagaaatgcaaatcaaaaccacaatgagataccatttcacaccagttagaatggcgatcattaaaaagtcaggaaacaacaggtgctggagaggatgcagagaaataggaacagttttacattgttggtgggactgtaagctagttcaaccattgtggaagacagtgtggcgattcctcaaggatctagaactagaaataccatttgacccagccatcccattactgggtatatacccaaaggattataaatcatgctgctataaagacacatgcacatgtatgtttattgcgaaactattcacaatagcaaagacttggaaccaacccaaatgtccatcaatgatagactggattaagaaaatttggcacatatacaccatggaatactatgcagccataaaaaatgatgagttcatgtcctttgtagggacctggatgaagctggaaaccatcattctgagcaaactattgcaaggacagaaaaccaaacaccacatgttctcactcataggtgggaactgaacaatgagaacacttggacacagggtggggaacatcacacactggggcctgtcgtggggttgggggatgggggagggatagtattaggagatatacctaatgtaaatgatgagttaatgggcgcagcacaccaacatggcacatgtatacatatgtaacaaacatgcacgttgtgcacatgtaccctagaacttaaagtataataaaaaaaaagaaaagaagaaagaccatcaaaaaaataaaataaataaaaccatcagctctcgtgagacttattcactatcatgagaacagcatgggaaagacccacccccatgattcagttacctcccaccaggtccctcccaccctcccacaacatgtaggaattcaagatgagatttgggtgtggacacagccaaaccatatcaagcactattcacaaaggcaaaggtatggaattaacctgaatgtccgttaatggatgactaaataaaatgtagtacatatgcaaaatggaatactattcagccataaaaaataataaaattgtcttttgcagcaacatggatgtaactgaatgccattatcttaagtgaaacaacagagaaacagaaaagaaaatgccacatgttctcacttataagtgggaactaagtaatgtgcacacatggacatagagtgaggaatgataaatatcagagacttggaagggtaggaggggagtgagggatgagaaattatttaatgagtacaatgcacattattcaggtgatggttaccctaaaatcccagacttcattactaggcaatatatccacataacaaaactacacttgtacctcatatatttatacaaataaaaagaggaaaagaaaaaaattcacaatgactttccagcaacagatcccaatcaaaaagatattcacaaaatcccagataacaaattgaaaatacaaattttaaagaagctcagcaagataaatgagaaatctgaaaaacaaaaataaatcagaaaaacaattcaagatatgaattagaaatttttcaaatagatatttttttaaaaaagaacccaacaaaaattctgaaactgaagaattcattgaataaaatataaaatacatttgaaagttacaacaatagattaggtcaagcagaagaaagaatttcagaacttgaagacaggtcttttgaaataatccagtcagaaaaaaaaataaataaaaaagaattaaatagaatgagcaaaaccttcatgacatttgggataccataaagtgatcaaatctttgaattatcagtgttctcaaggctgaagagagaacaaaatgatggaatcctatttaatgaaataataggtgaaaaattcccaagtctagcaagagacttcgacatccatatgtctatatggggctcaaacatccccagaaatacaatgcataaaggttttctccccaccacattatagtcagtctctctaaagtcaaagataaaacaggattctaaaaatagcaagagaaaaatgtctagccaccaataaaagaactctcatcagactaacagcagatttctcagcagaagtcttacaggacaggaaagaatgagatgatgtattcaatgtcctgaaagaaaaaaaaactgccagccaaggatactatccccagcaacgttttcactcataaatgaagggaaatttatgatttccctcataaatgaagtctttttcagagaagcaaatgctgagagaattttcaccactagatgagtcctacaagaaatgctcgagtcttaaacctgaaagcaaaatgacagtatttaccaccatgaaaacaaacaaaagtataaaacccactagtaaaccctacacacaaatgaggaagagaatggactcaaatgataccactacagaaaatcaccacaccaaaataacaaacaataagagaaaacaaaaggaacaaaaaatatacaaaacaaccagaaaacaattaacaatatgataagaacaaaacctcacatagcagtgataaccctgaatgcaaatggactaaattctccacttaaacatatagactggctgaatggattttaaaaacatggtccaactgtatgctgcctccaagaagagcactttacctgcaaggatacatatagacaaagggggataatgaagacattacatgcaaatggaaactaaaagtaaacaggagtagctatacttagataaaacagactttaggtgaaaaacagtaaaaagacaaggtcattacataatggtaaattaatcaagcaagaggatataaattatacacacacacaaacacacacacacacacacacacacacacacacacacatatatatatgctttatgaatctgtgtgctccatgaaaataaacaaaatgttttgtatgtttggagtacatatatgcactcaatcctggagcacacagatttgtaaagcaaatattgctagatataaagggagagaaagattccaacacaataataatggggaactttaacagcccactctcagcattagacagatcatctagacagaaaatcaacacagaaacattggatttaaactggtaaactgatccttagaccaaatggacctaacagatattaaagaaaatttcatccaacaattacagaatgcacattcttcccacaggcacatgagacactcttcaggatagaccatatgctggctacaaaacaagtctcaacaactttttaaaaactgaagtcatatcaagtatttcagaccaaaatggaataaaattagaaatcaatagcaagaagaactttagaaactgtaaaaatccatcgttattgggccaggcacggtggctcatgcctttaatcccagcactttggggaggccgaggcgggcggatcacctgaggttgtgagttcaagaccagcctgaccaacatggagaaaccccgtctctactaaaaatacaaaaaaattagccaagcatggtggtgcatgcctgtaatcccagctactcgggagcctgaggcaggagaattgcttgaacctgggaggcagaggttgcagtgagtgagatcatgccattgcactccagcctgggcaacaagagcaaagctccgtctcaaaaaaaaaaaaaaaatccatggttattaaacaaaaagctcctagatggcattgagtcaagaaataaattagggagagcaaaaaatttcctgaaacaagtgaaaatgaaaacaacacatacgcaaaagtacagggtacagcaaaagcagtgctcagaggaaagtttatagcaataaatggctacatgaagaaagtacaaatatttcaaataagcaacataacaacgcacttgaaggaactagaaaaatatgaacaaaacccaaaattagcagaaagagaaaaaataataaagataagagcagaattaaacaaaatagagactcaaaaaatacaaagatcaacaaaatgaaaatttggttttttgaaaagataaacaagttttataaacaactcactaagcaaatcaaaaaagagagaagacccaaataaacaaaattagaaatgaaaaaggagatattacaactgataccaaacagaaatacaaaagatcatcagagactattatgaacatctatacactaacaaagtggaaaacctacgggaaatggataaatcccttgacatacacaatgtgtcaaagttgagtcaggaggaaatagaaaagctgaacagatcaataacaagtagtgagattgaaccagtaataaacagtctcccaaagaagaaagctcaggaccagatggattcacagatgaattctatcaagtgtataaagaacaactaatattaaccctcctgaaactattctaaaaaattgaagaagagagaactatccctaactcatttaatgaggccagaattaccttcataccaaaatctggcaaagacacaacagaaaaagaaaagtaaaggctgatattcctgatgaacacagatgcaaaaatcctcaacaaaatactagcaaacaaaatccaacagcacatcaaaaagataatacaccacaatcaagtgagatttatcccagggatggaaggatggttcaacatatgtaaaccaatatatgtgctacaacccatcaacagaatgaaggacaaaaattatatggtcatcttaatagatgcagaaaaagaatttgataaaattcaacgtcctttcatgataaaaactctcaacaaactagtatagaaggaatatacctcaaaaacataaaggtcatatataacaaacccacagttaacatcataccaaatggaaaaaagctaaaagccttacctctaagaaatggaaaaagacaaggatgcccactttcaccactcctgttcaacataatactggaagtgctagccagagcaaccaagcaagagaaagaaataaaacgcatccaaattggaaacaaggaagtcaagtcactctctttgctgatgatatgatcttatatctaaaaaaatctagagactctactaaaaaactcctacatttgataaataaagtaacattttaggatacaaagtcaacatacaaaaatcagtagtgtttatatatgccaacaatgatctagccaagaaagaaagcaggcaatcccattgacaatagctacaaaaaataaaatacttgggaataaatttaatcgaggtgaaaaatctttacagaaaaactaaaaaatactgacaaaagaaatttaagagaacagaacaactggaaaacatcccatgcttaagtattggaataattaatattattaaaatgaccaaattacccaaaccaatctacagattcaatgtgatccctatctaagaaccaatgttattttacacagaattagtgaaaacaatcttaaaatttgtatggaactaaaacagagcccgagtagccaaagcaatactaagcaaaaagaacaaagatggaggcatcacattacctgacttcaaattatattacaaggctatagtgtctaaaacagcatggcattggtataaaaacagatgacacatagacaaatggaacagaatagagagtctagaaataaatccatgtacttatatccaactgatttttgacaaagataccaagaacatatactggtgaaaggaaaccctcttcaatagatgattctgagaaaatgggagacctgtatgcagaagaataaaactggacctctttctctctccatataaaaaattaagtcaagaaggattaaagtcttaagcatgacccaaaccgtttaagcagtagaacaaaacacagagaaaacattggtctaggtaaagatttcatggctaagacatcaaaggcacaattataataaaaacatacaaatgagactttattaaactaaagagcttttgtacagcaaaagaaacaatcaacagagtgaagagacaacccattgaatgggagaaaatatttgcaaattattcatccaacaagggactaatatccagaatctagaaggaactcaaagaactcaacaataaaaaaaaaaatcccgttaaaaagtgaacaaaggatatgaatagacatttctttttaaaatacatacaaattgccatcagctgtaggaaaaaaatgctcaacatccctaatcatcagggaaatgcaaattaaaaccacaatgagatataatcataccccagctaggaagcctattatttaaaaaacaacaaatgaacaaatgttgatgaggatgtggataaaagggaactctcatctgctggtggaatgtaaattagcacaactatggaaacagtatggaggatgtttcaaaaaactaaaaatagaattaccatatgatctagcaatcctataatagtactgggtatttatctaaaggaaacaaaatctgtatatcaaaagaatacctgcacttacatgtttataacagcactattcataatagcaaagatatagaataaacctaagtgtctattgaagaatagataaagaaaaatttggtatatatacataatggaatactattcaccataaaaaagaatgaaatcggctgggtgtggtggctcacgcctgtaatcccagcactttgggaggccgaggaggggagatcacctgaggtcaggagtttgagacctgcctggccaacatggagaaaccctgtctctactaaaaatacaaaaattagctgggtgtggtggtggacacctataattccagctactctcgggaggctaaggcaggagaattgcttgaacccgggaggcggaggttgcagtgagccaagatcacaccactgcactccagcctgggtgacagagtgagactctctcaaacaaacaaacaaaaaaacaatgaaatcatgtcatttgcagcaacatggatggaactggagttaagtgaaataagccaggaacagaaagacagatactgcatgttctcactaatttatgaaaggtaaaatcactgatttcatgaagatagagaccagaatgatagatattagaggtcgagaaggatgtgtggatgggagaagtgatatagaaagattggttagtgggtaccaacatacagttgaatagaataaataagttccaataatctataccagagtgactacagttagcaacaatgtattatatattccaaagtagctaaaagagaggacttgaaatgttaccaacacatagaaatgataaatattcaaggtgatggataccccaaataccctgacttgatctttatccatcctatgcatgtaacaaatactcatatgcaccccaaaaatatgtaaaatattttgtatcggtaagaaaaagaagaaaatgtcaaccgaaaattctatttgcagcaagactgtacttcaaatgaaggtaatataaagacattcccaaatggataaaaattgagagaatttattactagtagaactcctgtacaaaaatactaaagaaagttccttgggctgaaaggaaatgacaccagatggtaataaaataatcacaaagtaataaaggtaaagattattacatgggtaaatataaaacatggtacatacgtgtacatacacatgtacttctgtttcctttgcttaactgatctaaaagacaattgtataaaacaataatttatgaaagtgtatggttggtcttacaacatataaagctacaagatacatcatacttaccaaaatatgtgtggataaaatagacctatattggagcaagaaaatgatgccattgataacatgcatcctcagaaagaattgaagacaaccataaatgataaatatataaattaatctaaaagactttataaatgtattttctcctttcttccatctcttctttaaaaacataattttacaaattcataattataactgtatttgggggtttatatcacatatagacataatatacattactttaataacataaaagaaggtagaaaatggagctcttctgaagtttctacgtgctactgaaatgaagtcagcattaatcttctgtaaactgtggtaaaataagatgcacattataaaccctagagaaaccagtaggaaaataattaaaaatatacatgtatatgataaagacatcaaaaattaattataacagtatattagaatatagctatttaacacaaaaaactagagcaggaagaacagaggaacaaaaagacagggtatatgtagatgaaaaatagtaaactggcaggcagaaattgaaacagactaaatgtaaacagttacattaagtataaaataattaaacattcaaatcaaaagggagaaactatcaggctggattttaaacactagatgaaaaaatatatatctaactatactatgagagacacgctttacagtcaaagaaacaagctaaagggaaaggatggggaaagatataccaggtaagccttaaagagagctagagtgactacactgttattatactaaatagactttttaaaagagaaaaattttataattcagtaattcaattcctcagggaaatgtgaaaagtaaaatgatacatgcatctaacaaatagagccccatggtacatgaagaagaaagaaactgatagaattaaagaaagaaagaaataatgcaacaataatagatgaaaacctcaaaatcccactcttaataatggatataacaaaaagaaaatcagtgaagaaataaaagacttagacaacactatatacttatggactacctgacatcaatagaacacttcactccaaaacgcacattcttttaagcacacatgtaactttatacagaaaagacaatatgcaaggtcataaaataattccccataaatttaaaagactgaaatcataaagcatgttctctaatcacaatggaattaaattagaatcaatagtagaaagaaatttgggaaatccacaaatatttaaaaattaagaaaaacatataaataatccatgagctaaagaagaaaccaaggggaaattttttttgaactgaatgaaaataaaactaatataccaaaatttatggaacacttcacacctattagaatggctattatcaaaaagactaaagataacaagtgtggtaaggatgtggagaaaagggaacccttgtacacttttggtgggaatgtcaattaggatagccattatggaaaacattgtaatggttcctaaaaaaattaaaaatggaattaccatttgatccagcaatctcacttactggtatagccaaaacatataaaatcagtctgttgaagagacatctgcacccccatgctcactgcaacactatttactataatcaagatatgaaatcaacctaagtatccatcaataggtgaaagtgtaaagaaaatgtggtatgtatacacaatgggatactattcagccttaagaaagaggaaaatcttgtcatttgcaacaacatggatgaacctggaggatgttatgttaagggaactaagccaggcacaaaatgacaaataccaccttatctgacttatatgtgtaaactaaataacttgaactcatagaagcagagaataaactggtgcttctgaggggctgggtgcaggggaggggactggggagatgttggtcaaatgataaacaatttcaatttgacaggagaaaggagttcaagacacatggtgactatatttgataacaatgtactgttattagcaagatgtcaaaataggagattccaggctttacttctctccatagaaagtgcaactagcaactatcaacagaccaaaacatctttgtgaaaaccccaaaacttgggaaaagcctgagacacccatgtggaccacagaactaaataaaaacccattagaaggataagaggaatgatcccactttgacttcaaggcatctcctactcccctaagttggcacagtgccatacagagacagttctcctgggcttacagtttctacagtgggaaaagagaaccagaggcagacaactagatttctagcattccaagatgctccccaggaagcccactctagtctcacctcatggggaacagaaagaataatgacacagctagactgccttgggtcaagtagaaacaaagaaaggaggcagagctcataaccaccagtgtgtgaatcttggtgatagctctgggctcctgctagcagtggtgccctgtcagatgtaccagccaatggcatagcccacccacaaagtagagctgattgctcccagaagcacagtgggaagttcaatctggcttaagtctctaggatggccagcctccatgcccagcctcagactccccaaggccccttccagggagagagttgcccatcacagcacattttggcaaagcacaggggctaggcctgcccccatctgggagaacaaacagcagcttggctcagccacaaaccccatctgaaaaccccacccagacagggaggcaaacctcaactatgcatttctactgagcatagaagatactcccaaccatcccaagcagcaactctgcctaatcttggagaccagcctgcacccctggcccaaccacagaaatcaaatggtggtaatgcccagccaaggaatacaccctgtgatccagcctgatcagaggtgattgtaaagcccagccaacaactctgcctgatttcagagctcagccagtgatgccataagatattgaagcccagccagcagcctcatatgacctcagagcaaaggcagcagcccaccaagctagaaaatacaacagcaagctctgacttcccaggcttgttaccagatggccccgtccagtatcacaggctagacaatagtgaaggtccatccctgccaaagaactcctgtaaaggttggaagaggtggttgcctcctcaaatgtaaagacaccaacataaagaaacaagaattaagaagaatcaaggaatcattacatctccaaaagaaactaataaaactccaacaatgggtcctacagaaatggagatctatataatgactgacaaagaattcagaataatcctctttaaaaagttcagtgaactacaataatatatggataaaaaattaaatgaaatttggaaaacaatacatgaacaaaataagaaggctgacgaagaaatagaaacaattttttaaaaataaaaatcttagagatgaagaactcaatgaatgaactgaaaatttcaatagaatatatcagcagcaggctctataaatccaagaaaaaaaaaacaatcagtgagctcaaagacagaacatttgaaataatgcagtcagagagcaaaaagaaaaaagaatgcagaaagcctatgagaattatggaacaccatcaagagacttaacatttgcataataataatacatgaagaagaacagagaggaaaagagccagaaaggctatttaaggaaataatggctaaaacctttccaaatctgggggaagatgccaaaagtctggcaaaggaagcatacagacctgcaatcaaattaaacccaaagaggagctcaccaagacacaataatcaaactgtcaaaattcgaagacaaataaaaagttctgaaagcatcaagatataagaaacacatcacatacaagggaatatcaatatggctatcagcatatcagatgttttagcagaaactctgcaggtcaggagaaaatgggatgataaattcaaagtgccaaagtggggagggggaaacccagcaaccaagattactttaactggcaaatctgtccttcaaaaatgaggaagcaatttttaaaaaaaagaaaaaaatgagggagaaggaaaagctttctcagacaaacaaaagctaagagagttcatcaccactaggcctgccctgcaggaattactaaagggagttatttaagctaaaacagaaggccactaattaataacataaaacatatgaaaatgcaaaacttaatggtataagtaatacagttacatatagaataggagtataatgatggtgtgtaaagcaattttacctcaagtacaatggctaaaagtcaaaactatgaaaaataactataattaaaataaattatcaagggatataaattacaaaatgctgtaaattttgacaccaaaaccaaaatgtgtgtgttcaggggaataaaagtgtagagctatatgtgataaaagttaagttcttatcagcttaaattcacctattataagatgttttatgtaagccttatgataacaacaaagtgaaaaatctatagtacagctgactcttgagcaacatggtttgaactgcatgggtccacttatacacagaattttttcaacatatttgaaaaattttttgaaatttgcaacaatctacaaaaacttacaaaccatgtggcctagaaatataaaaatttaagaaaagggtatgtcacgaatgcataaaatatatttagatgctagtccattttatcatttactaccacaaaatatatacaaatatgttataaaaagttaaaatttgtcaaaatttacaaacacagactgtacatgatgccattcacggtcaagataaatgtaaacaaatataaagatgcagtattaaatcataactgcataaaatttactgtagttatactactataataatttcatagacacctcttgttgccattgtgggtgggcttaggtattatgagtatccacctaaaaagctgtgtgatgctaatcatctccacaagagcagttcatgtctgcagtaaattgcatatcatagtaagaagtgatctctcatgattctcacatatttttcattgtatttagtgcaatgccataaaccttaaacatcatgggatccatacaaagtgccacttgtgatgttggaagtgcttccaagaagcagagaaaagtcatgacattacaaggaaatgtttagttacttgatatgtactgtatgtagattgaggtctgcaactgtggttgtccaccatttcaagataaataaacccagttaaggaccattgtaaataaagaaaattcatgaagctgtggctgcagctatgccagcaggcacaaaaaccttgtaccttttgtgaaatacctttttatctcattttgaaaatgtagtttttatatgggtacaggatttctatgagaaaggcatacctatagattctaatatgatttgaggaaaactgaagtgattatatgacaagataaggcaaacgaaaaggtgaaggatctaaagctggaaaatttaatgccagcaaaggatggtttgacaatttcagacagaggtttggcattaaaaatgttaagagaagcagcttctactgactaagaggcagcagatgatttctgagataccattaagaaaatcacccaagagaaaggctatctatatgaacaaggttttaatgttaataaatgtgccctatactgaaagaaagataccatgaaggacatttattagtaaggaagagaagtgaatatcaagatttaaggcaggaatggataggctaactctaccgctttgtgcaaatgcagtcaggtttatgatcaggattttccttatctataaaactgctaatctccgagctttgaagggaaaagataaacaccagttgtcagtattttgattgtacaacaaagcctggacaacaagaaacctttttctggattggtgccattgatgctttgtccttgcagtcagaaagtaccttatcagtaagatactgacttttaaagttcttttgatattggacaatgtccctggacacccagaacccccatgagttcaacaccaaaggcgtttaaggggtctacttgcctccaaatacaatgtctctaattcagtccctagatcagagggtcataagggcctttaaggctcattacacccagtactctatagaaagaattgtcaatgctatgaaagagaaccccaataaagagaacatcatgaaagtctggaaggattacaacattaaagaattcccccatgtgtatcaaaagaaagaaatgaggctattttgacatgacttattcttaggaacctcagtcagttgcccaatacactgtcccctaaatgctaacattatctaatactttcaagggttgttgtccaacttctcagaatttactcttcaaaatatatgtttgtcagttccccaatcttttggcgcctcttatgttttctgtagtttccataattcctgacagtgactatactcaggaatacatttcttctaagtatacgaactcattgaaataggctcagtgtttctttttttttaaattctattattattatactttaagttttagggtacatgtgcataatgtgcaggtttgttacatatgtatacatgtgccatgttggcgtgctgcacccattaactcgtcatttagcgttaggtatatctcctaatgctatccctcccccctccccccaccccacaacagtccccagtgtgtgatgttccccttcctgtgtccatgtgttctcattgttcaattcccacctatgagtgagaacatgcagtgtttggttttttgtccttgcgatagtttgctgagaatgatggtttccagcttcatccatgtccctacaaaggacatgaactcatcattttttatggctgcatagtacacatgaaaaaatgctcatcatcactggccatcagagaaatgcaaatcaaaaccacaatgagataccatctcacactagttagaatggcgatcattaaaaagtcaggaaacaacaggtgctggagaggatgtggagaaataggaacgcttttacactgttggtgggattgtaaactagttcaaccattgtggaagtcagtgtggcgattcctcagggatctagaactagaaatgccatttgactcagccatcccattactgggtatatacccaaaggattataaatcatgctgctataaagacacatgcacacgtatgtttattgtggcactattcacaatagcaaggacgtggaaccagcccaaatgtccaacaatgacaggcttagtgtttcttaagcatttttttacctaagctaatacaagttgagtattccaaattcaaaaatccaaaatctgaaacattttgagcactgacatgagctcaaaggaaatactcactggagaattttggaatttggatttggggattaaagatgctcaactggtaagcatgtaatgcaaatattccaaaaaaaacaatctgaaatgcttctagtcccaagcatttcagataaggaatactcaacctgtacattcttcaaaataaaatccttttcaaaaaaaaaaaaagatgccatcattgttatagaacaaggcatgaaagccataaagccccaaacaataaatttctgttggagaaaactgtgtccagatgttgtacatgacttcatagacttatgacagagccaattaagttaatcatgaagtagattgcacatatggcaaaagcaggtggaagggtgaagggtttcaagataggaatattggaaaagtccaagagctaatagataccatgccacaggaattttaaaattttaaaatgacgacttgatggagatgagtgcttccgaaccagtgccagattatgagaaagaagatgtagatgaagcagtgccagctataaagacacatgcacacgtatgtttattgcggcactattcacaatagcaaagagttggaaccaacccaaatgtccaacaatgacagactggattaagaaaatgtggcacatatacaccatggaatactatgcagccataaaaaatgatgagttcatgtcctttgtagggacatggatgaagctggaaactatcattctcagcaaactatcgcaaggacaaaaaaccaaacaccgcatgttctcactcataggtaggaattgaacaatgagaacacatggacgtaggaaggggaacatcacacaccggggtctgttgtggggtggggggaggggggagggatagcattaggagatatacctaacactaaatgacaagttaatgggtgcagcacaccaacatggcacatgtatacatatgtaacaaacctgcacgctgtgcacatgtaccctaaaacttaaagtataataataataataataaagaaattgacactagacaatacagaagaagggttctgattattcaagactgcttttttacttcttttacaatatggacttttctatgatatgggcactgaaactaaagcaaatggtggaataattggtaccatataggaacatttttagagaaatgataaagcaaaaaatacagacagaaattatgatgttcttctgtagttacaacgagtgttcctgcctctcctgcctcccgttccacctcctccaccccttccacctctgccactcctgagacagtgaggtcaacccctcctagtcctcctccttctcagcctactcatcttcacataagaatacagtatataatatgtataacataaaaagtatgtgttaattgactgtttatgttatcagtgaagcttctggtcaatagtaggctattagtagttaagtttgggggaataaaaaattacacatggattttcgactgtgcaagagtcagaagccctaacccccacattgttcaagtgtcaactgtacttccatattatacaaactcttcctgagaacaaataaagagaaaatactcccatactcatgtttaaggcaagtataatctttatatcaaaatcaaaccaagacaacacacttacagaccaatctcactcacaaacatgcttgtcaagaacacaaacaaaatatattagcagaacaaatccaagaaaaaaagtaaagacatgaatcatgttcaaggttgcttaaattttagaaagtatattatagaattcaacaaattaataggtgatagaagcaaaatacactcacttcaacatgttcagaaaaaaatagataatatatccattcacaatattttaaaagtctctcagtaaattaggcatagaatggaacttccttagcctgttaaggggtactaaaacataacaaacatacttaacagtaagatataaaagcatttccatttatttattgatagtgagacaaaaattgatacaaccatgttgaaaatgagtttgacgttttttatctagtagagttgaggatatgcatacactttatcctaaagtagtggttttcaacaggcatcttgccaccatcaaccggcatcttgccatgtctagggagtgtgttggaaatgtgtatggggcaggttggttatcacaatgattggaggggaattattgacatttagtggcatcagagatattaggcatcctgaaatgttcaggacagtcccaggcaatggagaatcctgcctaaactttttaatattaaccttgacatgcctacaaatgaaaaacctgtttataattaccagaggccagaacctacctccttttgttacatataaacatggtatttttgcatgaatttactatatactgaattttctaggagtaaatctaccaagtaaattgagagaacagtatattttcttttgttcagaaatttatccaaaataatttttttagaaaatcatgtcaccaatgataattacactttgtggtattatatttgtagccgtcacattcatggcgatcaatgtataggtgtaaatatttggctacttcaggtagtcatgtttcagcatttacatatttaaatacattattataaatcactcgcatttaatttttcctttaaattctagttaggacattgtgctcatattttaaatatgtgtataggtaggttatgctatctatgaatttcacttctggttaataaagaaattggtacaaaatatttgttacaaaaagggaattggtagagtctttcaagatggctgactagaggcacaagacacttgactcctccacaaagaagaaccaatcaactgggaacgaccaacatcacagctgacaaaagttgcaatactagttgaagcaaatgagaccagcctaaaatttaacagagtaatctactgcacgagacagctatactgggctttaaataaggtcctacatatccctaggggtctccaagtctgtgcacatgctcgggagaaactgaacagtgcctcacttatctactagtctttgcctaaatgtgtggtgttatacagtagcaagtaatagcaaaggtagatttctaaactgcgtgaatctggaatgtacgccccagcccacacatggatactttcagcaaattgtggaaccctcactggcagaaggtgtttaagcataacatatgaacaatcactggatgaccactaaaatatggcccagcagtgaccccctggaagctagcataataacaacaacaaccaaaaaaactgagtaaaagcatcagaggccacaccctgtgggggaggccagaaggcagtggaatagcaaaatgctgaaagaaaaatacccaaaattttcaagtaagaattctatatccagcaaaattatccttcaaaaatcaatgtgaaataaataaattccacaatacacaaagacagagaattcattgctaacagacctaccctacaaaaaatactaaagtccttgagctaaaaggaaatgacaccagatggtaacttgaatccataggaagaaataaagaggattagtaaaggtaattatgtaagtaaacataaaagagaaaatacatacttttcttactttcttttaaaggaaaactacataaaacagtatttttaaaactgtgttgttgggcttataacatattaagatgtaaaatatactgcattaatagcacaaaggatgggtggagaaaacttccctgtgttgctgaaattaaattattattaatctaaagtaggttatttcaagttgacatacatattgcaatccccagagcattcaataaaaaagctctagaaattacagtaaaaacatcaaaaaaggatttaaatggtatgcaagaaattagctatataacataaaagaaggtaataaaggagaaacggaggaacaaagaagtcaagaaacattaatgaaataaatgaataaagccagatgtacatctataagtataaatgggttaaacagtccaatcaaaacaaacattgtgagactggatgaaaaacacactccaaggatatgccatctacaataatggaaagacacactttaaatgtgaagacataaacaggttaaaagaataaaagaatgaaaaaattgtattaaaaaaaagagcaaccataaaagagctggagtggttaaactgatatctagtatcagacaaaatggactttaagaaaaaaatgttatagaaaaagaaggacattttataatgatgaaaggttctattcatcaggaagatatgtaactataaacatatacacatctgacaacaaaactctccccaactaattctatgaggctggtctctgacatcaaacaaaacaaatacattataagaaaagaagcctacaattcaacttcccttatgaatacaaatgcaaaattccttaacaagatgttagcaaatcaaatccaccagtatttcaaaaaggattatatatcatgacaaagagagatttattccaggaaggtaaggttcgtttaacacccccaaattaaggtaataccctatgttacattagttaataatgtattgtgtagaataaaggacaaaaaccacatgatcatttcaatagatgcagataagccatctgacaaaatctaacagtcattcatgatcaaacataaaaacttaaccaattagtaaaacttcctcaacctgataaagaacatctacgaaaaatgcacagctaacatcacatttagtgatgaaggattgaatatttcccctaagaccagaaaaaaaacaaagatgttcactcctgtcattcctattcaacattatactggagatgctagccaggggaattaggcaaggaaaacaagtaaaaggtatccaggctggggaaaaaaaataagtcaaactgtccttgacataatcctgaatgagaaaaccctaaggaatatacccacacactcacatgcacacatacacatggacacacacacacacaatattaaaactaataattctactcaacaaagtcacaggataccaaatcaacatgcacaaagtcaatttgtatttctatacacttgcaaaaaatcataaagtgatattataaaaaataattcacaatagtaccaaaaattaaatacttgggaataaatgtaacaaaaaagtaaaagatttttacactgaaaactacaaaacattgttgaggaaaattaaagaagatctgaataaatggagaggtatttcaagttcatggattgaaaaatccaatactgttagttggcagttctccccaaactgatgtatagattcagtgcaatcgctaccaaaatcaaagcagaggctgggcatgatggttcatgcctataatcccagtactttgggaggccaaggcaggaggatagcttaagcccaagagtttgagaccagcctgggcaaaatagggagaccacatctctacaaaaatattgttaaaatagccaggcatagtgatgcacatctgtagtcccaggcactcaggagactgaggtgggaggatcgtttgagcctgggaggttgaggatgcaatgagctgcaactgtgtcactgcactccagcctgagcaacagagcaagaccctgtcgaaagaaagaaagaaaagaaagaagaaaagaaaagaaagaatgaaagaaagaaagaaagaaagaaagaaagaaagaaagaaagagtgacaagatgatcctaatatttatatggaaatggaaagaacccagaatacccaaaacaatgttgaaaaagaagaacaaaattttaggattcacctttctcaatttaaatacatattacaatgccacaatagtcaagacagtagggactggcataagaatagaaatataaactaatggaacacaattgagaggtcggatataaacccttatatttatggtcaattggttttcaaaaaaggttccaagtcaattcaacaggaaaaggttagtttttcaacaaatgatgatagtacagttggatatccatatgcaaaaagattaatgaagaccttcaccttacaccatacacaaaataacacagaatgaatcagagtcataaacgaaagacgtaaaagtataaaacttttagaaacataggaaaaccttcatgatattggattgggcaaagaattattagatacaacatcaaaaaacacaattgacaaaagaaaaaaaataacttggactttatcaaaaataaagaaccgagagcccctctgccactgccattgcagcagctctgtccttgctgccctaagactggggaaggaataaagagcctgagggatttacttgcacctccaacatgccacagttgccatacagaatagagccaagtctctcatctctgtgagcctccaaccccctggtcttcaccaagcagggcccctggcttgggcccacagaacagctgccctacctcgtggctgaacatacccattgtcagtggctctgtgttgctctggggtggagctcccagaggcaaatgaaatgccctctgagactgccactgcagtggtactgcctttgctgcccttggattggggaaggaacaaagaccctgagtgctgtactcatacctccatcatgccacagccaacctaagaagaggctagtctgtcttccctgtgagctcccttctccccctccccattcatcaccaggcagggctccctggctcgggcccacaatgcagccactccaccccaggatgaatgctccaaatgatagtagttctgcatttctctggagtggagacccaaaagacaagtgaaaggccctctgcaattgccactgccaaggtccctgcccctgctgctcccaagctggggagggaacacaaagcctgagctcatctgaaggctgcatgtgaagcccaagagtgtcaagccaagctctgcagccagcactcaagtgggagaggagcccacaccctcagagcaccaagagggagcatggccgcaaacacaaggaaatagaggagtcatgtggctgagcaagagcctacctaatggccattacacttaagcaccatctactggatcacagcccaaattttgacaccaaaaatacttacctaatatatccctctgtgaaacgaagaacaagaattcagctacaaataaagaccccgcacaaagctccagcactctgacaatgtccagaaatgaggtcaactgactatactcaaatcacaccacagttaaagaaacattagcccacacacaggagaaagaaccagcacaagaactctggcaacccacaaagccagagtgtcttttttcctccaaacaacactagttccccagcaaggattcttaaccaggctgaaatggctaaaatggcagatatagaattcagaatgtggataggaattaagatcatttgagatccatgagaaagttgaaactgaatccaaggaatttaaggattataataaaacaatacaggagctgaaagatgaaatggccattttaagaaagaaccaaactaatatgatagagctgaaaaacataatactgtccatgaaaatttcccaaacatcactagaaaggacaacattcaaattcaggaaattcagagaacctctgcaagaactatacaaaaggaccatccccaagacacatagtcatcagatgctccatcaagctaacagcgacctttcagcagaaatcttgcaagtcaaaagagattgggggcctagattcagcattcttaaagaaaagaaactccaaccaagaatttcatatccagccaaactaagcttcataagcaaaggagaaataagatcttttttttagacaagcaaatgctaagggaattcattaccatcaggcctgccttacaagaggtccttaagggaatgctaaatatggaaacaaaagactattactggccaccacaaaaacacacttaaagacataggccactgacactataaagcaaccacgtgatcaagtgtacataataactagctaacaacatgatgccaggatcaaatctgcacatatcaatattaatcttaagtgtaaatgggctaaatgccaaaattaaaaggtatccaacggcaaattggataaagaagcaagacccggtggtatgctgtcttcaagagtcccatctcacatacatcacatacaatgacacccatagactcaaagtaaatggatggagaaaaacctacaaagcaaacaaagaacaaaaaaaagcagggattactattttaatttcagacaaaatagacattaaaccaacaatgatgaaaaaaggcaaagaaggacattacaaatggtaaagagtcaacaagaagacttaactatcctaaatatatatgcacccaacacaggagcacccggattcataaaaccagttttcagagacctatgaagaaacttagataactatacaataatagtgggagatttcaataccccactgacagtattagacagatcctcgaggcagaaaactaacaaagatatttgggacctgaactcagcatttgatcaagtggagctaacagacatctacacaacaatccacccaaaaacaacagactatacattcttctcatctgcagataacacatactctactgaccacacagtcagccataagacaattctcagcaaattaaaaatttttaaaaccaacaaaaacaaaaatcataccagccacattctcagaccacagcacaataaaaatagaaatctataccaagaagattggtcaaaactataaaattacatggaaattaaacaacctgctcctgaatgacttttgagtaaacagtgaaattaagtcagacatcaataaattcttggaaactaatgacaacaaagatacaacatgtcagaatctcaaagacatagctaaaacagcatcaagaggaaagattatagcattcaatgataaaaaaaatgaatgaaatcaatgaggctggttccttgaaagaataaataagacagatggactgctagctagactaacaaagaaaaaaagagaagacacaagtaaccaaaaacagaaatgataaaggggacatcatcaccaaccccacagaaatacaaaaaaaaaaaaaaaaccccatcagagactattatgaacatctttctgcacacaaactagaaaacctagaataaactgataaattcctggagacatataacctcctaagactgaaccaagaagaaatacaaaccctgagcagaccaataacgagttccaaaattgaatcagtaatgaaaagcctaccaaccagaaaaaaacacaggtccagaaggattcatagctgaattctaccagacatataaagaagagctggtaccattcctattgaaactattccaaagaattgaggagggactcctccctaactccttctttgaggccagtatcatgctgataccaaaacctggcaaggacacaacaaaaaaggaaaacttcaggccaatatccgtgaagaaagtagcatgtcaaaaagctaattcaccaagatcaagcaggctttatccctgggatgcaaggttggttcaatgtatgcaaatcaataaatgttattaatcacataaacaaaactaaaaacaaaaatcacatgttcatttcaatagatgcagaaaagccttttgataaattgcagcatctattcatattaaaaaccctcaaaaaactaggcactgaaggaacatacctcaaaataataagagctatctatgacaaacccacagccaacatatactgaatgagcaaaactggaagcattctccttgagaactggaacaagacaaggatgcccactctcaacatactactggaagtcttggccagagcaatcaggcaaaagaaagaaaaaaaaggcatccaaataggaagaaaggaagtcaaactatctatgtttgcagacaatattattttatacatagaaaacccctttgtctctgacaaaaatctcctagatcatatcaacaacttcagcaaagtttcaggctaccaaatcaatgtacaaaaatcagtagcatttctatacatcaataatgtccaagctgagaaccaaataaaaaatgcaatcccattcacaatagacataaaaaaaataaaatacctgagaatacagctaacctgggagatgaaagatatctgcaatgagaattacaagacactgctgaaagaaatcggagatgatacaaacaaatgaaaaatcattccatgctcacggataggaagaatcaatattgttaaaatagccatactgctcaaagcattttatagattcaatgctattcttatcaaactaccaatggcattcttcacataattaaaaaaaattattctaaaattcttatggaaccaaaaaggagcccaaatagccaaagaaatcttaagcaaaaatacaaacttggaagcatcacattacttgatatcaaactatagaagtctacagtaaccaaaagagcatggtactggtacaaaaacagacatatagaccaatggaacaaaatggagagcccagaaataaggttgtgtgcctacagccatctgatctttgacgctgatgaaaacaagtaatgggatagatactccctattcaataaatggtgctaggattgctggttgctgtgtgcagaagatagaaaccagaaggcgtctgccttctttacaccatatacaaaaatcaacccaaaatggattagacttaaatgtaacaactaaaaccataaaaacccttgaagaagacctaggcaataccattctagacatgggccctgtcaaatatttcatgacaaagacatcaaaagcaatggcaataataataaaaactgataaatagcacctagttaaactgaagagcttctgtacagcaaaataacctatcaatagagtaaatagacaacacacagaatgggagaaaatatttgcaaactaggcatctgacaaagttctaatatctagaatctataaggcacttaaattaacaagcaaaaaccaaacaacctcattaaaaagtgggcaaaggatatgaacagacacttttcaaaagaagacatacatgtggtcaacaagcatatgaaaaaatgctcaacatcactaatcaatgaaaaccacaatgaaataccatcttacaccagtcaggatggctattactaaaaagtcaaaaataacagatgttggcgatggtgcaaagaaaagggaacacttatacactgttggtgggaatgtcagttagttcagccactgtgggaagcagtttgacaattcctcaaagaacttaagacagaactaccatttgacccagccatccattattgggtatatacccaaagaaatataaatcgttctgccataaagacacatgcatgcatatgttccttacaacactattcacaacagcaatgacatggagtcaacctaaatgcccatcagtggtatatggaataaagaaaatttggtacatatacaccatggaatactatgcagccacaaaaagaatgagatcatgtccttggcaacaacatggatggagttggaggccattattctaagcaaagtaacacaggaacagaaaaccaaacaccacatgttctcatttataaatgggagctaatattgagtacacatggacacaaagaaggggacaatagacacgggggcctacttgaggatggagattgggaggagggtgaggatcaaaaaactatctattgggtactatgcttattgcctgtgtgatgaaataatatgtacgccacacccctgtgacacacaatttatctatagaaccaacctgcccctatacctctgaaactaaaataaaagtaaaataaataaaaacctttgcccttcaacatacagtagtaagaaaatgaaaagacaaaccacagacttggagaaaatattttcaaactacatatctgataaaggacttgtatataagcaactcttacatctcaatagtaaggaagcaaacaacctaatcagaaatgggcaaaatatgtgaggagacatttctccaaagaacatatacaaatatctaacaagcaaataaaaagatgctcaattagccattaaggaaatgcaaatctaaatcacaatgagatacttctccacaccctcaagaatagctacacatttgaaaaaaacaaaacaaaacggggaaataacaaatatggtgatgatgtgaagaaatacattgctggtggttcatataaatctagtaactgtaaaatagtacagccccttgggaaaacagtttggcagaaaattaaacatacagttataatatgaccaagtaattccactcataggtgtttaaccaagagaattgaaaacgaatgtccacccaaaaacttgcacacaaacgttcatagcagctttattcataatagccaaaagatagaaacaatccaagtgttcatcaactgatgactagatagacaaaatgtagtatactgatgcaatggaatattactcagctataaaaaggaatgaagtatttatatatgccacaacattaataaactttggagacattatttagatgaaattttcaggataggcaaatccataggcacagaaagtagattagtggttgtctgatgctgggagtagtaatgaagactgactgcagatgggcaaggaagatgtcactgacgtgatgcaaatgttttaaaattagattgtagtgatggttgcaccacccaataaatttataaaatcactttaaatatgcaaattttatggcatgtaaattatcctaaatacaatatttaaacactgtgagcatcaagaaaaaaagagaactttcatctccttactttgacaatttattagggatcatacagaggtcattaggctgtttgttgttgttgctgtggtggtggtgggttgtggttttcccatgagagtcgagggtcatgcaaccatttggtcttttaaaataaaaatttttaaatcaattaaaaaagaatattgctggcttgaaatttggagtagtcatgggacaaagagaagtggatggattttttaaaatattcaggatgtagaagtgacaagattttgtagcagttagatatagggagtggggaaaggtgaggaggcctcagactgagtatgcttaaagttgaattcctgttgtcctcccgaactggctgtcctgtgctgccaatctcagtgaatggatcagcatcctggcacagagttgacattcattgattgcctttggagtgaatgaacagagtatgatgaatagagtgaaaatatagctaaacaaggcagacaccaggtcctgccaaatagccaatgcaaaactcacccttcaggttggctcagcagatatccagcataatttttttctcacctttcaaaccatttgggaaatcatgaggtattttcctcatccagaagaacactcacctacatatcagccactccttccctagaacctacaggtatggagcaggctgggttttttcaagagcctcttatcctgtaaatctttacacagggcaatggcaggtgcatgtacagcccatatgagcccaggggatgcttggtattatagaaaggggatcacagtggtgcccaactgatggatccgtgttcagtttgcaggaagagactcttcccaccaaagaggtttgttaatcctggggtccccctcccagcccctggaggcatcagatacagctgtcagaaacattgtaaacacccagtgatccacttggctggttttactgttgttcccagggttgacaagcagaaatacagaacaaatggtggttcctgaaacagaggccaaaacaaggaagtgatctgttccagtccaagcttccaagaaataaagaactaggtggggcacactaaacaagcccccagactcaaccaccccagtaaacattcccttcatcacactggttatgagataaagtataagttttttaagccttattataaataaccttacttaacgtcttctggttgttgtgaaaattatagtattttgcaaaatatatgttcaccattatcattaccaccagttccttaatgaggagaaaccagaagttgacaccaaaatgttgatccataatgtttatagtccttctttgtctttatagttaatgtaaaataaactgtatgtaatttttactacagtgtgtcctgaaagggcaaaccaagctacaagcaactctaaaagactactactgtatgggagtggattatgaaagtgtttcttaaatatgagagctcaagtttttctttcagcgactgagttaaagcacgcaactcatttatcatgagacttttgctaggcagtgtactatgtccactcaacacacatcattttaggcaatcatctggttaaaacgtttaatagtatggcattcacaaacccattcttcagagttgacattcaattaatggtttgaatgtcgtttccagggcagtcaggagtatttaaaggcttttccattgttttcggaagagaaagaaaacttcctagcctaacttacttacccagagccttgctccagagggggcagacaaagggtaaaatctgggcagagaacattagtggatatgagaacgaaagaaagtgctgcaagatcttgcagacagctgagttccaccttccactctactgccgaacaaagtgaggcaggaagagggtagggactcgctgaaagctaaacaccaagtcagtgacagatccagggctgtaaagtccgaccgagattgaaacaatgtacactgggcgtcagtcccaacgcgagcttgctccagctcttccagctcttcctgagcgctaggcccatccggcctcacgctgatctccgggcagactctgtcgcgcaactggcacagatcgtgacgacaaccctgcggcaaggcaggagtggccttcctctccgccagggttaaggtgagtaccaccgcccttgggcccagcagcccgggtgagagcctccgccgcccactgcgacaggcctgaaagcgagcgcctgggtaaacccacccgtagcacccatggggacaccccttccctgacccacgggacggaacccacctgtgctggaggtcgtgactgctaactccgcagagtgggcagaattccaagcaaggagagtctcgggaggcagcctttcacccgccttttgccttttcacccccaaaactgtcggccccacgctcccctcccccagcccgctcgggcccagcggagagcctgtaggcccc

SEQ ID NO: 1458 - DNA, 40298 bp, Homo sapiens
cacaaagaaacagacagccctgtatttctaaaaccattcaaggctccttcattaattggcttccccccaaaagaaagatttctttattaagaaataccagagagtgaaaaacccccaacacatacacatttgtaggctcacacaaaagtgcagagatttacatattaaattgcatttaaattagaaaatagatttaaaaacaaaatactttttttctccaacaaagtaaagagatttggtcagtaggaacgggtgctttatgggtaaaggcaggatggtcaggacagggagaatggaatttagctgctacggaatcagaatccacctctaacccaacctcactcctggggtaaaagcaaaggaggagatgatgatctcagctagggccaggaaggcctcagagctgaatggacatgaagaaatggctcaccacagccaatttccacctgcccccagaggtttgggatcagtgccaaccatcctggcctgggaaagtagggtgcataggaagcttgaggaagaaggaggaaggggagagttggagacagtgtcagccattgaaaagaccaaacaatttaaggcccttttcccctgggaacattgattctttaatctcccctctgatcagatagggacagtcccagctggtgcatggtatgaatgggacagatcttcaggccaacatcttaaacatggaagatttattaaggaaaagaaagagggcagggagtatgaaaaagcagaaaatcatttcacactagagataagagatttccactttgacccttcccatcagaaagagaaagcttctctgtctgacctaagggtcctcaggagaacacttgaggtaaggtgagggaggagagagagccatctgagcccaggagaggagatgggctgagtacttattaaaatggggttcatatgagtgccaagttacctggggaaacctaacaacttacaaattctccaggtttggctttataacttcaagaaaaaaaactgagagaaccagaaaaagaagcagacaggagagggatctgagtcagtctctccccatctctcttccaatctctctctctctctctctctcaagaatgctcaacttaaatcctgttaaaaggaaaaaggaagacatggaaaaaggtctgggagcagccaaatttcattaattccaattaactgggaagtatgagatgggaattgatagggagtcttgattatacaccacctagaaagaaatatataccatcacttgtaaaagaccactgatcaaatatttccaagggggggccctgatgagcctgcgttaataactaagacttattagcaattaacggcatccatctgcttcaaaacaatatcctaatatagagcttgttctcttaagtaaatataatccctctaccttcctgatcctgttcacactatatctccttgaaagtcctttcttcatagtccagaataagaaaaccttcagcccagaatgtagtatagatcaatggagagtttggaactacctctccaacccaagggtgccctggttaatggaagtttggggagtaacaagcaaccccttccaacccccacccccaccctacacacaaacatattcttgaaatggaagggggaaggaggaggcaggaagtttgcattagacacagtttaatcgccttcaaatagatgaaaagttctggtttacactcccccaccgcataagtcatccagacaggaccctggcttagaaagaggaaaacacaggtgctctaggaaatatagccacatataatacataaatcttcttccctgaaatagagcaggtcctgagcagagctgactgggggccacagcccacccccagggtgaagtggctctgggactctgccggtggaagtgctggaagagcggggcttggaggaagcccccagtgtggttaccatagccagaggtgggccgaggccttagggtgagttacccgagagggcagcagtgctgggctttccctcactcagccgaggcttaatggaagaactggttagcatttttttttttttgagggtacatcgggggagaggagaggagaggagagcctctctgtgccttggtttcccatttgtgcattcagggcctctgcaggcctcacacagggagtctgaggggatagtgtttaagtgagcactcaggcttcctctgaggaaaagaaatgaccaaagtgcagacttttattactgccattcctgctcctaatgggagcaggagtcaaaaggaaaaacaaattaaaaggggctaatgagaaaggaggagagatgagacagagagtgtgaagggctatgccgctggcatctcataaattcttattgagaatggcacaggtattaaaaaagtttctgggtagtctacgagaaatgtcaattattatctctactacaactacttacatatatctaatgggaaaagagtggggcttaggtgtcagagtggatgggagacaaaggagaagctacactaataaatacaacaagtggaaggtacctgtcccattcctaaaaggatttgtgggcaatgctggcacttggtggccaggagaatcttctgaccccactctccctcctcttcagtcctgaagaccccaagaacccagttaggatcccctggccagaggtctctgtgactgcctctggactcagcacgtgcagcagcttgggaggatttgagccagtctcaaaaacttttagccccagaatgagaccagtgaccccaagcaggagggctgggatctggagggaagagagggggtccaaggggaccctgtggctgaggccatggagaaccagtgccagggcccaagagacccatttttccagttatcagaggtgactgacatcttctgccactgccttgagttcagaaatttaaaaaagcttgcagcaagaaaatgccagtgtgcaactgggtgactaaagaccaaagaaaaacagttaaaagggacagcttacttgctctctgtctcaggtttaacttctcacctgaaatctctcatagccctaattaaacacaaacaaaagtctcttccatagataggctacttctcagcttcagctgcctcctgtggtggctctgggggctctggaggtggcatctcttcgggagtgctgctgtcctccggcatctcatttgagttcaggtgttctgtgggggcctgagaaggaaaagatatgagattcaacacaaagctgttcctcaaaatccaaatgcagataaaccttagacactgaactcttcctctcagccccctgatcacactgatgctacagatatgcagccaccaacaccaaactcagaaccaacaccaagctatcgtcttctcggcagaacacaactgaagtttatttgagtttgatccttaactgttggttggggacagatttttctattattattaatagtcataataataggaatcacaaataattacacaggtcctccccacttcagaacaaatgtcataacatacttatgtaacaaggcctgacccaatggtcctcaatcgtgtttctgcccgaacacacagctcattagaatagtgattctgaaccaaagaaggccaagtgtccaaattttcagctggtcatatgtggtttgaaaatgtccccaagtgattctaaaataccacccttctccactttgaaccaagaataactaacctagattgttacaatttgagtccagactcatttaaaaaataatattaaaaatgacaacaataatatataaacacgggttgctgtactttaaaaggaaattcaaaatttaggaaaggcaaagtagagaactattatctaccttataaaaagaattcacttaaaagtatgattctggccgggcgcggtggctcacgcctgtaatcccagcactttgggaggccgaggcgggtggatcatgaggtcaggagatcgagaccatcctggctaacaaggtgaaaccccgtctctactaaaaatacaaaacattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcagaaaaaaaaaaaaaaaaaaaaagtatgattctattttaaaacaaagttcaaactactaaaaatctattagaactaatgaacaagggccgagtacggtggctcgtgcctataattccagcactttgggaggccgaggagggtagatcacttgaggtcaggagtttgagaccagcctggccaacatggcaaaacccggtctctactaaaaacacaaaaattagccggtgtggtggtgggcacctgtaatcccagctacttgggaggctgaggcagaagaatcacttgaacccaggaggtggaggttgcagtgagccaagatggcgctgccgcactccagcctgggcaacagagcgaaactccatctcataaaataaaaacaaaaacaaacaaaaaagaactaatgaacaagcttggcaaggttttagggtataagatccatatataaaaatcaattgtctttcaatacactccaagtgaaaaatccaaaaatgaaattagtaaaacaatttcacttacaataacatgaaaaataatcaaatatttatgaataaatgtaacaaaagtgtaaaacttatactctgaaaactacaaaatgttgttgaaagaaatcaaatcatacctaaatatgtgaaaatacagtccatgtaaatggctcagaatatttaatcttgttaggatggcaatatttccccaaattgatctatagattcaatgaaatccccatcaaaattccagctggcttcttttcataaatgacaagttgatcctaagattcatacggaaatttaaggcacccagaagagccaaaacaatcatgaaaaagaagtataaagttggaggactcacatttcctgatttcaaaacttactacaatgctaaagtaatcaagacagcgtggtactagcataagaacagacatattgagcaatacaatagaactgaaagtccagaaatgaactctcacatttatagattttcaacaagggtgccaagacaagtctatgggagaagaatagtcctttcaacaaatggtgcagagacaactggatagctacaggcaaaagaaagaatgtggaccctctacctcacaccatatataaaaattaactcaaaatggatcaaaaacctaaatgtaagagccaaaactgtacagctcttacaagaaaacaagggcataaatcttcatgactttggattaggcaacagtttctcagatatgacaccaaaaagtacaaacaacaaaagaaaaaaatagacaaactggactacatcaaaatttaaaaattttgtgctccaaaggacactatcaagaaaattaaaagataacccatggaataggagaaaatatttgcaaattgtatatctggtaagagacttgcatacagattacataaagaactcttacaactcaacaataaaaaagacaaacaatccaattaaaaaatagacaaaagctctgaacagacacttctccaatgagcacataaaaatggccaataagcacatgaaaagatattcgacatcattagtcatcagggaaatgcaaatcaaaaccacaatgagataccacttcacattcactaagatggctagactcaaaatgtcagataataagtgttgcagaggatgtagagaaactggaaccctcaggcactgctagtgggggtataaaatggtgcagccactttggaaaacagttcagcagtaccttaaaggttaaacatagagctaccatgtgacctagctattttactcccaggtatatagccaagagaaatgaaaatatatggccatgcaaaaattggtacacaaatgttcatagcagcatcactcataataatcaaatggtggaaacaatccaaatgtccatcaactgatgaatggataaatgaaatgtggtatatccatataatggaatatcatttggccatataaaggaacgaagtactgctacatagtacaacatggacaaacctcgaaaacatgctaagtaaaagaagccagtcacaaaagaccacatattgtatgatttcatttacatgaaatacccagaagagagaaatctgtactaaaaggaagtagattagtggttgcctaggggtgtggctggggaagttcaggggaaagggagagtgactgctaatggctacagggtttcttagggtggaagggtaacgaaaatgctctaaaattgattgttataatgattgtacaactctgtgaatattctagaccagtgaatcatacattttaaatagggatcagttgggcgcagtggctcacgcctgtaatcctctactttgggaggctgaggtgggcagatcatctgaggtcagaagttcgagaccagcctgaccaacatggagaaaccccgtctctactaaaaaatacaaaattagctgggcgtggtggcacatgcctgtaatcccagctactcaggaggctgaggcaggagaacccgggaggcggaggttgcagtgagctgagattgcaccaccgcactccagcctgggtgacagagcgagactccgtctcaaaaaaaaaaaaaaaaaaaattgggacctatggtatgtgaatcatatctcaataaagttcttattaaaaaaagaaagctcagctgggcacggtggctcacgcctgtaatcccaacactttgggaggctgaggcgggaggatcacgaggtcaggagatgcagaccatcctggccaggatggtgaaaccctgtctctagtgaaaatacaaaaattagccaggcatggtggcgggcgcctgtaatcccagctactcggaggctgaggcagagaattgcttgaacctgggaggtggagttgcaatgagccgagatcacaccactgcactccagcctgggtgacagagcaaaactccatctcaaaaaaaaaagctcaagtaatatttttttttaggaaagtactttatatactttaaagatatactttatatatcttaaataggacagctgggagagtttccacaacttttgcatattccagttaggaagcccccttctaccacagtaaccacatcactaactctaatacaatcccctgacctctgtctttgcccctatagcattttatgctttcctcatcaaggcacttttcacaatgttgagcaatggcctgtttacttgtttcttgcccccactagacaatgagctccttgagagcagggacatcgtttgcctcattcattggtataaccctggcagctagtacagtggctggcacagagtcactcaatatacaccaaagaaatgactaaatcttaatctacatcaaggacacaaagatctgaaggcaacatcagggcaggtgtagaggcagggaagctggggtgattagaatacaatattgcctaattatatttccaagctgtaaattagcctccgccctctctatatcgacccagccttaagtcaggaacacttactgggctctgtggcaagaggctgctactggtctcttgagtactgggaggtcgacttccactttcctccagtggcaaaataccccttcgatccagcacactgaaggagataagagagttaacaaagaactgggcattcacccctccacccacctggcctacggaattttgctgcatagactggaaaatataaacctgtcctttggcaatctagcctgaacacagcacatgcctcttatctcccattcactttttcttccacaaaccaggaaatgtcacattaaccagggaacaaacaaatgaaattaagaatgaaagatcatccctccaaaacaaccagcccatggtctatggtccatgtagacatggtaccaagtggcaagccctggaaagacctatttgacaccaagaggccacactcagaaaaacacatcagacaaggtaacaggatcaggttgagctgctcatcccaacagtcccaggacttttgagtgccctgagcacctggggggcaaggggccacacagcacttcacagcagttcttcacaatattgccatggctgtagggattctggacgcgattcttccctgtccatgatcctttgatctgcaagataaaaaccaaggctgacattaaaaataatgttaaaatgaacaaataataataataaaattaaaaacagacacaaaaaagaaaaataataataataatgttgaagaaacacatgcagcatgggataataaaaaagttctggaaatggatggtggcaatggttgcacaacaatgtgatgccactgaactgtacatttaggatatgagggcgatctggctgcaacaactgtcaccccattgatcgccagggttgaaagacatttaatatagcacactttatatcatgtatattttatcacaacaaaaaagaaatacatacacagccatgaaaaatactcacaatagagtgaaaaaagcagataactgaatgatatatactatttttatttaaaagtacataatataaacacataaataaacatggaaaaaagtctagacaagtctagaatatataaatcatactactaacaaaggtgatgtctaagaagtaaagtaagaggaacttacttttttctttttgctcatctgtattttctgattttctacagtgaatgtagattaattgctaactttttttttttttttccagacagagtctcattctgttgtccaggctggagtgcagtggcgtgatctttgctcgctgcaacctccacctcccgggttcaagtgattctcctgcctcagcctcccgagtagctgggactacaggtgcacactaacacatccggctatatttttgtatttttagtagagacagggttttgccatgttggccaggctggtcttgaactcttgacttcaggtgatccgcccgcctcagcctcccaaagtgctgggattacaggcgtgagccaccacacccagcctaattggtaactttttatatagcaaggattcatccagtgcaactgtccctctccatgccaaacagaggcaccagctagcctttaaggacctgtgaacagttaaaggctgtatacccacccaacttttcaacctcttcttcctaatgctccacaagcattcaacaaagccctctcctttctcttccacacatctgacttaacaacctcgcataccacgtttctgcctgcctcaacctcccaggccctggagactcggtagttctctagcaggtagcaagaggataggctttgggaagaagaatatgtggtgaggagaagagaaagttgactcacgtcttcattggttgtctggttgagagccacgaggaaagtatgaaatccagtcagtcccacgacggaccagagtgtaaagaagcaaatgaggacttctagaacagtgaggtgtggttaaggagtattgaagaactcaacatcaggagacttgatgcctccgcccatattcagagcaccagtcagaccatctttacctcctggaacgtatatcacaaaaagccatgtttccatatataacaatagatgaattctgaacttactggatagatcccttatgaaagaatttctagcgtatctagggtatttaagggtgtgcctatttacccatcattggctcttggaaggggatgcatgggaggggccaaagctaaacaatgttggccatcactgccaatggaaattctgtcaaaaaacaaaattcatgtaatcccggcactttgggaggccaaggtgggcggatcacaaggtcaggagttcgagaacagcctggccaacatggtgaaacccccgtctctattaaaaatacaaaaaattagctgggcgtggtggcgggcatctgtagtccaagctactcgggaggctgaggcaggagaatcatttgaacccaggaggcgagctggggcaacagtacaagactctgtctcaaaaaaagaaaattcataaatgaagaactggtgggggaaaaaaaagaggatgtgatttatagaaatctcatctgaaccccctttgcagaaatgcagccactgtcctgagcagggggtgaaggaaagacctcccttttagtcccggtcatcttccattctggttgctaccactaagactatatttttttaaattattttagaccttggcactctctgatatctgaaaaactagatagtgggagaactgtggggaaaaagcatgctggaaagtagcttaagaaggcttcacagggacatactgccagcggaggatatgttccaggagtttctttcaatgtctccaagaagccaattttcaaagattctgtgaaattggatggaagagtagagagaaaaattagtgacttcagtcaaaactacacactatcctagtgcctactcacttccttccctccctctcccgtgttacacactggcaagagctaagctctcactcgggcaagggtgaagagcctcatctcctagctggtagtctcatgactaaagagttcacatttccagtgcaggaccaggccctggactagacaggcaggcagaagagcagcaggctcccttcccttttccctagcccccaactatggacatgttagggggatattaacagataaaagaaatcagaaatacccaagaaaaatcctctctccttgccaatacgtgtccctcccttgttcaaaatccagctcagaactcttctctttccagaaagctgtcttaagaccactcccttaactccacatcacatctgctcttagattggcgtgtgtgtgggtgtgtatgtttgtgcacatgtacatatgtgggtgtgctttctatctcccaaactagaccatgagctacaaaaagacatttctcaggcaaaacccttacccttttctaccccttagcacaaggcaagttttacaaggcagaagaagagaggatgctccgagacaaaatacatccccagcctttgggattacctcagaaatgccccagtactctggatacagaccagtaattatggccccagtgcccagcagttggccaaagagaaggccaacacactgattaatactcattgatgtgcactgaggtttgcaaccctgctcaagagcagataactgtgctcatttctaacctgtcctaaagtacctttcacaatggtaccaccaggaaacccaacaaccctctaagctgcccttaactcttcccccacccagccccactccaacaacggacactgccctgtatactcactgagggccacatagacgatgttgaaggcgaagacatagattgtgaggagggagagagaaaggatgaagaggtagaagtagcggtagttcctctttccaacacaattccccacccaggggcagtgatggtcgaagcgctctgtgggagaaagagagagtccaaagccaaaagcctccagaacaaaaatcaaccccaccatccctataatacctaattcaaagacctccaggatcattgtctatttcagttgtaaaaaatatagggtttttttttttttttactttttcaaaatgttttcataaccatctcatttgatcctcacaatttccctggaacttgggcaaaaggagatactcttttccccactttacagatgaagaaacaaaggcatggagaggttaagtgatttgcctcactcagctcattaaaagcagagacactgcttttccaaataaaatcttaatcggtgggcctactaagttcaagaagaataaacaggtcaaaatagccaaggaaaaatgtaaaactacaatatttaaaatggtatggcatagttcaatggaatggaaagagcccagaaacagatcttagaatatataagattttgttgtctaataaactcagcattacaaaatcagaggtaaaaggaagtattattccataaacaattacgtgacaattggctatttggtgcaaaataaggatcgatttttttgtcttcatactacttgtcatagtaaattccagatgaattaaagaactaaatgtaaaaacaaagtgaatccataaaataactataaagaataaatgtttatttgtcctctatatgcagaaggactttctaagcataaaagtactggaagaaaacagatgacaaggaaaaatagatttgactccataaactttaaaaaagtactttgtggttttgatttgcatttccttggtgatcaatgatgtgattattacacattgcatgcctgtatcaaaacttctcatgtacaccataaatatatatacctactatataccaacaaaaaattaaaaatttaaaaaatattttgtgtatgttaaaattaccataaagaagactaaagaaaaaaaaacaatggcaatctatgtaaagttgtacctgactatatgaaaagttcttagaaatcaataggaaaatacaaatacttcgtcaagaaaataatagtcaaaagttacttgaaatttgctaagagagtaatcttaagtgtcctcaccacacacacacatgcacacacaatggtaactatgtgtggtgatgaatatgttcatttgattgtggtaagcattacaggcagacaccaaaatccacccatactcaagtcattcagcagccctgcagaacccacggataagaaaagttgcccctcatgtacacaggttttgcatcttgtgaatactgtacatttgaaccttgaacaactcaggttagaactgcgtgcgtccacttgtacatggatttgtttcaataaatacagttggccctccgtatcaacaggttctgcatccacaactaaacctagatcaaaaatacggtattcacaaaatatgaaactcctggagacggatacagagggctgacttcatatccatgggttccacagggccactgcaggacttgagaatgcatggggtttggtattcaagggcaatccctgaaaccaatcccccaaggatacttagggacgactgtattttggatccgcatttggttgcagatgaggaacacactgatactgtatttattggaaaaaaaaaaccctcattattaagtgggcccatgcagtacaaaactgcattgttcaagagtcgactgcacataaaacaaaaacaaaaaacaaacaaaaaggaaatagggcaaaaactaataaataccataaaacctatatttaatatttttcctagtcaccaataattcattgtaatactagtaaaataatagcatattttatgcctatcaaaataagaatataaataataaaatccagtgctagtgagaatagggtaaaatggacactctaacatactgcttgtgggagcataaaatgaaagaaccttcccagaaagcaatttggcagtacgtatcaagagccttcataaagcttgtacccctttggtagaataagtccattttcagcaatttctcataagaaaatagaaatgtacacagaaattttaagttcaaatttttatttttatttatttatttatttttgagacacagtttcacacttgtcacccaggctggagtgcaatggtgcgatctcggctcactgcaacctccacctcccaggttcaagcctcatcagctgcccgagtagctgggattacaggcatccgccaccacgcccagctaatttttgtatttttagcagagacggggttttgccatgttagccaggctggtctcgaactcctgacctcaggtgaaatgcccgcctcagcctcccaaagtactgggattacaggcatgagccactgcgcccggccgaagttcaaacttttaaattaaattttgtattgtttggaaggcccaggcaggggaatcatgaggtcaggagtttgagaccagcctggccaacatggtgaaaccccatctctaccaaaaaatgcaaaaatccgtgggtcgtggtggtgcacacctgtaatcccagccaatcacgaggctgaggtggggggatcacttgagctcgggaggcggaggttgcagtgagctgagatcacgccactgcactccagcctgggtgacagagtgagaccctgtcttaaaaaaaaaatctattatggtaaaatatacataacatacaatttgccattttaaccattttaagtgtgcaattcagtggcattaattacattcataatgtggaaccatcaccattatctatttccaaaaccctttcattactccaaacagaaactctgcacccattaagcagtaactctccatttcccccttccccatcccctagcaatctctaatcttctgtctctatgaatttgcccattctagatatctcatataagcggaatcacacaatatttgtctttttgtgtctttttttttttcacatagcatgttttcaaggttcatccacattgtatcagtactgtattcctttttatgactggataatattccaccgtatgtacataccacattttgtttaaccattcatctgttgatagacacttgggttggttacaccttttggctactgtgaataatgatgctacgaacactggcgtacaagtaggttttgagtccttgttgtcaattcttttggctattgttatggaatgaactgtacccccactccccagttccatatgttgaagccctaacccccaatgtagctgcacttggaggcagaacctttaaggaggtagctaaagttaaatgaggtcatctggatggggccctaatccgatgggactggtgtccttgtaaggagaggatgagacaccagtagtgtgtgagcacagagaaaaggtcacgtgaggacacagcaagaaggcagccatctgcaagccagggggagaggcctcaccagaaaccatcccttctcgcacctctatcttggacttccagcctccagaattgtgagagaaaaattcccattgtttgagccagccagtctgaggtattttgttatggtaacccaagcagactaatataggtatacacccaggagtggaattgctgggtcatgtggtaattctatgtttaactttttgaggaaccaccaaacttttccacagcagctgcatgattttacattctcaccagaaatgtatgaaggttccaattgttccacatccttaagtttaataattatgattgcagtgttacaacaatgaataaaatagaagaatgaataatgtctaatgacagaagactgcctgaataaacttgaatagaaccatatgatggattatgcagtcattaaaataatatattaaagaaacatttattaaagatgtagaaaaacgctcaggatagaatgttaaatgacaaaagcaggattaaaaactatcatgttacagtccaattttgcagaaacactagtaggaaatatagcaaaatggagagtgaatttaggattaagttttatttatactttctgcacttcccatattttccacaatgaacatgtgttattttgatgaataaaagactacaaaagaataaaatacatcaatttgggccaggcgtggtggctcacaccagtaatcccagcactttgggaggccgaggcaggtggatcacaaggtcaggagatagagaccatcctggctaacacggtgaaatcccgtctctactaaaaatacaaaaaaattagccaggcgtggtggcgggagcctgtagtcccagctactcgggaggctgaggcagaagaatggcgtgaacccaggaggcggagcttgcagtgagctgagatcgcgccactgcactccagactgggagagagagacagcctccgtctcaaaaaaaaaaaaaaaaaaaaaaaaagaataaaatatatcaatttgaaagaaaagtgagctgtgtactggtgaaaaaataaggctgtaaaaatggtctatctcctgctgaggaagctacatcttttcaggaaagggaagaaaggtatagagaagaatggttatacagatatatattttttacagtattttaaatcacattttttctgataatacaagtaatacatgctcattgtagaaaacttgaaaaaaataaaaggaaaaatgaagaaatcacagtagtggaggatggcatatgaaaaaatgaaggaaacaaaatcactcataatcccacaacctatagataataaactataaaaattgtggcatatttcctgtatttccttgcatatttctttatacatcattagattttttaaaaataggtaactgacttcacactgtaaatgtagcctatctcccattttgtcatttagctttctggtatgaactctttccatcagtctaatgtacgaatgtcctattatttatttatttatttatttagagacagagtcttactctgtcgcccaggctggagtgcagtggcacaatctcggttcaatgcagcctccacctcatgggttttttattctcatgcctcagccagggtctcagctgggattacaggcacatgtcaccacgtccagctaatttttgtatgttttagtagagacgaggtttcaccatgttgctcaggccggtctcaaacttctggcctcaagtgatctgcccacctcggcctcccaaagtgctgggattacaggagtgagccaccacacccggctctataatttatttggctactcatctattggtagacaattaggttcttttcaacttttaattgtcataataatcctgagttaaacatttccaccccgaaatattttcccacatctctgatttcatgggacagactccctagaaagtgaaccactggcaccaaaaggtatagatgttttaaggctttcgattaatcttattagattgccttccaaaaagtttgttccaatttacactcttactagtggaagaataaacatcaggttttccttgctaattttctagatttaaaaaagcatattgggctgggggtattggctcacacctgtaatcacaacactttgggaagctgcagcaggtgggctgcttgagcccaggagtttgagaccagcctgggcaacatggggaaaacccatctctacaaaaaatacaaaaaaaaaaaaaaaaatagccaggcatggtagtgcatgcctgtagtctcagcaacttgggaggctgaggtgggaggatcacctgaacccaggaggttgagtctgcagtgagctgtgatcgtgccactgccctccagcctgggaaaaagagtgagatcctatctcaaaacaaaagcatcctgaaatcatttatttgactattagtcatgataactagccaattatattgttatgaactgtttatatttctcctggaatatcagtgctttttaaaaaaattgatttgtatgagttccttatagttaagagtattaataaggaaaggaaatactacctcacatcagacctttttattttacttaagttctggggtacatgtgcaggatgtgcaggtttgttacataggtaaatgtgtgccatggtggtttgctgcacctataaagccatcacctaggtattaagcccagcatgcattagctatttttcctaatgctctccctcccttccccacccctcaacaggccccggtgtgtgttgttcccctccctgtgtccatgtgttctcattgttctcgaaagaagacattcatgcagccaacaaatatatgaaaaaatgctcaacatcactgatcattagagaaatgcaaatcaaaaaccacactgagataccatctcatgccagtcagaatggcgattattaaaaagtcaaaaaacaacagatgctggcaaggttgcggggaaataggaacgctattgttgttgggaatgtaaattagttcaaccattgtggaagatgtggcaattcctcaaagatctagaaccagaaataccatttgacccagcaatcccattactgggtatagaccttcttcttttttttttttttgagatggagtcttgctctgtcacccaggctggagtgcagtggcgcgatcttggctcactacaacctccgcctcccgggttcacgccattctcctgccttagcctcccgagtagctgggactacaggcgcccaccaccacgtcccctaattttttgtatttttagtagagatggggtttcaccatgttagccagaatggtcttgatctcctgacctcgtgatcctcccgctttggcctcccaaagtgctgggattacaggtgtgagccaccgcgcctggccagaccttctttaaatatcaagtttcctgcttcacttaaaatgggtttcgacagccgggtgtggtggctcatgcctgtaatctcagcactttgggaggcctaggtgggtggatcacaaggtcaggagttccagaccagcctgaccaacatggtgaaactccatctctactaaaaatacaaaaattagccgggcgtggtggtgtgcacctgtaataccagctactcaggaggctgaggcaggagaatcgcttgaacccaggaggtggaggttgcagtgagccgagatcatgccactgcactccagcctgggtgacacagtgagactccatctcaaaaaataaataaataaaatgggctttgacaatagatgctgatgaggctgtggagaaataggaacacttttacactgttggtgggagtgtaaattagttcaaccattgtggaagacagtgtggcgattcctcaaggatccagtaccagaaataccatttgacccagcaatcccattactgggtatatacccaaagcattataaatcattctaccataaagacacatgcacacatatgtttattgcagcactatttacaataccaaagacttggaaccaacccaaatgctcaccaatgatagaccggataaagaaaatgtggcacatatacaccatggaatactatgcacccataaaaaaggatgagttcatgtcctttgtagggacatggatgaagctggaagccatcattctcagcaaactaacacaggaacagaaaaccaaacaccgcatgttctcactcataagtgggagttgaacaatgagaacacatggacacagggaggggaacaacacatactggggtctgtcggggggtggggtgaggagggagggcattaggacaaatacctaatgcatgcagggcttaaaacgtagatgacaggttgataggtgcagcaaaccaccatggcacatgtatacctatgtaacaaacctgcacattctgcacacgtatcccagaacttaaagtaaaataaaaaataataataataataaaatgggttttgatttataaaaatcttatatacatatagtagctttttagtatacacgctgccgaagagagcaccatatagcttttaccatataaagcaatatatatctcccaacctttgcctaaagaaatggctagtaagaggaaagcaatgccctcaggatgccacatggtatacagaaaaaacattatccaatcatgggaactcaagaaaaagtaattttaaaaagaacattagaagtatgcctagtgatgatataagcaatttcacatataggcctatcaacaggaatctttatggcccatttctcatcttggccagggtttagcacacagtaggcagtgattacaacaaagccacatatatgtggatggaagtacagaccactgtattagacacacatatacctgaccctcttgcagcagcagcaaagagaagaaataagcagtttggaatcagacctgctctagcttaatctcatactaattatgtgaacttacatactggtgcttcacctatttcctcatccgtaaaatggggataataccaatctcatggggctgttacaagtcttaaatgagagaaaggtaaatcacttagcacagtgcccaatatgtagtagaaactcaataaatgctagcaactttcctcttcttgggttgcgtcttagacagaccttccttcctcaatgctgccctccagtggactaggtgtctcctcccactatgtaaggtgggtcccacatgaaaatccagtacaggaaaatctaaatttcaaaaataggtaaagtttatttttctcatttactaaagaggtttttgtaaagtttaggctagaggatatttaaattttgatttgatctacacaagtacagctgatttgcagtttttcaggagcttgttgcctatctaaatttccctatctaaatctagttcatttctcatctaaatctatcttccctcctcccaaaattggtgaccaccctgactttctagttcaactcagccttttccctaggcaatgtccctgtagttttactcacccacacagttgtcacagatgctgcaatgggaggcccggggaggccggaagatcttgcatgtgtaacagtatttcagtttcacaatctggttgtttatctggaaattcttgatacgaggcggtggtcgctggccctggggcaccgcaccattggtagcttctgtaaatcaataaagacagttaatatcacagctagccatcacttgagcccaaaagtctcaccacctctccaaaaccaatgggggcattcaaaggttccccaagccccctgtcttttatagactagacactcaacatcacagaatatgcccataaaactccactaagtgcatgcagttctgttgtatacataagaaaaagtgtttcttcgaggcttttttttctgattacaaagaaaaacattcatttaaaaaaatagctaaaaatacattaaatgaaaacatccaatttcactaataatcagagaaataaaaattaaagcacaaagataccatttttacctatcatattaaaaaacattacaaacaataaaaataccccatgttagcaagggtggggaaaggtcattcttagatcttatcagtgagcaatatggcagctgctactaaactttttttttcttttaagatgaagtctcgctctgtcgcccaggctggagtgcagtggtgggatctcagtcttggctcactgcaatttctgcctcctgggttcaagtgattctcctgtctcagcctcctgagtagctgggattacaggggcccaccaccatgcctggctgatttttgtatttttaatagagatggggttttatcatgtttgtcaggctggtctcagactccagacctcaagtgatccgcccgcctcagcctcccaaagtgctgggattacaggtgtgagccaccgtgcccagccagctaccaaagttttaaacgtgtatattcatttactgatcaagtctacttctagaaacttatcaaaattataatgagatatacgaaagatgtttatataaggatatttgtcacagagttccttttaatagtgaaaaactaaaaataacttcaatgtcacaatagaagggtggttaagtaaattatgttatgtgcatagaatggaatattatgcagccgttaaaaatgacatagacgaaagaatggtgaaaacaggaaaatacaatatatggcaaaatgaaaatgtatgttaaaaagcaatacgcataaaacaatactatcttgcaaacaaaatatatgcatgtgaaaagaaaagactggtaacacagaaacagttactgaaataaaagtaatgcttgcttattgtaaaaattttggaaaaaaacagaatagggccaggcatggtggctcacgcctgtaatcccagcactttgggaggctgaggcaggcggggcacctgagatcaggagtttgagaccagtctggccaacatggcaaaaccccgtgtctactaaaaatacaaaaattagccaagcatggtggcacgcatctgtaatcccagctactctggaggctgaggcaggagaatcgcttgaacctgggaggcagcctgggtgacagagcgagcaagactccaactcaaaaaaaaaattttttttggaaaaaaacaaagtataaataagaaaacataaaaatcactgacagtcagtctctcagctcagagatatttatattttttggcgtatttccttctaatcttctattaacaggtaaacattcataatttttaaaaaattgagatcatattataaatgcagatttgtaccatgaagtatttacttaatattatatgctgtgaacattttctcattgttaattttttttctaaaacataactactggcaatattccatcatatacgtgtactatgatttatttaaatattccatattgttgggattttttactatttaggtgatgtttcatgtaaaaatttaaaacattacagagaaaagcttaaatctccttcgatcaccacctcaatcctagtcccctcctcccttccaagaacatactcatgtgttaaaattaatttctaaaacagaaagaataaagaaaagaatggtgaagtataagcagtaatacatgaagttgccggcattaaaatagctactcatatttaaaagaaaagaaaaaatgatgcaccaaaaatccttctacagtaatttgtaaaaatctgtttatctcctttagctaaaccctcagagaagtagaactactgggtcaaagggtatgaccctttaaagtccatattacttgttgccaaactgcttcccagacagaccgtatgaatttgcatgcctgcccatccgcagcatatgagagtgcctgtctcattgcactctcaccatgcagtataattctaaaaacagaatatttttcaattcactttgattttaaaaatatctgccatatggaacatttttcctttttttgtggagtggggtagatgctgtgaaatcaaacaataacaatgtgtcacaagtcttaaaaggatgaggacagctattcattagaggataagtaccagcatgccaccttaatattctatgcatatgctttccatgagggcacctgggagacagggttcatggttcacctttctcaggaggccgtatcaggcaagggcatcacatgacttcctctctccccatcccccacccacagcatacccagtacaggactgaatataagatgacaaaaacttgctaacataaacatacatatgaactgaaaaatgtactcttctagtgagagaaacatgctaaatgcagaggccacaatgtgactgcttgagtctgagccccaggcccagtgatcaggcagaaaagagctaactttgttaacaacctgctgtgagaggcaggagacaagtcaaggtactgccttgaccctcagtttctccatatgtgaatgggaagggaactggaaaagaataatccagatggagaaaaaacagcactcacaactcttcctcaccatcttgctcctaactactcctagttctatcgggtctccccagaactccagctgtgccagcacacgtcgcctctgctctcttcccactatccccaccctcaccccacccccaaatagttatagctcacatgtgcacaaacccatttctccttagctcaactaaaacaggctggaatttttcaaaatgaaatccattaagaagcctaagggaaaacacagctaaaataaacaaaagaaatacatgggccgggcgcagtggcttacgcctgtaatcccagaactttggaaggccaaggtgagaggataacttgaggtcgggagttcaagactagcctggccaatatggtgaaacaccgtctctactaaaaatacaaaaattagctgggagtggtggcgggtgcccataatcccagctactctggaggctgaggcacgagaatcacttgaacctgggaggtgggggttgcagtgagctgagatcacgccactgcactccagcgtgggggacagagtgaaactgtgaaaaataaaaaagaagaaaggaaggaaaaataaaaaagaagaaaggaaggaaaggaaggaaaaaggaaggaaggaaggaagggagggagggagggagggaaggagggagggagggagggaaagaaaaagaaaaaagaaatacatggaagccttcaaagcaccgtcaaagaactaaaggctagccacagattggtgctctactggcacagcttcttagtcttacaagtcctgggtccctttttcttactctgtctagcttggatgctgactcaagctacctgggtaccaaacctgagaaccatttaggtaggcactgctgttgatctggtgggctcccactccctcctagtacttgcatcatagtcttctttctcactgtgagatcccaggatatctcctcctctggccctgggatggttctgcttcaaatcatgaagccaccctggctcctagataatgtagcacttcatctctgtaccaaagatccttatcctgagctgcagtatgcactctactgagcctgcaattgcttcttttacccctcctagaattctcagtggttcctggcaccacagctgccccctttcacattgcatgttcccctaaagcagcgttttttgtttgtttgttttggtttggttttttgagatggactctcgctctgttgcccaggctggagtgcagtggcgcaatctaggctcactgcaacctccgcctcccaggttcaagcgattctcgtgcctcagcctcccgagtagctgggattacaggcacatgccaccatgcccggctaatttttgtattttaagtagagacagggcttcaccatgttggccaggctagtcttgaactcctgacctcaagtgatctgcccgcctcagcctccccaagtgctgggattacaggcgtgagccacagcgcccggcctaaagcaggaattcttggttgggggggacatgaatgaacttcagaagatctatgaatccctgaaattacatacaaaattgtgtacatgtacatgcatataagagcatttttatggggagaaggtttacagctttcatcaaaaaaccaaaaagtggctcttgagccacttgctcaagccccctcccactctgtggagtgtacttttgtttcaataaatttgtgctggccaggtgtggtggctcacgcctgtaatcccagcaatttgggagatcaaggcgggcggatcacaaggtcaggagatcgagaccatcctggccaacacagtgaaatccccgtctctactaaaaatacaaaaattagctgggtgtggtggcatgtgactgtaatcccagctactcgggaggctgaggcaggagaatcacttaaacctgggagtcagaggttgcagtgagccaagatcacgccactgcacttcagcctggtaacagagccaggctctgtctctaaataaataaataaataaataataaatctgtgctttcattgcttcagaaaaaaatgtgttggtgaccacctcccccaaaaaagtaaaaaaccatcctcctgggaacaatacagcaggaccttggtaacaaatccttcctgaaatgtgaccaaatgcagtgaaggacaaagtctatgactttagactgttgctagacctgcattactaaattcacggggtagtcatgatctcagattcaggatctcagagagaaaaggctagaagtgattattaatctgcaactactattatgattccattctcttactgattagggccacccactacacagcagcttgccagctggttggaagactcacctatctccatttctatgaaagctgcttcatctggtagcgcccgaggaatcactccagggtcactgaagctggtcctcaacagtgtagccatggagaaaaggaagagcatggcagcaaatacagggatggcaggagacagctgaacagccaggtagcggcacctgaagaaagcaggcaattcagcatttaatgatacctaccctatattgatctccaattgttaccagtatgtcaatctggcccccacaacagaatcagcagcacctcaagggcagggaccatgtttcttctcttgaattaccccaaacccctaacatatggctttacccatagtaggagctcaacaaataattgactgctgccacctataacatacagaagacacgcttgaggacactctcttacccccaagtccaatctatcctatcaacccactgggagctacatttcctctacctcaggaaaggttcacacctgctaagaatagggaagcaactgaacctggatttctaagcaacacaggttgatctcactctgggaatgtccagggcttctcataaccactgatctggcattcaagctgagcttgatgaagagggagaaaagatgaggaccaaccagaaagcaggttcacagtgtcagacagagagtatctcagcatgcttcaagaccagtgaaaaccttcagggctgttgactgactctgcaacatccattcctctggtctcctcaattagctcagctaataagtgactaatgaccatcagcaagaaaataagaaaatcgtttatccttagtaccccttcccaacatcatgttcactcccctctttcctcataatgcatctggcaagctatttctcttcctctctgaatatcccaactctactcatctttcaggtgccagagacatcaatatcattgtcatcattgcaactataatttattgagggctctccataagacaggcactgcactaagctcttcatctacattatcccatccaattctcacactaaatctatgaaatagatcctactatacccatttgatagatgaagaatctgagacttagagaattcttacctcctccaaaaggcttatgctaagctgcactaatctctctcttctctactccctgtggtcctcacttccagagccttgcattatttcctagctatttctcagtatgttgatggcatctccctcaactggacttcctaagagcaaggacctagtcttattggactgggaatgctccggtttgaattctggctctaccagctcctagttgggtgacttagttaacttcagtctccttatcgataaaatgaggataataacagtgcttgatgaggtcattgtgtggatcaaacgcactagtataaataaagtgcttagaactgcacttgacacacagtaaatactaaacactaagtaaaatgttagctattaacattaacaccatgattctgtatctcccagagctttaatacaagtaagggaacaaagaagctatcaataaatacttgttgatctgaactgaatttcaaacaaaataaataggaatatgtaaggagagttatcgctgacctatttttatcctcctcctcctgaggcacatttctccttgaaaacagagttttcacttggaggcagactataagtggatgagcaaggagcagagagagagcagagaaagtaagctaagaaaaacgcttacctcatcagcatgggaagtaagcaagctactggccattcaaagcaaacgtttaactcctggttatatattctctgcagtttcggaacaacccccatgaggtcttcccctagctccctgccacacacacaacttcatggggggacacaagccaagttttatattagactaagcagtttttgatgaaggtgcacatatgtactgaacctgaaggatgattttcgtgacttttgtgtttgcttgcttgcttatttttaacaaaatccttcatcttaagttgcttttttaatgatttacttccttctcctaaaagccaagggttgggggaaaactggagaactgaaggatctggcagctgagttcagggtaattaaggttcttacatatcactagcttgtggattaccctattttccactactccttttcactggtacagattaaccaaaaagggaattcagaagcaaaaatcacctccacttatcaggaacccaaaggatgcaggaaaagcatgaggcttcatttcatgaacaagccaagtgaaattaccacactaacagcaaataggaatcttcctggccactgcccatcactaagatcattcttgaaaacaaagaagtaatgtctccaggacgcaaactgccctggatgtatagtctccaatcaaaagccttaaaaatcagatgtatctgattggccaccaaagagagcttaatttttttattaaagggaaaacatacagagtgagtagagcaacagcaaaaaattctaaattaatgctgccccgctgcacagaaggacccgagcttaactaagtccagttccaacacctgcttgtaggccagacaaaggacaacttagatttgaattacgctatgccatcaaggataaaggtctctgtaatctccacacagagcatcttctgcacctgctaaaacaatccactctgtatgtcaacaagtacacaacaggcctattgtattgttctcctccagagatgaggctattggcagccagtcgtctctagtgagtgggtgtggctgggaagccagatgtgggactagcaggcctttctactctgagtaaggggaaacttcgagcgccagccactaagactattgtgaactacaacccatagtgtttgtcttcaaaagttatgataaaaaatacccccaccgggggtattgggaagggaggattgggaagatgtttgtcaaaggacataaaatttcagtaaggaagaataagttcatgagatctattgcccaacatgcggactatggttaataacactatattgtataccagaaaattgctaggagagtagattttaagcgttctcaccattaaaaaaataagtatgtaaggtaatacatatgttaattagcttgatttaactattccaaatgtatagatgtatcaaaacatcatattgtatacatatatatctttgtatatatatctttatatatatatataaaatatttgtcaatttaaaaaatacttcaaaaatatcaccctagactaatcccataattgctataagctggaagtctgtctctgacaagaataagctacgtgaaagtttggtggtaattcccaatatagacctccaaagtcaggagtatcctcaaacatcactaatttgtcttagataaagattagatcagccaggcacagtcgctcacacctgtaatcccagcactttgggaggtcaaggcaggtggatcatctgaggtcaggagttcaagaccatcctggccaacatggcaaaaccccatctctactaaaaacacaaaaataaggccgggtgcagtggctcacgcctgtaatcccagcactttgggaggctgaggtgggtggatcacaaggtcaggagatcaagaccaccctggctaacacagtgaaaccccgtctctactaaaaatacaaaaaattagccaggcgtggtggtgggtgcctgtagtcccagctacttgggaggctgaggcaggagaatggtgtgaacccgggaggtggagcttgcagtgagcggagatcgtgccactgcactccagcctgggtgacagtgcaagactccgtctcaaaaataaataaataaataaataaataaatacataagccggacgtggtggcatgcacctgtaatcccagcttactcgggaagctgagacaggagaatcacttgaacccatgaggcggaggttgcagtgagctgagattgcaccactgcactccagcctggtgacagagcaagactccacctcaaaaaaaaaaaaaaaaaaaagactaggtcagatctgtcatccacgaatataagctaattgtttctgaaactccctatatcactccatggaataataatatccatatacttcttaaaacagaactctcctgtattcaaagtaccaagaggcctttctccttcctggggattagagttccttttctcccttgtgaattttataaatgcaaccatgtcccaactaagtcttcatttctgccacctgaagagacatcatcattttaaaccatcctctactgacttcttgactgtcctcaggctaccatagctggactagacaactggactcccacatgtcccctcaggcggcacggtggtactgaccagcagtaaccatcagtgccaggctgggctcatgtgtcgtgtcccatcccccatccctagcatgctagttcactggagggatgatgataatgacacagacttcaattcacatgaaaacactcagaagagattcatgagtagaatgggtaagaatctagacagagagctatgccttacggattggcagcttggattggtgttctgtacaatacactgcttctaagtctccctaacagctttcttgctatgttttttggtttgtttgttcttttatcaatgtaatcagtcagccaacaagtacttgttggactaacaaatgaagaacaagggaaataggagttaattttgttggggaaaacataactgaaatatgaaacagctaaagaataagatgaccgataatcaagtgttagaatggtgactcagcctctaagggctgtaagtggtcagggaagagctctgtaggggagctgctggctgcttgaaactgctccagtagcagctggtaagtatggctttaaggaagaaggcccaaggatcagagccccatgatactctttggtcacacatgggagaaataagcctttgctataatacctccctgatatggatggccatctgtcctcttactacctacctgctacttactgaatgtctgtatccctgcaaaattcatatgttgaaatcttaacatccaatgtgatggattttggaggtggggcctttggggggtgattaggtcacctaaggctccaccctcatgaatgggattagcatccttataaaagaaatcctggcaagctcccttgcccctttggcaagggagagaagacagccatctatgaaccagaaagcaggccttcatcagtcaccaaacctgcaggcatcttgatcttgtacttgccagcctccagaactatgagacacaaatttctgttgtttataagccacccagtcgatggtagtttcttacagcagccagaacagactaagacactacctctagaagacaataaacatgtagaaccacccattaagactgtttcaagattcttctgatgaccctcagagtctgctgagaggggaagtttcccttaacactaaaaacataatttacaatcagcctccagatttacttctatgtgaaggtcagagaaaaatgcacaaccctcttttgctccagtagcaataaagaaaattaaccaaacagggacactttcaattctgaagtgagaagccatcctctcatcaaaatctctatccaggtaaacccgctcagtagtttccaaatttcagttataataacaaagttcaaatttcagttacaatatacccctgctcgagaacttagaaccattcactgctgcctattatattatgccccaaactccacaggtcagtattccaaggctctccattaactggccttatctaatcatcatcataggggccctgtcttccccactccattccagaaacatcccactaattaattaccctgaattagctagcttcttgctactgcaaatagcctaaggtacctcctttgttcttaagcacaataccagcaccagcatctctgaggagaaagatttaggagtctcttctttccctcaataacatctcaactgatgtcagcatgttggggaacatccctgttctctgggcttgcttttcccaaaacagaggatcactatatttaattaagactcatcctcaaaagatgggagaggcattcagtggagactgaaaatgtgaaactcattaccacaaaaggaaatagaggctgaaaatgtagagaaattctgaatgacagaaccataaagaattattaaaggagccaggcatggtggcttacacctgtaatcccagcactttgggaggccaaggctgttggatcacttgagctcaggagttcaagaccagcctgggcaagatggtgagatcctgtctctacaaaaaatacaaaacttagtcaggcatagtggctcactcctgtagtcccagatacttgggaggctgaggtgggaggactgtttaagcccaggaggcagaggatgcagtgagccaagatcacaccactgcactccagcctaggcaagagagggagaccctatctcaaaaaaaaaaaaaaaaagaggaaaaaaaagaattattaaaagaaagcaaactgccgccaggtgcagtagctcacgcctgtaatcccagcactttgggaggcagaggcgggcggatcacctgaagtcaggagttcgagaccagcctggccaacacggagaaactctgtctctactaaaaaatacaaaattagcaaggcgtggtggcgcatgcctgtaatcccagctactcaggaggctgaggcaggagaatcgcttgaacccgggaggcggaggttgcagtgagccgagattgtgccattgcactccagcctgggcaacaagaatgaaactccgtctcaaagaaaaaaaaagaaaaagaaaagaaaaagaaagcaaactgttcaggagatacaacccaaggaactcttgggaagaactctctctcaaggaacatacttcatcaggaagttaagtttagctaagtactgtaacagattgataccaaagaggcaactatgcctttctaaaactcatttggttagtcaagtcacagacagaatccgaagctagataaagccaagactgacctccatagagtcattccccagagaatgcactcttggttacagagcacaatatagtcactttttcctcttcccaatctcacataaggatgctcttcaggaacctggaccttgtcactgtgggcactaacattctggtatgtcaaagtttggctttggtctacatagtcttgtgtctcctcaaacctagtaagttcatattatcaggtctgctttttctatttcacctgtctgccagacacacctcctctttcttttttctattttatttatttatttatttatttagatggagttttgttcttgttttgttgcccaggctggagtgcaatggcacaatctcggctcactgcaacctccgcctcccaagttcaagtgattctcctgcctcagcctcccaagtagctgggaatacaggtgtgcaccaccaagcccagctgactttttgtacttttagtagagacagggtttcaccatgttggcccggctggtctcgaactcctgacctcaagtgatccacctgcctcagcatcccaaagtgctgggattacaggcatgagccactgcgcccagcccacactgcccctttcatcaggataagtcactaagtaacaatgtacagagcacacattgcttgatttttctccaagccatcctcatcttggcagcagggaccaggagtggccacagcagtgatgatcccttgttaactcacaaagctcctgataggcttccctgttcctgcaaggctaccagaaatgccatgctgcaataccatcagttctctgcaaagatgccttcattttctaggagcataagcttgggagacccaaagagcctagatgccactgggtaacacacacactagctcgcaagaatctggaatatgctggcctagtatttggtactatgtacactttactaaagcatgtgtgtttgaatatcttcaggattccatagccaaagggtaacaatgaacaatgagataaaatgtcgaaattagaagaaaaagccctgagtcagtatagagacgttggctggtcaactcatcttgataaaggaaactcacttctgtgggcctggtttcctcaccccacacaaggagggagatagtctccaaagccctttccagatctaccatcctatgattctgtgggtcaagattgttaaattttaagtacatctagaatgttttaattcagcaacacttattggccatctactctatgtaaggcatggtagagagcactgtgggggctacacagccattgaacatagtctctgaccttgaaagagactagctgcgggggacaacaacagtgagaagtgtaatcaccatatagctccaaactataagaaatgtcatgtgattatctgttgaatgagcggtgtgtacaattagcccaatgaatgcagaaattactggaaagttttcatgaagaaagactcaagaaagaatttgaaagaggggtagaatttggataggctagaaaagtattgtttgtattgattactattgattactaagcagtgttacaaagctgttttcagttcatccaattcaatgactcttctgccaatatatacatcaaaagctctaatggggaccaacctgacagaacctggtctgacagtgccttgataagatttccttcatatacagaggacacagtgagaccataagcactgattatagcagcaaactgcttctgcttcaggggtcaagagtctcatagtcattcttgccacaagagaagtctgaggaccttgatcccactagtggccaggtcagaaagctaaaagagaaagctggaagccaattccaggagacagtgcacttgttcctttctccaggatcacactttatcaggaagttgaatttgactgaataccacgatagcctttcagtagctggatgtctcctaggttgtcagtggcattctgctacagtgtcctaacacttcaggccaagctggtagctatgtgttcatcgcacaagctggatagagcttaagcagaaagaactgaaaattgttcatgtgctcaaagctgaaactagcaatacacactcacatttcttaaatacctcaccctaagaattaattagaaaatcctttttctttaagcattataccatttttcactctgcttttaaacttaaatacgtttaccatgaatacaattatatttaaatatagcaacctactggtaatctataatctccttttgtgtgtatttgagtcttccagacagacacagagttatacagaatttcaggttcttggagttgcaagaggcttagtgaatatttggccaaatttctactcggtgacagcggcccgagagagaccccccggcttcttcagaaacacctctaacaggccgggcgcagtggctcatgcctgtaatcccagcacttggggaggctgaggcaggtggataacttgaggtcaggagttcgagacaagcctggccaacatggtgaaaccctgtctctactgaaaatacaaaaattatttgtatttggcaggtgtctgtaatcccagctactcgggaggctgaggcaggagaagtgcttgaacccgggaggcagaggttgcaaaagcagagatcatgccactgcactccagcctgggtgatggggcaaggccctgtctcaaaaaataaataaaaaataaaaaataattaaaaaaaaaaagaaacactctaacaatacagagctaactggccccaggatggacaactttttttgttttatgtattcaatctactatgtgtccactgaaaattacaggtcactcatttgaaaagtcttctagaagatatgtaaaggcataatccaaaaataaaaggacatctgccagcactgctaacattatgcgtttttcattaaggggcacccacatgcctgaccagacttctcaagccatctggctggcccagagctgtgctgcaggcagctataaatcaactcacacttgttcctaagcacctgctgcaagcaggaccctgctactaaaatgcagctccagatgtgcctcaagatttggactatcttcccacaaggtaaaaatacagcagccagaggatgtggagtctctactcctagacaatgtaagaatgaaaatagatcaccatttgtctattcagacaccctcacctgcctgaaggcagggggctagatcaactgatttcctgaggcctcactaagttcttttttttttttttttttaagacagagtctcactctgtcatccaggctaagatctcagctcactgcaacctccgcctcccaggtgcaagggattctcctgcctcagccttccgagtagctgggactacaggcgcacaacagccacacggggctaatttttgtatttttagtagagacgggggttttaccatgttggccaggctggtctcgaactcctgacctcaagtgatctgcctgcctcggcctccccaagtgctgggattacaggcatgagccactgcgctaagtcctaatactaacaaagcagcccacattctgctccccaaaccctgcccccactatgtggtggacaggaaattatagatgccaaagaaaaaggccgaccagaaggagatttcattcctcagaggcatgctggtgtaccttgtacaacctgtcactggctaggcacaaggcagccaccacctaaagtgtctatgtgtctgtatatgacagacacacacacacatacacaagcacgcacatccacacatgtacaaagtattcatcaccagggtcctctcctctgtggtcacatttccacctcccccctccactcctctgctaacacatttacttccttctcccctcttcttcccactactccctcctccagccctatcttcaaaaatatttagtctttcacacagacagctggtactcaagtaagttttacaaataacctcacccttcaaaatgcaagaaataacctggggcggggggaagtcatcatggtagaaaactcaacctgcctctgtcaaatggtaacttggctaattagaagcttcatcccaccagcggttttcttcagaggcctgcaggggcctcagtggaacagattccagtcagattcttctgctggctcccagatacaaaaggggacaaatggcaatacctccaaatttcaagtacccctggccagtcaaaccagaggtttcctgggcccagaactaccaactaactcaaagcctgggaacaaggctcatctctgtttggaatagttgtaataaaaatttaacctggaggtgggggtggggacaaaaagagaaaaagagaggaagaatgataaagaacagatgtcagctttgcacttccaagaagaagcaggacaggaatgaggcaaggaatacttggagagaagggtgaggagaaggaaaaacaatttttaatgctaggggcttatgcctgcctgactacacatgctcactggtaccacacacaagcacgtgcgtgcacatatgcacacacacacactcattcaggaaactcaaactggaaagcaaataagaagccttcagcaacctgcctgacttcactaaacacttcacaaagtcagcagtagcggcggcagcagcaaaaggacctttaacaaagagttcctctgaccttactttcccagccccgttataaactggatctccctccccctgctgttactcaagccagctgcaaccacccaaaagtctggcaaagcagcccaaaaatcactctgggtgcactgggaaagcctgaagccctcacagaaggacaaaaatgagccccaagggaccagagctcattttacttccccactaggctggccaaggtgccccctcctacctcccatggacacaccccagcataagccctccatttccaggtcacccatgtacatacaccatagcacgctcacctcaggtgtggcttacagtccacacacacacctcttggctctcaaaggcctcctcacagtaatcccaaaacaattagcaatgctcccatccctagagtgtagagcattctcagcacacccaggagacacgccacagtgccctagaatccagccggccacctcccctagagacgagacctacacagacttcaaacagtggctcgagtacgaggtattacaccacagaaaaaaaatcactccaaggctggtaccagacatacacagaatatagagctgtttacgttgagtgattttgagggaaagagcaactcacttctaataagcacgtatgtgccacgcacacaactagtatgtggtccagctgaggctggaactaatctgtaggttcccaactcagttggcttttcactgtaccagctagctgagagctgagccttaaggaaacaggacccagaataacaaaataggtgaggattgctgagtaatgtaacaatgaggggtgccctcaggtttgtgtgcaggggaggccatctgtcatttagcttctaaggagaccactaaaagggagaggtgagtaattaagacaaactttcttatttcccaagtctatcaaggacagccccaaatcagtactacaaaattggtatcaaaggtattggtctttttaggaagtacatactctgtgatgaccacgaagcaatgaattcagctggcatctctacagacatcgctcaagaggacgttaaagtcatccaaggaccagccccaaactccccagaaagcaggttcttcccctggacccaaagtaaccataatcaggtaactctactcaaccgaaactcactcaaaggcgaagaagagtgtacatgtccccaggatgaggaaaagggtcaggtagaaaatgcccttttgccgggccatcatgacgcggccatcacagcaaaaggtgttcctgcctgggagtttctcccatttccgtgtcaccttctttctcaccaccatcacagacatgattggaattcctgctccaaaatgggttttgcgattacacgagagaagaaacagaggctgagcccagctttgaaatcacgttgcctgctattcctgccgctgggtcaaacatcatcaaaagtccaattgctagccctaagaaaaagcagaaaaagaaaaaaaaatgaggcaataataagaaaatacagttcaaccctcctttcccagagacagaaagttgaaaactgactgaaggggtggggacggggaagtgggaaaagtttatttccaattcgtgtttgttctctaaaagaaggtatgataaaaggttctcaaaaaaggaaaggggctagtatttcttcttaaataagcctctatgcttccaatctaatgctgatgatctgatcatcacagaaccttggaactagagaggattttataggtgatcgtgccaattattaatactttgttttgtaaatgagtaaactgaggaccagagagaggaaataacttatccaggaccacacagcagcaatgctgatactgctaacttccagtcaagggcatgttccactatgccacagtgttctttcaacatcattaaaaggactctaaaaataatagtagagtttctgtccttataaaacctccctcccttcctccacttcaccttctttcttcaattagccactcgaatatgaatcacagcagggaacaagtcaccctctggcagggccaggaggttctggacgctctgtgcacatacgtgcattgtatttacacaaaacagatttcccctcatcaaaccctctgcaacttcctgagtccgggaaatgaaacaatctggctggtctagcctaacatttgtgagaatcttaatgaaaccacatcagagacctgtaggtgaaaggctgacttaagcaggagagattctggaatggttggtgactgctgatggctggttggggggtggggaatggcagcagctaagaaaagtcacaagggcgctttctgggacatgtcctaagtaccatctctactcagcatcctgaattcccaggcccagagtttctcagcctctgctacccttctcctccgctcaggtgtggtgttgtggcctctatttaccgacaccacatgccccacgctggcaggactgaggcggaagcctgcagcccgacggacggagggagaaacagccaactcgcgggctggagagggcaaaggtccaaaaacagcctaggagcggagcagggaaacgagaaggtagaaggttcggggaaggggaggggggcccagaggtgcagagaacccgtcctttgtgtaaaactaacctggaagacaatctcctcccgataaaccggcccagcgggagaagggagaccaggaagggggagccggcctggaagaacaaagatcaaaatccgtcgggaagcagcgaccggctccccagcggggggccggaggccggaggccggagtccggggccgagccgcgggcgcggcctctcgaggcccgccctgactccgccacgccgcggaccaccgccccaggcaggttgggacgcgcgccacatccacacgcacacgcagccacacgctcgtacacactcacacacgccccgccacgtgtagtcaccccgggccaggggctcggcggct

SEQ ID NO: 1459 - DNA, 40647 bp, Homo sapiens
cacaaagaaacagacagccctgtatttctaaaaccattcaaggctccttcattaattggcttccccccaaaagaaagatttctttattaagaaataccagagagtgaaaaacccccaacacatacacatttgtaggctcacacaaaagtgcagagatttacatattaaattgcatttaaattagaaaatagatttaaaaacaaaatactttttttctccaacaaagtaaagagatttggtcagtaggaacgggtgctttatgggtaaaggcaggatggtcaggacagggagaatggaatttagctgctacggaatcagaatccacctctaacccaacctcactcctggggtaaaagcaaaggaggagatgatgatctcagctagggccaggaaggcctcagagctgaatggacatgaagaaatggctcaccacagccaatttccacctgcccccagaggtttgggatcagtgccaaccatcctggcctgggaaagtagggtgcataggaagcttgaggaagaaggaggaaggggagagttggagacagtgtcagccattgaaaagaccaaacaatttaaggcccttttcccctgggaacattgattctttaatctcccctctgatcagatagggacagtcccagctggtgcatggtatgaatgggacagatcttcaggccaacatcttaaacatggaagatttattaaggaaaagaaagagggcagggagtatgaaaaagcagaaaatcatttcacactagagataagagatttccactttgacccttcccatcagaaagagaaagcttctctgtctgacctaagggtcctcaggagaacacttgaggtaaggtgagggaggagagagagccatctgagcccaggagaggagatgggctgagtacttattaaaatggggttcatatgagtgccaagttacctggggaaacctaacaacttacaaattctccaggtttggctttataacttcaagaaaaaaaactgagagaaccagaaaaagaagcagacaggagagggatctgagtcagtctctccccatctctcttccaatctctctctctctctctctctcaagaatgctcaacttaaatcctgttaaaaggaaaaaggaagacatggaaaaaggtctgggagcagccaaatttcattaattccaattaactgggaagtatgagatgggaattgatagggagtcttgattatacaccacctagaaagaaatatataccatcacttgtaaaagaccactgatcaaatatttccaagggggggccctgatgagcctgcgttaataactaagacttattagcaattaacggcatccatctgcttcaaaacaatatcctaatatagagcttgttctcttaagtaaatataatccctctaccttcctgatcctgttcacactatatctccttgaaagtcctttcttcatagtccagaataagaaaaccttcagcccagaatgtagtatagatcaatggagagtttggaactacctctccaacccaagggtgccctggttaatggaagtttggggagtaacaagcaaccccttccaacccccacccccaccctacacacaaacatattcttgaaatggaagggggaaggaggaggcaggaagtttgcattagacacagtttaatcgccttcaaatagatgaaaagttctggtttacactcccccaccgcataagtcatccagacaggaccctggcttagaaagaggaaaacacaggtgctctaggaaatatagccacatataatacataaatcttcttccctgaaatagagcaggtcctgagcagagctgactgggggccacagcccacccccagggtgaagtggctctgggactctgccggtggaagtgctggaagagcggggcttggaggaagcccccagtgtggttaccatagccagaggtgggccgaggccttagggtgagttacccgagagggcagcagtgctgggctttccctcactcagccgaggcttaatggaagaactggttagcatttttttttttttgagggtacatcgggggagaggagaggagaggagagcctctctgtgccttggtttcccatttgtgcattcagggcctctgcaggcctcacacagggagtctgaggggatagtgtttaagtgagcactcaggcttcctctgaggaaaagaaatgaccaaagtgcagacttttattactgccattcctgctcctaatgggagcaggagtcaaaaggaaaaacaaattaaaaggggctaatgagaaaggaggagagatgagacagagagtgtgaagggctatgccgctggcatctcataaattcttattgagaatggcacaggtattaaaaaagtttctgggtagtctacgagaaatgtcaattattatctctactacaactacttacatatatctaatgggaaaagagtggggcttaggtgtcagagtggatgggagacaaaggagaagctacactaataaatacaacaagtggaaggtacctgtcccattcctaaaaggatttgtgggcaatgctggcacttggtggccaggagaatcttctgaccccactctccctcctcttcagtcctgaagaccccaagaacccagttaggatcccctggccagaggtctctgtgactgcctctggactcagcacgtgcagcagcttgggaggatttgagccagtctcaaaaacttttagccccagaatgagaccagtgaccccaagcaggagggctgggatctggagggaagagagggggtccaaggggaccctgtggctgaggccatggagaaccagtgccagggcccaagagacccatttttccagttatcagaggtgactgacatcttctgccactgccttgagttcagaaatttaaaaaagcttgcagcaagaaaatgccagtgtgcaactgggtgactaaagaccaaagaaaaacagttaaaagggacagcttacttgctctctgtctcaggtttaacttctcacctgaaatctctcatagccctaattaaacacaaacaaaagtctcttccatagataggctacttctcagcttcagctgcctcctgtggtggctctgggggctctggaggtggcatctcttcgggagtgctgctgtcctccggcatctcatttgagttcaggtgttctgtgggggcctgagaaggaaaagatatgagattcaacacaaagctgttcctcaaaatccaaatgcagataaaccttagacactgaactcttcctctcagccccctgatcacactgatgctacagatatgcagccaccaacaccaaactcagaaccaacaccaagctatcgtcttctcggcagaacacaactgaagtttatttgagtttgatccttaactgttggttggggacagatttttctattattattaatagtcataataataggaatcacaaataattacacaggtcctccccacttcagaacaaatgtcataacatacttatgtaacaaggcctgacccaatggtcctcaatcgtgtttctgcccgaacacacagctcattagaatagtgattctgaaccaaagaaggccaagtgtccaaattttcagctggtcatatgtggtttgaaaatgtccccaagtgattctaaaataccacccttctccactttgaaccaagaataactaacctagattgttacaatttgagtccagactcatttaaaaaataatattaaaaatgacaacaataatatataaacacgggttgctgtactttaaaaggaaattcaaaatttaggaaaggcaaagtagagaactattatctaccttataaaaagaattcacttaaaagtatgattctggccgggcgcggtggctcacgcctgtaatcccagcactttgggaggccgaggcgggtggatcatgaggtcaggagatcgagaccatcctggctaacaaggtgaaaccccgtctctactaaaaatacaaaacattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcagaaaaaaaaaaaaaaaaaaaaagtatgattctattttaaaacaaagttcaaactactaaaaatctattagaactaatgaacaagggccgagtacggtggctcgtgcctataattccagcactttgggaggccgaggagggtagatcacttgaggtcaggagtttgagaccagcctggccaacatggcaaaacccggtctctactaaaaacacaaaaattagccggtgtggtggtgggcacctgtaatcccagctacttgggaggctgaggcagaagaatcacttgaacccaggaggtggaggttgcagtgagccaagatggcgctgccgcactccagcctgggcaacagagcgaaactccatctcataaaataaaaacaaaaacaaacaaaaaagaactaatgaacaagcttggcaaggttttagggtataagatccatatataaaaatcaattgtctttcaatacactccaagtgaaaaatccaaaaatgaaattagtaaaacaatttcacttacaataacatgaaaaataatcaaatatttatgaataaatgtaacaaaagtgtaaaacttatactctgaaaactacaaaatgttgttgaaagaaatcaaatcatacctaaatatgtgaaaatacagtccatgtaaatggctcagaatatttaatcttgttaggatggcaatatttccccaaattgatctatagattcaatgaaatccccatcaaaattccagctggcttcttttcataaatgacaagttgatcctaagattcatacggaaatttaaggcacccagaagagccaaaacaatcatgaaaaagaagtataaagttggaggactcacatttcctgatttcaaaacttactacaatgctaaagtaatcaagacagcgtggtactagcataagaacagacatattgagcaatacaatagaactgaaagtccagaaatgaactctcacatttatagattttcaacaagggtgccaagacaagtctatgggagaagaatagtcctttcaacaaatggtgcagagacaactggatagctacaggcaaaagaaagaatgtggaccctctacctcacaccatatataaaaattaactcaaaatggatcaaaaacctaaatgtaagagccaaaactgtacagctcttacaagaaaacaagggcataaatcttcatgactttggattaggcaacagtttctcagatatgacaccaaaaagtacaaacaacaaaagaaaaaaatagacaaactggactacatcaaaatttaaaaattttgtgctccaaaggacactatcaagaaaattaaaagataacccatggaataggagaaaatatttgcaaattgtatatctggtaagagacttgcatacagattacataaagaactcttacaactcaacaataaaaaagacaaacaatccaattaaaaaatagacaaaagctctgaacagacacttctccaatgagcacataaaaatggccaataagcacatgaaaagatattcgacatcattagtcatcagggaaatgcaaatcaaaaccacaatgagataccacttcacattcactaagatggctagactcaaaatgtcagataataagtgttgcagaggatgtagagaaactggaaccctcaggcactgctagtgggggtataaaatggtgcagccactttggaaaacagttcagcagtaccttaaaggttaaacatagagctaccatgtgacctagctattttactcccaggtatatagccaagagaaatgaaaatatatggccatgcaaaaattggtacacaaatgttcatagcagcatcactcataataatcaaatggtggaaacaatccaaatgtccatcaactgatgaatggataaatgaaatgtggtatatccatataatggaatatcatttggccatataaaggaacgaagtactgctacatagtacaacatggacaaacctcgaaaacatgctaagtaaaagaagccagtcacaaaagaccacatattgtatgatttcatttacatgaaatacccagaagagagaaatctgtactaaaaggaagtagattagtggttgcctaggggtgtggctggggaagttcaggggaaagggagagtgactgctaatggctacagggtttcttagggtggaagggtaacgaaaatgctctaaaattgattgttataatgattgtacaactctgtgaatattctagaccagtgaatcatacattttaaatagggatcagttgggcgcagtggctcacgcctgtaatcctctactttgggaggctgaggtgggcagatcatctgaggtcagaagttcgagaccagcctgaccaacatggagaaaccccgtctctactaaaaaatacaaaattagctgggcgtggtggcacatgcctgtaatcccagctactcaggaggctgaggcaggagaacccgggaggcggaggttgcagtgagctgagattgcaccaccgcactccagcctgggtgacagagcgagactccgtctcaaaaaaaaaaaaaaaaaaaattgggacctatggtatgtgaatcatatctcaataaagttcttattaaaaaaagaaagctcagctgggcacggtggctcacgcctgtaatcccaacactttgggaggctgaggcgggaggatcacgaggtcaggagatgcagaccatcctggccaggatggtgaaaccctgtctctagtgaaaatacaaaaattagccaggcatggtggcgggcgcctgtaatcccagctactcggaggctgaggcagagaattgcttgaacctgggaggtggagttgcaatgagccgagatcacaccactgcactccagcctgggtgacagagcaaaactccatctcaaaaaaaaaagctcaagtaatatttttttttaggaaagtactttatatactttaaagatatactttatatatcttaaataggacagctgggagagtttccacaacttttgcatattccagttaggaagcccccttctaccacagtaaccacatcactaactctaatacaatcccctgacctctgtctttgcccctatagcattttatgctttcctcatcaaggcacttttcacaatgttgagcaatggcctgtttacttgtttcttgcccccactagacaatgagctccttgagagcagggacatcgtttgcctcattcattggtataaccctggcagctagtacagtggctggcacagagtcactcaatatacaccaaagaaatgactaaatcttaatctacatcaaggacacaaagatctgaaggcaacatcagggcaggtgtagaggcagggaagctggggtgattagaatacaatattgcctaattatatttccaagctgtaaattagcctccgccctctctatatcgacccagccttaagtcaggaacacttactgggctctgtggcaagaggctgctactggtctcttgagtactgggaggtcgacttccactttcctccagtggcaaaataccccttcgatccagcacactgaaggagataagagagttaacaaagaactgggcattcacccctccacccacctggcctacggaattttgctgcatagactggaaaatataaacctgtcctttggcaatctagcctgaacacagcacatgcctcttatctcccattcactttttcttccacaaaccaggaaatgtcacattaaccagggaacaaacaaatgaaattaagaatgaaagatcatccctccaaaacaaccagcccatggtctatggtccatgtagacatggtaccaagtggcaagccctggaaagacctatttgacaccaagaggccacactcagaaaaacacatcagacaaggtaacaggatcaggttgagctgctcatcccaacagtcccaggacttttgagtgccctgagcacctggggggcaaggggccacacagcacttcacagcagttcttcacaatattgccatggctgtagggattctggacgcgattcttccctgtccatgatcctttgatctgcaagataaaaaccaaggctgacattaaaaataatgttaaaatgaacaaataataataataaaattaaaaacagacacaaaaaagaaaaataataataataatgttgaagaaacacatgcagcatgggataataaaaaagttctggaaatggatggtggcaatggttgcacaacaatgtgatgccactgaactgtacatttaggatatgagggcgatctggctgcaacaactgtcaccccattgatcgccagggttgaaagacatttaatatagcacactttatatcatgtatattttatcacaacaaaaaagaaatacatacacagccatgaaaaatactcacaatagagtgaaaaaagcagataactgaatgatatatactatttttatttaaaagtacataatataaacacataaataaacatggaaaaaagtctagacaagtctagaatatataaatcatactactaacaaaggtgatgtctaagaagtaaagtaagaggaacttacttttttctttttgctcatctgtattttctgattttctacagtgaatgtagattaattgctaactttttttttttttttccagacagagtctcattctgttgtccaggctggagtgcagtggcgtgatctttgctcgctgcaacctccacctcccgggttcaagtgattctcctgcctcagcctcccgagtagctgggactacaggtgcacactaacacatccggctatatttttgtatttttagtagagacagggttttgccatgttggccaggctggtcttgaactcttgacttcaggtgatccgcccgcctcagcctcccaaagtgctgggattacaggcgtgagccaccacacccagcctaattggtaactttttatatagcaaggattcatccagtgcaactgtccctctccatgccaaacagaggcaccagctagcctttaaggacctgtgaacagttaaaggctgtatacccacccaacttttcaacctcttcttcctaatgctccacaagcattcaacaaagccctctcctttctcttccacacatctgacttaacaacctcgcataccacgtttctgcctgcctcaacctcccaggccctggagactcggtagttctctagcaggtagcaagaggataggctttgggaagaagaatatgtggtgaggagaagagaaagttgactcacgtcttcattggttgtctggttgagagccacgaggaaagtatgaaatccagtcagtcccacgacggaccagagtgtaaagaagcaaatgaggacttctagaacagtgaggtgtggttaaggagtattgaagaactcaacatcaggagacttgatgcctccgcccatattcagagcaccagtcagaccatctttacctcctggaacgtatatcacaaaaagccatgtttccatatataacaatagatgaattctgaacttactggatagatcccttatgaaagaatttctagcgtatctagggtatttaagggtgtgcctatttacccatcattggctcttggaaggggatgcatgggaggggccaaagctaaacaatgttggccatcactgccaatggaaattctgtcaaaaaacaaaattcatgtaatcccggcactttgggaggccaaggtgggcggatcacaaggtcaggagttcgagaacagcctggccaacatggtgaaacccccgtctctattaaaaatacaaaaaattagctgggcgtggtggcgggcatctgtagtccaagctactcgggaggctgaggcaggagaatcatttgaacccaggaggcgagctggggcaacagtacaagactctgtctcaaaaaaagaaaattcataaatgaagaactggtgggggaaaaaaaagaggatgtgatttatagaaatctcatctgaaccccctttgcagaaatgcagccactgtcctgagcagggggtgaaggaaagacctcccttttagtcccggtcatcttccattctggttgctaccactaagactatatttttttaaattattttagaccttggcactctctgatatctgaaaaactagatagtgggagaactgtggggaaaaagcatgctggaaagtagcttaagaaggcttcacagggacatactgccagcggaggatatgttccaggagtttctttcaatgtctccaagaagccaattttcaaagattctgtgaaattggatggaagagtagagagaaaaattagtgacttcagtcaaaactacacactatcctagtgcctactcacttccttccctccctctcccgtgttacacactggcaagagctaagctctcactcgggcaagggtgaagagcctcatctcctagctggtagtctcatgactaaagagttcacatttccagtgcaggaccaggccctggactagacaggcaggcagaagagcagcaggctcccttcccttttccctagcccccaactatggacatgttagggggatattaacagataaaagaaatcagaaatacccaagaaaaatcctctctccttgccaatacgtgtccctcccttgttcaaaatccagctcagaactcttctctttccagaaagctgtcttaagaccactcccttaactccacatcacatctgctcttagattggcgtgtgtgtgggtgtgtatgtttgtgcacatgtacatatgtgggtgtgctttctatctcccaaactagaccatgagctacaaaaagacatttctcaggcaaaacccttacccttttctaccccttagcacaaggcaagttttacaaggcagaagaagagaggatgctccgagacaaaatacatccccagcctttgggattacctcagaaatgccccagtactctggatacagaccagtaattatggccccagtgcccagcagttggccaaagagaaggccaacacactgattaatactcattgatgtgcactgaggtttgcaaccctgctcaagagcagataactgtgctcatttctaacctgtcctaaagtacctttcacaatggtaccaccaggaaacccaacaaccctctaagctgcccttaactcttcccccacccagccccactccaacaacggacactgccctgtatactcactgagggccacatagacgatgttgaaggcgaagacatagattgtgaggagggagagagaaaggatgaagaggtagaagtagcggtagttcctctttccaacacaattccccacccaggggcagtgatggtcgaagcgctctgtgggagaaagagagagtccaaagccaaaagcctccagaacaaaaatcaaccccaccatccctataatacctaattcaaagacctccaggatcattgtctatttcagttgtaaaaaatatagggtttttttttttttttactttttcaaaatgttttcataaccatctcatttgatcctcacaatttccctggaacttgggcaaaaggagatactcttttccccactttacagatgaagaaacaaaggcatggagaggttaagtgatttgcctcactcagctcattaaaagcagagacactgcttttccaaataaaatcttaatcggtgggcctactaagttcaagaagaataaacaggtcaaaatagccaaggaaaaatgtaaaactacaatatttaaaatggtatggcatagttcaatggaatggaaagagcccagaaacagatcttagaatatataagattttgttgtctaataaactcagcattacaaaatcagaggtaaaaggaagtattattccataaacaattacgtgacaattggctatttggtgcaaaataaggatcgatttttttgtcttcatactacttgtcatagtaaattccagatgaattaaagaactaaatgtaaaaacaaagtgaatccataaaataactataaagaataaatgtttatttgtcctctatatgcagaaggactttctaagcataaaagtactggaagaaaacagatgacaaggaaaaatagatttgactccataaactttaaaaaagtactttgtggttttgatttgcatttccttggtgatcaatgatgtgattattacacattgcatgcctgtatcaaaacttctcatgtacaccataaatatatatacctactatataccaacaaaaaattaaaaatttaaaaaatattttgtgtatgttaaaattaccataaagaagactaaagaaaaaaaaacaatggcaatctatgtaaagttgtacctgactatatgaaaagttcttagaaatcaataggaaaatacaaatacttcgtcaagaaaataatagtcaaaagttacttgaaatttgctaagagagtaatcttaagtgtcctcaccacacacacacatgcacacacaatggtaactatgtgtggtgatgaatatgttcatttgattgtggtaagcattacaggcagacaccaaaatccacccatactcaagtcattcagcagccctgcagaacccacggataagaaaagttgcccctcatgtacacaggttttgcatcttgtgaatactgtacatttgaaccttgaacaactcaggttagaactgcgtgcgtccacttgtacatggatttgtttcaataaatacagttggccctccgtatcaacaggttctgcatccacaactaaacctagatcaaaaatacggtattcacaaaatatgaaactcctggagacggatacagagggctgacttcatatccatgggttccacagggccactgcaggacttgagaatgcatggggtttggtattcaagggcaatccctgaaaccaatcccccaaggatacttagggacgactgtattttggatccgcatttggttgcagatgaggaacacactgatactgtatttattggaaaaaaaaaaccctcattattaagtgggcccatgcagtacaaaactgcattgttcaagagtcgactgcacataaaacaaaaacaaaaaacaaacaaaaaggaaatagggcaaaaactaataaataccataaaacctatatttaatatttttcctagtcaccaataattcattgtaatactagtaaaataatagcatattttatgcctatcaaaataagaatataaataataaaatccagtgctagtgagaatagggtaaaatggacactctaacatactgcttgtgggagcataaaatgaaagaaccttcccagaaagcaatttggcagtacgtatcaagagccttcataaagcttgtacccctttggtagaataagtccattttcagcaatttctcataagaaaatagaaatgtacacagaaattttaagttcaaatttttatttttatttatttatttatttttgagacacagtttcacacttgtcacccaggctggagtgcaatggtgcgatctcggctcactgcaacctccacctcccaggttcaagcctcatcagctgcccgagtagctgggattacaggcatccgccaccacgcccagctaatttttgtatttttagcagagacggggttttgccatgttagccaggctggtctcgaactcctgacctcaggtgaaatgcccgcctcagcctcccaaagtactgggattacaggcatgagccactgcgcccggccgaagttcaaacttttaaattaaattttgtattgtttggaaggcccaggcaggggaatcatgaggtcaggagtttgagaccagcctggccaacatggtgaaaccccatctctaccaaaaaatgcaaaaatccgtgggtcgtggtggtgcacacctgtaatcccagccaatcacgaggctgaggtggggggatcacttgagctcgggaggcggaggttgcagtgagctgagatcacgccactgcactccagcctgggtgacagagtgagaccctgtcttaaaaaaaaaatctattatggtaaaatatacataacatacaatttgccattttaaccattttaagtgtgcaattcagtggcattaattacattcataatgtggaaccatcaccattatctatttccaaaaccctttcattactccaaacagaaactctgcacccattaagcagtaactctccatttcccccttccccatcccctagcaatctctaatcttctgtctctatgaatttgcccattctagatatctcatataagcggaatcacacaatatttgtctttttgtgtctttttttttttcacatagcatgttttcaaggttcatccacattgtatcagtactgtattcctttttatgactggataatattccaccgtatgtacataccacattttgtttaaccattcatctgttgatagacacttgggttggttacaccttttggctactgtgaataatgatgctacgaacactggcgtacaagtaggttttgagtccttgttgtcaattcttttggctattgttatggaatgaactgtacccccactccccagttccatatgttgaagccctaacccccaatgtagctgcacttggaggcagaacctttaaggaggtagctaaagttaaatgaggtcatctggatggggccctaatccgatgggactggtgtccttgtaaggagaggatgagacaccagtagtgtgtgagcacagagaaaaggtcacgtgaggacacagcaagaaggcagccatctgcaagccagggggagaggcctcaccagaaaccatcccttctcgcacctctatcttggacttccagcctccagaattgtgagagaaaaattcccattgtttgagccagccagtctgaggtattttgttatggtaacccaagcagactaatataggtatacacccaggagtggaattgctgggtcatgtggtaattctatgtttaactttttgaggaaccaccaaacttttccacagcagctgcatgattttacattctcaccagaaatgtatgaaggttccaattgttccacatccttaagtttaataattatgattgcagtgttacaacaatgaataaaatagaagaatgaataatgtctaatgacagaagactgcctgaataaacttgaatagaaccatatgatggattatgcagtcattaaaataatatattaaagaaacatttattaaagatgtagaaaaacgctcaggatagaatgttaaatgacaaaagcaggattaaaaactatcatgttacagtccaattttgcagaaacactagtaggaaatatagcaaaatggagagtgaatttaggattaagttttatttatactttctgcacttcccatattttccacaatgaacatgtgttattttgatgaataaaagactacaaaagaataaaatacatcaatttgggccaggcgtggtggctcacaccagtaatcccagcactttgggaggccgaggcaggtggatcacaaggtcaggagatagagaccatcctggctaacacggtgaaatcccgtctctactaaaaatacaaaaaaattagccaggcgtggtggcgggagcctgtagtcccagctactcgggaggctgaggcagaagaatggcgtgaacccaggaggcggagcttgcagtgagctgagatcgcgccactgcactccagactgggagagagagacagcctccgtctcaaaaaaaaaaaaaaaaaaaaaaaaagaataaaatatatcaatttgaaagaaaagtgagctgtgtactggtgaaaaaataaggctgtaaaaatggtctatctcctgctgaggaagctacatcttttcaggaaagggaagaaaggtatagagaagaatggttatacagatatatattttttacagtattttaaatcacattttttctgataatacaagtaatacatgctcattgtagaaaacttgaaaaaaataaaaggaaaaatgaagaaatcacagtagtggaggatggcatatgaaaaaatgaaggaaacaaaatcactcataatcccacaacctatagataataaactataaaaattgtggcatatttcctgtatttccttgcatatttctttatacatcattagattttttaaaaataggtaactgacttcacactgtaaatgtagcctatctcccattttgtcatttagctttctggtatgaactctttccatcagtctaatgtacgaatgtcctattatttatttatttatttatttagagacagagtcttactctgtcgcccaggctggagtgcagtggcacaatctcggttcaatgcagcctccacctcatgggttttttattctcatgcctcagccagggtctcagctgggattacaggcacatgtcaccacgtccagctaatttttgtatgttttagtagagacgaggtttcaccatgttgctcaggccggtctcaaacttctggcctcaagtgatctgcccacctcggcctcccaaagtgctgggattacaggagtgagccaccacacccggctctataatttatttggctactcatctattggtagacaattaggttcttttcaacttttaattgtcataataatcctgagttaaacatttccaccccgaaatattttcccacatctctgatttcatgggacagactccctagaaagtgaaccactggcaccaaaaggtatagatgttttaaggctttcgattaatcttattagattgccttccaaaaagtttgttccaatttacactcttactagtggaagaataaacatcaggttttccttgctaattttctagatttaaaaaagcatattgggctgggggtattggctcacacctgtaatcacaacactttgggaagctgcagcaggtgggctgcttgagcccaggagtttgagaccagcctgggcaacatggggaaaacccatctctacaaaaaatacaaaaaaaaaaaaaaaaatagccaggcatggtagtgcatgcctgtagtctcagcaacttgggaggctgaggtgggaggatcacctgaacccaggaggttgagtctgcagtgagctgtgatcgtgccactgccctccagcctgggaaaaagagtgagatcctatctcaaaacaaaagcatcctgaaatcatttatttgactattagtcatgataactagccaattatattgttatgaactgtttatatttctcctggaatatcagtgctttttaaaaaaattgatttgtatgagttccttatagttaagagtattaataaggaaaggaaatactacctcacatcagacctttttattttacttaagttctggggtacatgtgcaggatgtgcaggtttgttacataggtaaatgtgtgccatggtggtttgctgcacctataaagccatcacctaggtattaagcccagcatgcattagctatttttcctaatgctctccctcccttccccacccctcaacaggccccggtgtgtgttgttcccctccctgtgtccatgtgttctcattgttctcgaaagaagacattcatgcagccaacaaatatatgaaaaaatgctcaacatcactgatcattagagaaatgcaaatcaaaaaccacactgagataccatctcatgccagtcagaatggcgattattaaaaagtcaaaaaacaacagatgctggcaaggttgcggggaaataggaacgctattgttgttgggaatgtaaattagttcaaccattgtggaagatgtggcaattcctcaaagatctagaaccagaaataccatttgacccagcaatcccattactgggtatagaccttcttcttttttttttttttgagatggagtcttgctctgtcacccaggctggagtgcagtggcgcgatcttggctcactacaacctccgcctcccgggttcacgccattctcctgccttagcctcccgagtagctgggactacaggcgcccaccaccacgtcccctaattttttgtatttttagtagagatggggtttcaccatgttagccagaatggtcttgatctcctgacctcgtgatcctcccgctttggcctcccaaagtgctgggattacaggtgtgagccaccgcgcctggccagaccttctttaaatatcaagtttcctgcttcacttaaaatgggtttcgacagccgggtgtggtggctcatgcctgtaatctcagcactttgggaggcctaggtgggtggatcacaaggtcaggagttccagaccagcctgaccaacatggtgaaactccatctctactaaaaatacaaaaattagccgggcgtggtggtgtgcacctgtaataccagctactcaggaggctgaggcaggagaatcgcttgaacccaggaggtggaggttgcagtgagccgagatcatgccactgcactccagcctgggtgacacagtgagactccatctcaaaaaataaataaataaaatgggctttgacaatagatgctgatgaggctgtggagaaataggaacacttttacactgttggtgggagtgtaaattagttcaaccattgtggaagacagtgtggcgattcctcaaggatccagtaccagaaataccatttgacccagcaatcccattactgggtatatacccaaagcattataaatcattctaccataaagacacatgcacacatatgtttattgcagcactatttacaataccaaagacttggaaccaacccaaatgctcaccaatgatagaccggataaagaaaatgtggcacatatacaccatggaatactatgcacccataaaaaaggatgagttcatgtcctttgtagggacatggatgaagctggaagccatcattctcagcaaactaacacaggaacagaaaaccaaacaccgcatgttctcactcataagtgggagttgaacaatgagaacacatggacacagggaggggaacaacacatactggggtctgtcggggggtggggtgaggagggagggcattaggacaaatacctaatgcatgcagggcttaaaacgtagatgacaggttgataggtgcagcaaaccaccatggcacatgtatacctatgtaacaaacctgcacattctgcacacgtatcccagaacttaaagtaaaataaaaaataataataataataaaatgggttttgatttataaaaatcttatatacatatagtagctttttagtatacacgctgccgaagagagcaccatatagcttttaccatataaagcaatatatatctcccaacctttgcctaaagaaatggctagtaagaggaaagcaatgccctcaggatgccacatggtatacagaaaaaacattatccaatcatgggaactcaagaaaaagtaattttaaaaagaacattagaagtatgcctagtgatgatataagcaatttcacatataggcctatcaacaggaatctttatggcccatttctcatcttggccagggtttagcacacagtaggcagtgattacaacaaagccacatatatgtggatggaagtacagaccactgtattagacacacatatacctgaccctcttgcagcagcagcaaagagaagaaataagcagtttggaatcagacctgctctagcttaatctcatactaattatgtgaacttacatactggtgcttcacctatttcctcatccgtaaaatggggataataccaatctcatggggctgttacaagtcttaaatgagagaaaggtaaatcacttagcacagtgcccaatatgtagtagaaactcaataaatgctagcaactttcctcttcttgggttgcgtcttagacagaccttccttcctcaatgctgccctccagtggactaggtgtctcctcccactatgtaaggtgggtcccacatgaaaatccagtacaggaaaatctaaatttcaaaaataggtaaagtttatttttctcatttactaaagaggtttttgtaaagtttaggctagaggatatttaaattttgatttgatctacacaagtacagctgatttgcagtttttcaggagcttgttgcctatctaaatttccctatctaaatctagttcatttctcatctaaatctatcttccctcctcccaaaattggtgaccaccctgactttctagttcaactcagccttttccctaggcaatgtccctgtagttttactcacccacacagttgtcacagatgctgcaatgggaggcccggggaggccggaagatcttgcatgtgtaacagtatttcagtttcacaatctggttgtttatctggaaattcttgatacgaggcggtggtcgctggccctggggcaccgcaccattggtagcttctgtaaatcaataaagacagttaatatcacagctagccatcacttgagcccaaaagtctcaccacctctccaaaaccaatgggggcattcaaaggttccccaagccccctgtcttttatagactagacactcaacatcacagaatatgcccataaaactccactaagtgcatgcagttctgttgtatacataagaaaaagtgtttcttcgaggcttttttttctgattacaaagaaaaacattcatttaaaaaaatagctaaaaatacattaaatgaaaacatccaatttcactaataatcagagaaataaaaattaaagcacaaagataccatttttacctatcatattaaaaaacattacaaacaataaaaataccccatgttagcaagggtggggaaaggtcattcttagatcttatcagtgagcaatatggcagctgctactaaactttttttttcttttaagatgaagtctcgctctgtcgcccaggctggagtgcagtggtgggatctcagtcttggctcactgcaatttctgcctcctgggttcaagtgattctcctgtctcagcctcctgagtagctgggattacaggggcccaccaccatgcctggctgatttttgtatttttaatagagatggggttttatcatgtttgtcaggctggtctcagactccagacctcaagtgatccgcccgcctcagcctcccaaagtgctgggattacaggtgtgagccaccgtgcccagccagctaccaaagttttaaacgtgtatattcatttactgatcaagtctacttctagaaacttatcaaaattataatgagatatacgaaagatgtttatataaggatatttgtcacagagttccttttaatagtgaaaaactaaaaataacttcaatgtcacaatagaagggtggttaagtaaattatgttatgtgcatagaatggaatattatgcagccgttaaaaatgacatagacgaaagaatggtgaaaacaggaaaatacaatatatggcaaaatgaaaatgtatgttaaaaagcaatacgcataaaacaatactatcttgcaaacaaaatatatgcatgtgaaaagaaaagactggtaacacagaaacagttactgaaataaaagtaatgcttgcttattgtaaaaattttggaaaaaaacagaatagggccaggcatggtggctcacgcctgtaatcccagcactttgggaggctgaggcaggcggggcacctgagatcaggagtttgagaccagtctggccaacatggcaaaaccccgtgtctactaaaaatacaaaaattagccaagcatggtggcacgcatctgtaatcccagctactctggaggctgaggcaggagaatcgcttgaacctgggaggcagcctgggtgacagagcgagcaagactccaactcaaaaaaaaaattttttttggaaaaaaacaaagtataaataagaaaacataaaaatcactgacagtcagtctctcagctcagagatatttatattttttggcgtatttccttctaatcttctattaacaggtaaacattcataatttttaaaaaattgagatcatattataaatgcagatttgtaccatgaagtatttacttaatattatatgctgtgaacattttctcattgttaattttttttctaaaacataactactggcaatattccatcatatacgtgtactatgatttatttaaatattccatattgttgggattttttactatttaggtgatgtttcatgtaaaaatttaaaacattacagagaaaagcttaaatctccttcgatcaccacctcaatcctagtcccctcctcccttccaagaacatactcatgtgttaaaattaatttctaaaacagaaagaataaagaaaagaatggtgaagtataagcagtaatacatgaagttgccggcattaaaatagctactcatatttaaaagaaaagaaaaaatgatgcaccaaaaatccttctacagtaatttgtaaaaatctgtttatctcctttagctaaaccctcagagaagtagaactactgggtcaaagggtatgaccctttaaagtccatattacttgttgccaaactgcttcccagacagaccgtatgaatttgcatgcctgcccatccgcagcatatgagagtgcctgtctcattgcactctcaccatgcagtataattctaaaaacagaatatttttcaattcactttgattttaaaaatatctgccatatggaacatttttcctttttttgtggagtggggtagatgctgtgaaatcaaacaataacaatgtgtcacaagtcttaaaaggatgaggacagctattcattagaggataagtaccagcatgccaccttaatattctatgcatatgctttccatgagggcacctgggagacagggttcatggttcacctttctcaggaggccgtatcaggcaagggcatcacatgacttcctctctccccatcccccacccacagcatacccagtacaggactgaatataagatgacaaaaacttgctaacataaacatacatatgaactgaaaaatgtactcttctagtgagagaaacatgctaaatgcagaggccacaatgtgactgcttgagtctgagccccaggcccagtgatcaggcagaaaagagctaactttgttaacaacctgctgtgagaggcaggagacaagtcaaggtactgccttgaccctcagtttctccatatgtgaatgggaagggaactggaaaagaataatccagatggagaaaaaacagcactcacaactcttcctcaccatcttgctcctaactactcctagttctatcgggtctccccagaactccagctgtgccagcacacgtcgcctctgctctcttcccactatccccaccctcaccccacccccaaatagttatagctcacatgtgcacaaacccatttctccttagctcaactaaaacaggctggaatttttcaaaatgaaatccattaagaagcctaagggaaaacacagctaaaataaacaaaagaaatacatgggccgggcgcagtggcttacgcctgtaatcccagaactttggaaggccaaggtgagaggataacttgaggtcgggagttcaagactagcctggccaatatggtgaaacaccgtctctactaaaaatacaaaaattagctgggagtggtggcgggtgcccataatcccagctactctggaggctgaggcacgagaatcacttgaacctgggaggtgggggttgcagtgagctgagatcacgccactgcactccagcgtgggggacagagtgaaactgtgaaaaataaaaaagaagaaaggaaggaaaaataaaaaagaagaaaggaaggaaaggaaggaaaaaggaaggaaggaaggaagggagggagggagggagggaaggagggagggagggagggaaagaaaaagaaaaaagaaatacatggaagccttcaaagcaccgtcaaagaactaaaggctagccacagattggtgctctactggcacagcttcttagtcttacaagtcctgggtccctttttcttactctgtctagcttggatgctgactcaagctacctgggtaccaaacctgagaaccatttaggtaggcactgctgttgatctggtgggctcccactccctcctagtacttgcatcatagtcttctttctcactgtgagatcccaggatatctcctcctctggccctgggatggttctgcttcaaatcatgaagccaccctggctcctagataatgtagcacttcatctctgtaccaaagatccttatcctgagctgcagtatgcactctactgagcctgcaattgcttcttttacccctcctagaattctcagtggttcctggcaccacagctgccccctttcacattgcatgttcccctaaagcagcgttttttgtttgtttgttttggtttggttttttgagatggactctcgctctgttgcccaggctggagtgcagtggcgcaatctaggctcactgcaacctccgcctcccaggttcaagcgattctcgtgcctcagcctcccgagtagctgggattacaggcacatgccaccatgcccggctaatttttgtattttaagtagagacagggcttcaccatgttggccaggctagtcttgaactcctgacctcaagtgatctgcccgcctcagcctccccaagtgctgggattacaggcgtgagccacagcgcccggcctaaagcaggaattcttggttgggggggacatgaatgaacttcagaagatctatgaatccctgaaattacatacaaaattgtgtacatgtacatgcatataagagcatttttatggggagaaggtttacagctttcatcaaaaaaccaaaaagtggctcttgagccacttgctcaagccccctcccactctgtggagtgtacttttgtttcaataaatttgtgctggccaggtgtggtggctcacgcctgtaatcccagcaatttgggagatcaaggcgggcggatcacaaggtcaggagatcgagaccatcctggccaacacagtgaaatccccgtctctactaaaaatacaaaaattagctgggtgtggtggcatgtgactgtaatcccagctactcgggaggctgaggcaggagaatcacttaaacctgggagtcagaggttgcagtgagccaagatcacgccactgcacttcagcctggtaacagagccaggctctgtctctaaataaataaataaataaataataaatctgtgctttcattgcttcagaaaaaaatgtgttggtgaccacctcccccaaaaaagtaaaaaaccatcctcctgggaacaatacagcaggaccttggtaacaaatccttcctgaaatgtgaccaaatgcagtgaaggacaaagtctatgactttagactgttgctagacctgcattactaaattcacggggtagtcatgatctcagattcaggatctcagagagaaaaggctagaagtgattattaatctgcaactactattatgattccattctcttactgattagggccacccactacacagcagcttgccagctggttggaagactcacctatctccatttctatgaaagctgcttcatctggtagcgcccgaggaatcactccagggtcactgaagctggtcctcaacagtgtagccatggagaaaaggaagagcatggcagcaaatacagggatggcaggagacagctgaacagccaggtagcggcacctgaagaaagcaggcaattcagcatttaatgatacctaccctatattgatctccaattgttaccagtatgtcaatctggcccccacaacagaatcagcagcacctcaagggcagggaccatgtttcttctcttgaattaccccaaacccctaacatatggctttacccatagtaggagctcaacaaataattgactgctgccacctataacatacagaagacacgcttgaggacactctcttacccccaagtccaatctatcctatcaacccactgggagctacatttcctctacctcaggaaaggttcacacctgctaagaatagggaagcaactgaacctggatttctaagcaacacaggttgatctcactctgggaatgtccagggcttctcataaccactgatctggcattcaagctgagcttgatgaagagggagaaaagatgaggaccaaccagaaagcaggttcacagtgtcagacagagagtatctcagcatgcttcaagaccagtgaaaaccttcagggctgttgactgactctgcaacatccattcctctggtctcctcaattagctcagctaataagtgactaatgaccatcagcaagaaaataagaaaatcgtttatccttagtaccccttcccaacatcatgttcactcccctctttcctcataatgcatctggcaagctatttctcttcctctctgaatatcccaactctactcatctttcaggtgccagagacatcaatatcattgtcatcattgcaactataatttattgagggctctccataagacaggcactgcactaagctcttcatctacattatcccatccaattctcacactaaatctatgaaatagatcctactatacccatttgatagatgaagaatctgagacttagagaattcttacctcctccaaaaggcttatgctaagctgcactaatctctctcttctctactccctgtggtcctcacttccagagccttgcattatttcctagctatttctcagtatgttgatggcatctccctcaactggacttcctaagagcaaggacctagtcttattggactgggaatgctccggtttgaattctggctctaccagctcctagttgggtgacttagttaacttcagtctccttatcgataaaatgaggataataacagtgcttgatgaggtcattgtgtggatcaaacgcactagtataaataaagtgcttagaactgcacttgacacacagtaaatactaaacactaagtaaaatgttagctattaacattaacaccatgattctgtatctcccagagctttaatacaagtaagggaacaaagaagctatcaataaatacttgttgatctgaactgaatttcaaacaaaataaataggaatatgtaaggagagttatcgctgacctatttttatcctcctcctcctgaggcacatttctccttgaaaacagagttttcacttggaggcagactataagtggatgagcaaggagcagagagagagcagagaaagtaagctaagaaaaacgcttacctcatcagcatgggaagtaagcaagctactggccattcaaagcaaacgtttaactcctggttatatattctctgcagtttcggaacaacccccatgaggtcttcccctagctccctgccacacacacaacttcatggggggacacaagccaagttttatattagactaagcagtttttgatgaaggtgcacatatgtactgaacctgaaggatgattttcgtgacttttgtgtttgcttgcttgcttatttttaacaaaatccttcatcttaagttgcttttttaatgatttacttccttctcctaaaagccaagggttgggggaaaactggagaactgaaggatctggcagctgagttcagggtaattaaggttcttacatatcactagcttgtggattaccctattttccactactccttttcactggtacagattaaccaaaaagggaattcagaagcaaaaatcacctccacttatcaggaacccaaaggatgcaggaaaagcatgaggcttcatttcatgaacaagccaagtgaaattaccacactaacagcaaataggaatcttcctggccactgcccatcactaagatcattcttgaaaacaaagaagtaatgtctccaggacgcaaactgccctggatgtatagtctccaatcaaaagccttaaaaatcagatgtatctgattggccaccaaagagagcttaatttttttattaaagggaaaacatacagagtgagtagagcaacagcaaaaaattctaaattaatgctgccccgctgcacagaaggacccgagcttaactaagtccagttccaacacctgcttgtaggccagacaaaggacaacttagatttgaattacgctatgccatcaaggataaaggtctctgtaatctccacacagagcatcttctgcacctgctaaaacaatccactctgtatgtcaacaagtacacaacaggcctattgtattgttctcctccagagatgaggctattggcagccagtcgtctctagtgagtgggtgtggctgggaagccagatgtgggactagcaggcctttctactctgagtaaggggaaacttcgagcgccagccactaagactattgtgaactacaacccatagtgtttgtcttcaaaagttatgataaaaaatacccccaccgggggtattgggaagggaggattgggaagatgtttgtcaaaggacataaaatttcagtaaggaagaataagttcatgagatctattgcccaacatgcggactatggttaataacactatattgtataccagaaaattgctaggagagtagattttaagcgttctcaccattaaaaaaataagtatgtaaggtaatacatatgttaattagcttgatttaactattccaaatgtatagatgtatcaaaacatcatattgtatacatatatatctttgtatatatatctttatatatatatataaaatatttgtcaatttaaaaaatacttcaaaaatatcaccctagactaatcccataattgctataagctggaagtctgtctctgacaagaataagctacgtgaaagtttggtggtaattcccaatatagacctccaaagtcaggagtatcctcaaacatcactaatttgtcttagataaagattagatcagccaggcacagtcgctcacacctgtaatcccagcactttgggaggtcaaggcaggtggatcatctgaggtcaggagttcaagaccatcctggccaacatggcaaaaccccatctctactaaaaacacaaaaataaggccgggtgcagtggctcacgcctgtaatcccagcactttgggaggctgaggtgggtggatcacaaggtcaggagatcaagaccaccctggctaacacagtgaaaccccgtctctactaaaaatacaaaaaattagccaggcgtggtggtgggtgcctgtagtcccagctacttgggaggctgaggcaggagaatggtgtgaacccgggaggtggagcttgcagtgagcggagatcgtgccactgcactccagcctgggtgacagtgcaagactccgtctcaaaaataaataaataaataaataaataaatacataagccggacgtggtggcatgcacctgtaatcccagcttactcgggaagctgagacaggagaatcacttgaacccatgaggcggaggttgcagtgagctgagattgcaccactgcactccagcctggtgacagagcaagactccacctcaaaaaaaaaaaaaaaaaaaagactaggtcagatctgtcatccacgaatataagctaattgtttctgaaactccctatatcactccatggaataataatatccatatacttcttaaaacagaactctcctgtattcaaagtaccaagaggcctttctccttcctggggattagagttccttttctcccttgtgaattttataaatgcaaccatgtcccaactaagtcttcatttctgccacctgaagagacatcatcattttaaaccatcctctactgacttcttgactgtcctcaggctaccatagctggactagacaactggactcccacatgtcccctcaggcggcacggtggtactgaccagcagtaaccatcagtgccaggctgggctcatgtgtcgtgtcccatcccccatccctagcatgctagttcactggagggatgatgataatgacacagacttcaattcacatgaaaacactcagaagagattcatgagtagaatgggtaagaatctagacagagagctatgccttacggattggcagcttggattggtgttctgtacaatacactgcttctaagtctccctaacagctttcttgctatgttttttggtttgtttgttcttttatcaatgtaatcagtcagccaacaagtacttgttggactaacaaatgaagaacaagggaaataggagttaattttgttggggaaaacataactgaaatatgaaacagctaaagaataagatgaccgataatcaagtgttagaatggtgactcagcctctaagggctgtaagtggtcagggaagagctctgtaggggagctgctggctgcttgaaactgctccagtagcagctggtaagtatggctttaaggaagaaggcccaaggatcagagccccatgatactctttggtcacacatgggagaaataagcctttgctataatacctccctgatatggatggccatctgtcctcttactacctacctgctacttactgaatgtctgtatccctgcaaaattcatatgttgaaatcttaacatccaatgtgatggattttggaggtggggcctttggggggtgattaggtcacctaaggctccaccctcatgaatgggattagcatccttataaaagaaatcctggcaagctcccttgcccctttggcaagggagagaagacagccatctatgaaccagaaagcaggccttcatcagtcaccaaacctgcaggcatcttgatcttgtacttgccagcctccagaactatgagacacaaatttctgttgtttataagccacccagtcgatggtagtttcttacagcagccagaacagactaagacactacctctagaagacaataaacatgtagaaccacccattaagactgtttcaagattcttctgatgaccctcagagtctgctgagaggggaagtttcccttaacactaaaaacataatttacaatcagcctccagatttacttctatgtgaaggtcagagaaaaatgcacaaccctcttttgctccagtagcaataaagaaaattaaccaaacagggacactttcaattctgaagtgagaagccatcctctcatcaaaatctctatccaggtaaacccgctcagtagtttccaaatttcagttataataacaaagttcaaatttcagttacaatatacccctgctcgagaacttagaaccattcactgctgcctattatattatgccccaaactccacaggtcagtattccaaggctctccattaactggccttatctaatcatcatcataggggccctgtcttccccactccattccagaaacatcccactaattaattaccctgaattagctagcttcttgctactgcaaatagcctaaggtacctcctttgttcttaagcacaataccagcaccagcatctctgaggagaaagatttaggagtctcttctttccctcaataacatctcaactgatgtcagcatgttggggaacatccctgttctctgggcttgcttttcccaaaacagaggatcactatatttaattaagactcatcctcaaaagatgggagaggcattcagtggagactgaaaatgtgaaactcattaccacaaaaggaaatagaggctgaaaatgtagagaaattctgaatgacagaaccataaagaattattaaaggagccaggcatggtggcttacacctgtaatcccagcactttgggaggccaaggctgttggatcacttgagctcaggagttcaagaccagcctgggcaagatggtgagatcctgtctctacaaaaaatacaaaacttagtcaggcatagtggctcactcctgtagtcccagatacttgggaggctgaggtgggaggactgtttaagcccaggaggcagaggatgcagtgagccaagatcacaccactgcactccagcctaggcaagagagggagaccctatctcaaaaaaaaaaaaaaaaagaggaaaaaaaagaattattaaaagaaagcaaactgccgccaggtgcagtagctcacgcctgtaatcccagcactttgggaggcagaggcgggcggatcacctgaagtcaggagttcgagaccagcctggccaacacggagaaactctgtctctactaaaaaatacaaaattagcaaggcgtggtggcgcatgcctgtaatcccagctactcaggaggctgaggcaggagaatcgcttgaacccgggaggcggaggttgcagtgagccgagattgtgccattgcactccagcctgggcaacaagaatgaaactccgtctcaaagaaaaaaaaagaaaaagaaaagaaaaagaaagcaaactgttcaggagatacaacccaaggaactcttgggaagaactctctctcaaggaacatacttcatcaggaagttaagtttagctaagtactgtaacagattgataccaaagaggcaactatgcctttctaaaactcatttggttagtcaagtcacagacagaatccgaagctagataaagccaagactgacctccatagagtcattccccagagaatgcactcttggttacagagcacaatatagtcactttttcctcttcccaatctcacataaggatgctcttcaggaacctggaccttgtcactgtgggcactaacattctggtatgtcaaagtttggctttggtctacatagtcttgtgtctcctcaaacctagtaagttcatattatcaggtctgctttttctatttcacctgtctgccagacacacctcctctttcttttttctattttatttatttatttatttatttagatggagttttgttcttgttttgttgcccaggctggagtgcaatggcacaatctcggctcactgcaacctccgcctcccaagttcaagtgattctcctgcctcagcctcccaagtagctgggaatacaggtgtgcaccaccaagcccagctgactttttgtacttttagtagagacagggtttcaccatgttggcccggctggtctcgaactcctgacctcaagtgatccacctgcctcagcatcccaaagtgctgggattacaggcatgagccactgcgcccagcccacactgcccctttcatcaggataagtcactaagtaacaatgtacagagcacacattgcttgatttttctccaagccatcctcatcttggcagcagggaccaggagtggccacagcagtgatgatcccttgttaactcacaaagctcctgataggcttccctgttcctgcaaggctaccagaaatgccatgctgcaataccatcagttctctgcaaagatgccttcattttctaggagcataagcttgggagacccaaagagcctagatgccactgggtaacacacacactagctcgcaagaatctggaatatgctggcctagtatttggtactatgtacactttactaaagcatgtgtgtttgaatatcttcaggattccatagccaaagggtaacaatgaacaatgagataaaatgtcgaaattagaagaaaaagccctgagtcagtatagagacgttggctggtcaactcatcttgataaaggaaactcacttctgtgggcctggtttcctcaccccacacaaggagggagatagtctccaaagccctttccagatctaccatcctatgattctgtgggtcaagattgttaaattttaagtacatctagaatgttttaattcagcaacacttattggccatctactctatgtaaggcatggtagagagcactgtgggggctacacagccattgaacatagtctctgaccttgaaagagactagctgcgggggacaacaacagtgagaagtgtaatcaccatatagctccaaactataagaaatgtcatgtgattatctgttgaatgagcggtgtgtacaattagcccaatgaatgcagaaattactggaaagttttcatgaagaaagactcaagaaagaatttgaaagaggggtagaatttggataggctagaaaagtattgtttgtattgattactattgattactaagcagtgttacaaagctgttttcagttcatccaattcaatgactcttctgccaatatatacatcaaaagctctaatggggaccaacctgacagaacctggtctgacagtgccttgataagatttccttcatatacagaggacacagtgagaccataagcactgattatagcagcaaactgcttctgcttcaggggtcaagagtctcatagtcattcttgccacaagagaagtctgaggaccttgatcccactagtggccaggtcagaaagctaaaagagaaagctggaagccaattccaggagacagtgcacttgttcctttctccaggatcacactttatcaggaagttgaatttgactgaataccacgatagcctttcagtagctggatgtctcctaggttgtcagtggcattctgctacagtgtcctaacacttcaggccaagctggtagctatgtgttcatcgcacaagctggatagagcttaagcagaaagaactgaaaattgttcatgtgctcaaagctgaaactagcaatacacactcacatttcttaaatacctcaccctaagaattaattagaaaatcctttttctttaagcattataccatttttcactctgcttttaaacttaaatacgtttaccatgaatacaattatatttaaatatagcaacctactggtaatctataatctccttttgtgtgtatttgagtcttccagacagacacagagttatacagaatttcaggttcttggagttgcaagaggcttagtgaatatttggccaaatttctactcggtgacagcggcccgagagagaccccccggcttcttcagaaacacctctaacaggccgggcgcagtggctcatgcctgtaatcccagcacttggggaggctgaggcaggtggataacttgaggtcaggagttcgagacaagcctggccaacatggtgaaaccctgtctctactgaaaatacaaaaattatttgtatttggcaggtgtctgtaatcccagctactcgggaggctgaggcaggagaagtgcttgaacccgggaggcagaggttgcaaaagcagagatcatgccactgcactccagcctgggtgatggggcaaggccctgtctcaaaaaataaataaaaaataaaaaataattaaaaaaaaaaagaaacactctaacaatacagagctaactggccccaggatggacaactttttttgttttatgtattcaatctactatgtgtccactgaaaattacaggtcactcatttgaaaagtcttctagaagatatgtaaaggcataatccaaaaataaaaggacatctgccagcactgctaacattatgcgtttttcattaaggggcacccacatgcctgaccagacttctcaagccatctggctggcccagagctgtgctgcaggcagctataaatcaactcacacttgttcctaagcacctgctgcaagcaggaccctgctactaaaatgcagctccagatgtgcctcaagatttggactatcttcccacaaggtaaaaatacagcagccagaggatgtggagtctctactcctagacaatgtaagaatgaaaatagatcaccatttgtctattcagacaccctcacctgcctgaaggcagggggctagatcaactgatttcctgaggcctcactaagttcttttttttttttttttttaagacagagtctcactctgtcatccaggctaagatctcagctcactgcaacctccgcctcccaggtgcaagggattctcctgcctcagccttccgagtagctgggactacaggcgcacaacagccacacggggctaatttttgtatttttagtagagacgggggttttaccatgttggccaggctggtctcgaactcctgacctcaagtgatctgcctgcctcggcctccccaagtgctgggattacaggcatgagccactgcgctaagtcctaatactaacaaagcagcccacattctgctccccaaaccctgcccccactatgtggtggacaggaaattatagatgccaaagaaaaaggccgaccagaaggagatttcattcctcagaggcatgctggtgtaccttgtacaacctgtcactggctaggcacaaggcagccaccacctaaagtgtctatgtgtctgtatatgacagacacacacacacatacacaagcacgcacatccacacatgtacaaagtattcatcaccagggtcctctcctctgtggtcacatttccacctcccccctccactcctctgctaacacatttacttccttctcccctcttcttcccactactccctcctccagccctatcttcaaaaatatttagtctttcacacagacagctggtactcaagtaagttttacaaataacctcacccttcaaaatgcaagaaataacctggggcggggggaagtcatcatggtagaaaactcaacctgcctctgtcaaatggtaacttggctaattagaagcttcatcccaccagcggttttcttcagaggcctgcaggggcctcagtggaacagattccagtcagattcttctgctggctcccagatacaaaaggggacaaatggcaatacctccaaatttcaagtacccctggccagtcaaaccagaggtttcctgggcccagaactaccaactaactcaaagcctgggaacaaggctcatctctgtttggaatagttgtaataaaaatttaacctggaggtgggggtggggacaaaaagagaaaaagagaggaagaatgataaagaacagatgtcagctttgcacttccaagaagaagcaggacaggaatgaggcaaggaatacttggagagaagggtgaggagaaggaaaaacaatttttaatgctaggggcttatgcctgcctgactacacatgctcactggtaccacacacaagcacgtgcgtgcacatatgcacacacacacactcattcaggaaactcaaactggaaagcaaataagaagccttcagcaacctgcctgacttcactaaacacttcacaaagtcagcagtagcggcggcagcagcaaaaggacctttaacaaagagttcctctgaccttactttcccagccccgttataaactggatctccctccccctgctgttactcaagccagctgcaaccacccaaaagtctggcaaagcagcccaaaaatcactctgggtgcactgggaaagcctgaagccctcacagaaggacaaaaatgagccccaagggaccagagctcattttacttccccactaggctggccaaggtgccccctcctacctcccatggacacaccccagcataagccctccatttccaggtcacccatgtacatacaccatagcacgctcacctcaggtgtggcttacagtccacacacacacctcttggctctcaaaggcctcctcacagtaatcccaaaacaattagcaatgctcccatccctagagtgtagagcattctcagcacacccaggagacacgccacagtgccctagaatccagccggccacctcccctagagacgagacctacacagacttcaaacagtggctcgagtacgaggtattacaccacagaaaaaaaatcactccaaggctggtaccagacatacacagaatatagagctgtttacgttgagtgattttgagggaaagagcaactcacttctaataagcacgtatgtgccacgcacacaactagtatgtggtccagctgaggctggaactaatctgtaggttcccaactcagttggcttttcactgtaccagctagctgagagctgagccttaaggaaacaggacccagaataacaaaataggtgaggattgctgagtaatgtaacaatgaggggtgccctcaggtttgtgtgcaggggaggccatctgtcatttagcttctaaggagaccactaaaagggagaggtgagtaattaagacaaactttcttatttcccaagtctatcaaggacagccccaaatcagtactacaaaattggtatcaaaggtattggtctttttaggaagtacatactctgtgatgaccacgaagcaatgaattcagctggcatctctacagacatcgctcaagaggacgttaaagtcatccaaggaccagccccaaactccccagaaagcaggttcttcccctggacccaaagtaaccataatcaggtaactctactcaaccgaaactcactcaaaggcgaagaagagtgtacatgtccccaggatgaggaaaagggtcaggtagaaaatgcccttttgccgggccatcatgacgcggccatcacagcaaaaggtgttcctgcctgggagtttctcccatttccgtgtcaccttctttctcaccaccatcacagacatgattggaattcctgctccaaaatgggttttgcgattacacgagagaagaaacagaggctgagcccagctttgaaatcacgttgcctgctattcctgccgctgggtcaaacatcatcaaaagtccaattgctagccctaagaaaaagcagaaaaagaaaaaaaaatgaggcaataataagaaaatacagttcaaccctcctttcccagagacagaaagttgaaaactgactgaaggggtggggacggggaagtgggaaaagtttatttccaattcgtgtttgttctctaaaagaaggtatgataaaaggttctcaaaaaaggaaaggggctagtatttcttcttaaataagcctctatgcttccaatctaatgctgatgatctgatcatcacagaaccttggaactagagaggattttataggtgatcgtgccaattattaatactttgttttgtaaatgagtaaactgaggaccagagagaggaaataacttatccaggaccacacagcagcaatgctgatactgctaacttccagtcaagggcatgttccactatgccacagtgttctttcaacatcattaaaaggactctaaaaataatagtagagtttctgtccttataaaacctccctcccttcctccacttcaccttctttcttcaattagccactcgaatatgaatcacagcagggaacaagtcaccctctggcagggccaggaggttctggacgctctgtgcacatacgtgcattgtatttacacaaaacagatttcccctcatcaaaccctctgcaacttcctgagtccgggaaatgaaacaatctggctggtctagcctaacatttgtgagaatcttaatgaaaccacatcagagacctgtaggtgaaaggctgacttaagcaggagagattctggaatggttggtgactgctgatggctggttggggggtggggaatggcagcagctaagaaaagtcacaagggcgctttctgggacatgtcctaagtaccatctctactcagcatcctgaattcccaggcccagagtttctcagcctctgctacccttctcctccgctcaggtgtggtgttgtggcctctatttaccgacaccacatgccccacgctggcaggactgaggcggaagcctgcagcccgacggacggagggagaaacagccaactcgcgggctggagagggcaaaggtccaaaaacagcctaggagcggagcagggaaacgagaaggtagaaggttcggggaaggggaggggggcccagaggtgcagagaacccgtcctttgtgtaaaactaacctggaagacaatctcctcccgataaaccggcccagcgggagaagggagaccaggaagggggagccggcctggaagaacaaagatcaaaatccgtcgggaagcagcgaccggctccccagcggggggccggaggccggaggccggagtccggggccgagccgcgggcgcggcctctcgaggcccgccctgactccgccacgccgcggaccaccgccccaggcaggttgggacgcgcgccacatccacacgcacacgcagccacacgctcgtacacactcacacacgccccgccacgtgtagtcaccccgggccaggggctcggcggctgccgagttgagaagggcggtgccgacgtccccgcctccaggcgccgcggaaggggaggcagcccaccctgcagccgagcccaggagacccccgcccccacccctcgttacctgaaccacggagacccaactcggccggcagctgacggcaggaaacggaccgtcccagggaatcacgtcggcagccaaaggtggcagcgacttgtcctccccgggccgggaggctgtctcctcctgacaaggggccccagtggtcggggccctaaaccagctgtggcaaccgcccaccactggccaaatggaacgctcctcacgtcaccaggtcgctccagtagttgctcgccctctat

SEQ ID NO: 1460 - DNA, 47733 bp, Homo sapiens
tacactttaaacgatatactttattggtgatttctggagactacaatcaaaaaaatttttacacatcaataatccccacattcaaatgccaatttacttaataatttggtgtatttctttcctagctttttccctccacactacacagatatacctaactttttgttccatgtgtttatctatacacacacactcacctatgaaataggtgaatacaaatttatacttaaataaatacaaatttatacttatatgtgcatataactttactcatcacaaaatttttatatgtcaaccacccagaatcactgatataatggttcatatacttcctgtttgtacaatattaatcatatggttattgttttataatattttttacctaatgatttaccacgaacattttcccaaatttgccagtagtcttaattggtgcatgttatttcacctgacataccaatttttaatcatctatcattggatattaaattgtcttattttttcactactttaaataatactgctgttatggaagatactctgaaaattttaaatcttatattgcttcaccataaaattattactctttattaaaacatggagaattttaagttctaagcactgttcctaaggaaagtatgtaaaagcttactatgtgccctttctgtaatggctttgcatttttgcactgaagatattgatgaataatatacgtaaggtctcctgtttgagatctttgtttcagggatcctgatgactcatcctctcttaccctatttcaggaagcattttttctatttgtttaggaaaataatctgggagtttgccccacatgggatattttatgctttatactgttcttttaaaaatgtcatactcactgagcgtggtggctctcgcctataatcccagcactttgggaggctgaggcgggcggattacctgaggtcaggagttcgagaccagcctgcccaacatggcaaaactgcgtctctactaaaaaaaaaaaaaaaaaaaaagaattagccgggtgtggtggtgggtgcctgtaatcccagctacttgggaggctgaggcaggagaatcacttgaacctggaaggcagaggctgcagtgagccaagatcgtgccactgcactccagcctgggcgagaagagcgaaactccatctctaaataaataaataatcatactctactccacagtgaacatatcttaaatttataattgtttgccacctctacacctcttccacaaaatgtttggtaaagaacatggtaagtgtggtggctcatatctataatacaagtgctttgggaggcaaaggtgggaggatcaattaacgctacgagttcaagaccagcctgggcaacatagcaagaccctgtctctattaataaaagaatatagagcatgattcctctcatttataccatgggtttgtttatttatttatttgacaaggtctggctataatgcccaggctggagtgcagtggcacgatctcagttcactgcaacctctgcctcctgggctcaagccaccctcctacttcaacctcctgagtagctgggactaaaggtatgcaccactacactcagataacttttgtattttttgtagagacagagttttgccatgttgcccaggctggtctcaaacttgtgagctcaagcaatctgcccacctcagcctcccaaaagtgctaggattacaggtgtgagctacgtaccacgcctggctaccatggttttataagctcactaaattcttagttttcctcggcatacatactctgataaacagtgccatttaaattatttctgaaggctttcccacataactacattcagttttgccccttttgaattatttgacatacagttcttcactcctgggtgaagaattctgggtgaaaaaactgatcacatttattgacacctctggaattatacttttgtactttgtattaagttaaatgaacattaacatatgaagaatttccaatattctggacatttataagattactcgccatgattatttgacaaataatgagactagtaatagtcaaatgacaaataactactagtataattatcccactctcaagtataatcataggtttttatctcctgtgtgacttctctgatgtttaatgagagttgacttcccactgaatgctttcccacagtctctgcattcataaggtttctctcctgtatgagttctgtgatgcacaatgagagttgatttcacactgaaggccttcccacattcactacatttgtaaggtttttctcctgtatgaattctctgatgtttgatgagagttgacttcctactgaaggcttttttacagtcagtgcattcatagggtctctctcctgtatgaattctctgatgtttaatcagtggtgacttctcactaaaggctttcccacattcgttgcatttatagggtttctctcctgtatgcattctctgatgtacaataagggttgacttctccccaaaggctttcccacatcttctgcattcataaggtttctctcctgtatgagttctatgatggacagagaggtgtgactttccactgaaagtcttcccacatatactacattcatagggtttctctcctgtatgaattctctgatgaacagagaggtgtgactttcctctgaagcttttcccacatttactacactcataaatgttctcttttgtatgagttctccaatgtttagtgggactgggcttctcatcagaggctttcccatgttcactgcactgaggtttctcacttgtgtgaattctttgatatataaggctggacgtagtacatttaatacctttataaaatgcttgtctaatgtgtgttttttcatgtctaataagatgatatgaactcttaaaggcttttggacatttgtcacatacaaatggtttctctcctgtatgagttcgttgatgtttaatcagagttgacttctggataaaggtttttccacattcactgcattcatagggcttctcccctgtgtgagttctctggtgtgctatgagggttgacttctggctgaaggcttttgcacattcgcagcattcataaggtttctctccggtgtgagttctttgatgtacaactaagtttgctttctggataaacacttttccacattcagtacatttgtagagtttctccccagtttgacttctctgactttttctaagggcttgcttttggtggagggctttccctcgttgattagggtcaaaaaatctctctgcaggttgagctttatgaagattataatggaggcatactttccaatatgccttacatccatcatctttctttcttacatagcttctattttgaccaagaaagtttaaatgatgttttgaacacctttcccatgaataatatttagggagtctttgttttacagaaacaaagtctgtgttgagataaatgatttttctacatattttacattcttgaccactttcatccttcagtgtttccttgcctatgaatgcagcttgccacagaaatttgtcttggctttccttgtagtgatctatctgctcgtcaacttcccagacttctagaagaaaatgcaatgaatcatcaaacttgtcttcccactataatttatgaaataactaatccctaaatgcccaagcagtgaactcctatcaacatgacttgagctgatgtggatggaggacccttcccatgtcccaggctcaaaatcaagaaaagaaatgtattaggtatcaaaatgaagtgggaatttaaagtgagagagtaaacagaacagcttgaggatttgaaggggaccataaggcacaaatgttcaggaattcagcaaagtcagagtgtaattttggcttaaagcttatatatatatatacatataattgtatatatatgtgtgtgtgtgtgtgtgtgtgtgtatacatatatgaaaggttgccactgctatgaacctaccaataacaagaccaactttaaaaatttttcagtttataggctctgtactatgcttgtaatcatttggattgagttacagaattaggcttttgatgtcttatatataacatccttcttgccaatttctctggctagtggggaatccttctagttcctgtttaacaagcatgggagcccttgcagttatatatatatatatatacacatacacacactcatgtctttatagctgaagacatcacagaacttctagggaaaaccaactctcattgaggagttcacagtagaaaatttaaaacctggctgggcgcggtggctcacgcctgtaatcccagcactttgggaggccgaggtgggtggatcacgaggtcaggagttcaagaccagactggccaacatggtgaaaccctgtctctactaaaaatacaaaaattagctgggcgtggtggcaggtgcctgtaatcccagctattcaggaggctgaggcaggagaattgcttgaagctgggaggcggaggttgcagtgagctgagatcccaccactgcaccccagcctaggtgacagagcaagactccgtctcaaaaaaaaaaaaagaaaagaaaatttaaaaccttagaaggagctgatccatcattagaaagaattgaccgatacatttaaatatactcacattcctagaactgtagataatagaacaatctgtactttaaaataagtatatttcaaatgtacaaagataaggtaagaactagactatgaaggaaatagcaggaaattttgaaaaaagacagatgagtatttttaaggtaggcattatttaaaaaaaaaactctaaataggttgaacagtagactagccacagataagacagatttaataaattagatgacagatcttgggaaatcacttagtctctaataggcttcccttggcataaacatcacacatgttggtgcatctttgatactggagttagagtgtgctctgtgttcatgataggcagacagcataaggaagttagagtgtgctctgtattcatgacaggcagacagcataaggaagcctgcacatggatgcctccagattctgcctgtgcctttttcccttataatccagttgtttatcattactacatcactgtaataaatcttacccatgattacaactatatgctgagttccatgaatttctctagagaatatctgagtatgggagtcgtcttggggacccctgatctaggcagtatttgaagatacaatgactgattcttttctaaaatggaagaaaggcatgtatcctaccactgaatgtccaaagtccttgagtgtggaaaataaacaagtctgcacttagacaaagttcagtgtagccacaaggctttcaagtcagaaagaaaatattgtaagctaccatgaataagtaaaaatatcccctataaagaaataattatatcaacatcagacttcttcaaaaaagaaggcagaagattaaagaataatatcttctctgtcccgagacaagctttcatcttagaactctatacccagataaattatcataaagaaagatgacaaagacatttttggacaagaaaagacaaagaatttgccatacacaaaacctggctaagaataatgcttgatacttcagtaattcagaaagataatgactaaagaggaaaaagcgggtaaggaaaatccagcaaaggcaagaaaaaagaagtaatgaaaagcaggctatgtagaaaatatactaaaagaagaaatacaaatatagtaatttcacaataactatatattaaccctattagttaaatgccaaccatatcaaattgcattttaaaaaaatcagctccatgttttcagaagacaattagggcaaaatgacagagatgtgttgaaaataaaattacgggaaaagctacatctggcacttagtaaccaaaataaaattggcaagataatgcttatatgccaaaagcaaagaaggataaaagacgagaatattataaagcaattttcacttacaaagatgtgaaactcttaaatatacatggcaaattgattccacttatgacggataagaggtaatacatttagtattattgaaaatatacagcctgggcaacatggcaaaacccgtctccacaaaaaaatacaaaaaattagctgggcatggtggcgcacacctatagtcccagctacttaggaggctgaggcaagaggactgcttgagcccaggaggtcaaggttgcagtgagccatgtacacaacactacactctagcctgggtgacaaagtaagaccctgtctcaaaaaaaaaatacacacatgtgcacacatgcacacatatacacacatacacacacatgccttactacctattccacttgtagttcataccatagggaaattatggcaaattttaacatgtacaagaatgacaacaaaattttagaaaccaccaaatatccaccaataaaggtatggaaagtgaactatgacactcatatttccgctagcacagcagttaaaataaatgatctaaatctaaagtatcagcataaagctcaaaaggtaatactgaacacagaaagcaagttgcagaaagatccctataattttttttttttttgagatggagtctcgctgttgtcacccaggctggagtacagtagcgtgatcttggctcactgcaacctctgcctcctgggttcaagcaattctcctgcctcagccccctgagtagctgggattacaggcacctgctaccacgcctggctaatttttgtatttttagtagagacgggatttcaccatgttggccaggctggtctcaaacacctgacctcatgcgatccacccgcctcggccccgcaaagtgctgggattacaggcgtgagctaccgtgcctggccaagattcctataatttgagtgtaacaatctggtaattttacaaaaagaattctgtattgattacaggtacaaatatatgtagcaaaagtataaaaacatagtttagaaggatactcacaaaattcatgatactgtttacctggggaggagataagaggaataggcctcaggaggggaaaaatgggacttcaactttatttgtaaacctctgtttcttttcttttctttttatttttttaattttatttatttatttatttattttgagatggagtctccctctgtcgcccaggctggagtgcagtggtgggatctcggctcactgcaacctccgcctcccgagttcaagagattctcctacctcagcctcctgagtagctgggattacaggtgcacaccaccacacctggctaatttttgtatttttagtagagacggggtttcaccgttttggtcaggcttgtcttgaactcctgaccttgtgatatgaccgcctcggcctcccaaagtgctgggattacaggcgtgagccaccgtgcctggcctgtttcttttatttttaaaaaaatgacaaaatgttaatatttgctaatactgggaaggaagtacaagagtgtttgttaaaattatgattttctgtacttttttgcagttttaaaagaaaggcttttaggctggacttctgaaatgacagagtgagaggaaggacctcagtaaatcctcttcccccaaaaagtaatgaaaatactggcaaaatcaaaaattatcaaaatcaatcatttcacgactttagaaattaaccaaaggcaaacaatcaattaaaaatcatttattcaagaaaaactatgccagacgtggtgactcatgcctataatcccagcgctttggggggccgaggcggatgtatcacctgaggtcaggagttcaggaccagcctggccaacatggtgaaaccctgtctctactaaaaatacaaaaattagcaaggcatgatgacaggcgcctataatccgagctacttaggaggctgaggcaggaaaaccgcttgaacctgggacacagaggttgtagtgagccaagattgtgccattgcactctagcctgggctaaaagagcaaaactctgtcacacacacacacacacacacacacacgaaaaaaaaaactagtaaacctcactaagaacagccaggtcatggttcacttggcactactactactcttcctgctctcccactggctccccagctccatgaaaactggtagcctcacagctacccaaggggatgaactgttttggagctctaccaaaagccctatccccagacagctgttgctatttgatctaacttaaagctcagctccaagaaaataaaggacactctatggtaactcaaatccacacaaagaaataaagagcaccagtaaaggtaacctgtaggaaagtgttaacacagcagaactgatctttagaaggacctgctcacagggctggctcctggctaaagtctgggaacttggcttgtgaaatattccctatgttgatatgatggttttgcctgcctagggcactgaacacctgtttttcttctgggagtctggatgcccgaacactagaggctgatgattttctggtatgatgtgcctatttttagtgggtcaaactggacttgcccacagacaaagtgaaaggagcttaacaaaaaaggcctagcttgccacttggatgtgcagtgcagctgtctggccctgtagcatcttggctttgcatgggaaaaaaaaaaaaaaaactatccctgtggggatttatttcctatcaggcacccagaactactggtggcagtgatcccatatggggatatgtcagagcacctgagataaagggggtaaaatcttataagctgaaacagagaaaaaaattatatcaagtatcaataatcagaatagctttacactgaaaattagatgacaatggagcaatgccttcaaaagtctaagggaaagacatttccatcctagaactctacttcaagccaaactctccattaggagtcaaacacttgtagacatccaaaaatctcaaaacttcatctcccatggacctacatcctttcttacgaaagtacttgaagactgtgctccaaccaatgaggaagggggcatggcataaagaaaatatggaacccagcaatgcagagggtgaagggaatccccagagtgacactgaagagcaatgtcaggatggtagctgtacaagaaggaatgagggtaatccacccagatgagagcaggtcagaaggctctagaaaaactcagggatatgacactgaggaaacccttgatatctccagaagcgctcagagtcactctagacaactggtgataagtatatggagaaagaaacaaatgaaagaaacaaaacaagccaggagaagtggttcactcctgtaatcccagcactttgggaggctgaggcaagagaatgacttgagtccaggagtttgagaccagcctagactctcagtccagtgagaccccgtctctatgaaaaacttaaaaaattagctgagtgtggtagtgcacagctatagtcccagctactcgggagcctgaggtgggaagatcgcttgagcccaggagtttgtagctgcaggctgcagtaagccaagaccataccactgcactccagcctgggcaacacagcaagattctgtctcaaaaaaaataattattaaccaaaggaacacagttatgcagggaaggtaaattaatcatagattactatgtggcttggctgtgtatagtatttatatatacagttagccctctgtatccatgggttttacgtctgtggattcaaccaaccaaggatcaaaacccacaaatacggagggccaattataccatgccattttatatcagggatttgagtatcaatggattctggtatccatggaggttctggaacaaatcccttgcagatacagagagctaactgtatagtcatattgtaaaaaatagtactgatggaaaacaaatttatggtataatcacattgggactattgggaaacaagaagtctatgtacatacgcatgcctttgggtgggtgacaggagcagcgtggtgagttcaatcttaaccttccacagtgaaacatttcaaataagttttgtaaaatatatgtaagttataaagaatagtaataccaaaaataatacctgggtatccaccacccattaaaactaattatagttatctttgaagttcttcatatgcccgtttcattttctttcttttcagataatcaatatcctaaattttatgtttatcatgcccttcactttctttacagtttcaccacatttattttattctttaaacctcaggcatgacctacgttaataaaactaagagtttttttttttaaatcaagagaatactgccttaggttggtaaatcggacatctcagatgaaacataatggtctagaaaaatgaccagaattgacagaaaatacaagaagcttgaataattcaataattgtttttttaaatgataaaaactgactccataatcaagtcttgccatatccagatggttttgaaaatgactagtatcaaactctcatgaaactaaatttcagtcacagtttcaaaaattacaagaaggaaaagtactcagtttattttatgcagctagtataaccttggataccagaataagagaagaaagtacaaaaaaagaaaatctaagatctattttacttctaaacattaatgcaaaattcataggttaaatactagtaaaatcaattctaaattaattttttaaagtagtttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatctcattgagcagtggtttgtagttctccttgaagaggtccttcacgtcccttgtaagttggattcctaggtattttattctctttgaagcaattgtgaatgggagttcactcgtgatttggttctctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttaccaaaacagagatatagatcaatggaacagaacagagccctcagaaataatgccgcatatcgacaactatctgatctttgacaaacctgagaaaaacaagcaatggggaaaggattccctatttaataaatggtgctgggaaaactgcctagccatatgtagaaagctgaaactggatcccttccttacaccttatacaaaaattaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggaaacctacaaaatgggagaacattttcgcaacctacccatctgacaaagggctaatatccagaatctacaatgaattcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacagatgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcgtcattattcacaatagcaaagacttggaaccaacgcaaatgtccaacaacgatagactggattaagaaaatgtggcacatatacaccatggaatactatgcagccataaaaaacgatgagttcatgtcctttgtagggacatggatgaaactggaaatcatcattgtcagtaaactatcacaagaacaaaaaaccaaacaccgcatgttctcactcataggtgggaattgaacaatgagaacacatggacacaggaaggggaacatcacactctggggactgttgtggggtggggggaggggggagggatagcattgggagatatacctaatgctaaatgacgagttgatgggtgcagcacaccagcatggcacatgtatacatatgtaactaacctgcacattgtgcacatgtaccctaaaacttaaagtataataattaaaaaataataaatttattaattttttaaaatgcttcacaattaagtagagtttagcacaggaacacaagaacacttcaatatcagaaatttattcacgtaatctaccacattaatagattaaaggaggaaaaactgtcttctcaacatatgcagaaaataagcattcaagaaaatacaacactcattagtgattttttaaaaagtcttattaggccgggtgtggtggctcacgcctgtaatcccagcattttgggaggccgaagtgggtggatcacctgaggccaggagttcaagaccagcctggccaacacggtgaaaccccatctctactaaaaaatataaaaaattagccaggcatggtggtggatgcctataatcccagatacttgggaggctgaggcaggagaattgcttgaacccaggaggcggaggttgcagtgagccgagatcgtgccattgcactccagcccgggtaacagagcgagactctgtctcaaaacaaaaacaaaaacaaaacaaaacaaaagtcttattaacaaaataggactaataaaaggggctcttgatgaaagatatctttcaaaataccacagcagatatcatatttaatagtgaaagctatagaagttacatcatttctgtgcctcagtttttttcatatataaaacagggataacaaccagcctactttacagggtcattgggaggattcaactatttaatatgtgcaaagcatacagaacaatgcatttgtggcacatggcaagcattcaaatgctgcttattattttattacaatcattgtcttcatgattatttccactaaaatcagaaacaaagaatgcaatatcattgtatctattaaacattgtactacaggtcctaattcattgagagaagaaaaagaaataaaatgtataattggaaaagacaattgcctttataaagataattattcacatagaagaccgaagagaattaaaaaagattagtattaataaaagccttcagaaagatttctgtacacatgattttatgaatatcactagcattctcatatactaatattaaccaattagaagatgtgataggaaagaagatcccaatcacaaatgcaacaataactcagaggtatctaggaagaaattcaacaaaaaatgcacaagatcttcctgagaaaaaatttgaaacattattaaatgacataaaaggataactgagtaagagttcactgaaaggaaaattcaatagtataaagatgccaattcccaacccactcccaactcatttctaaacacatgcaattgcaattggaatcccagagttttccttggaactcaacaaacgaatcctaaaattcctatgggagaccaaaggatcaaaagagataaggggactaaagcctattagctcttaacagcattaattgataagaatggtacaacaggccgggcgcaatggctcatgcctataatcccagcactttgggaggccgaggcaggtggatcacctgaggtcggagttcaagaccggcctagccaagatggcgaaaccctgtctctactaaaaatacaaaaatttgctgggcagggtggtatgtgcctgtaatcccagctactcaggaggctgagacaggagaattggttgaacccaagaggtggaggctgcaataagccaagataacaccattgcactccagcctgggcaacaagagtgaaactccatctcaaaaaaaaaaaaaaagggtgcttgcctgggcacagcagagcaactgggttttggccgggcgccacagtggctcacgcctgtaatcccagcactttgggaggccgaggcgggaggatcacctgaggttaggtgtttgagaccagcctggccaacaaggtgaaaccccatctctactaaaaatacacaaaattagccggccgtggtggcacatgcctgtaatcccagctacgcaggaggctgaggcaggagaatcatctgaacctgggaggtggcagttgcggtgagccgagatcacgccattgcactccagcctgggtctctaaataaataagtacataaattccaggcaggttttaagaaaataaacagcaaatatttaaatttttaaaaaattatataaaaatatttttatgtgctcagccccccaaaaaaaatacttaaaattacacaaaaagggtcgggcatggtggctcatgcctgtaatcccagcactttgggaggccgaggcaggaggataacctgaggtcaggagttcgagttcagcctggccaacatggtgaaaccccatctctaacaaaaatataaaaaaaattagttgggcatggtggcacatgcctgtagtcccagctactcaggaggctgaggcaagagaatcacttgaacccgggaggcagaggttgcagtgagccgagatggcaccactgcactccagcctgggtgacagagtgagactccatctcacaaaaaaaaaaaaaattacacaaaaagcaaactaaaaattgatacatttgattattttacaattaaaacttctactcaaaaagacaccataaacaacctagactaaggaaagatattgactatacacaaaattgaaatctagaatatacaaagaattcatataaagcaataagaagagacaaactcaacaaaaacatgaataaagaatatgaacaggtggctgggcacagtggctcatgtctgtaatcccagcactttgggaggccgaggcaggcagatcacgaggtcaagagatcgagaccatcctggccaacatggcgaaactctgtctctactaaaaatacaaaaattagctgggcgtggtggcacacacctgtagtctcagctactcaggaggctgaggcaggagaatcacttgaacccgggaggcagaggttgcagtgatctgacatcgcgccactgcactccagcctggcaacgagtgagactacgtctcaaaaaaaaaacaaaaacaaaaacaaaaaaagaatatgaacaggtaagccacagaagaggaaatctaactagtcaataacatatgaaatgataaatactttcaatagtaatcagggaagtgaaaattacaataatataccaatttacccttgccatattaccaaaattcaaaatctataattctgtgtgtgtgtgtacacgagtctaaatcacacactatctgtaacattaattttgccacataaggtcatagagctttgcattttaacattgatgattcctattcaaaagctgaattccatacatttcacgaagctgtatctgcccacctggctgcaatccatgcttttaggggattaatttgacatgatgttaaaaccagctctttttatttcaaagactggtaataaaatactatcaagtattttcccagtccgcaggcctttacgggactcaaaaggaataggtcaaaaccacttaatgtcctttatctctaacataccctttaaaagcataagagtgttggccgggtgtggtggctcacatctgtcatcccagcactttgggaagtggaggcaggcagatcacttgagtccaggagttcaagagcagcctgggcaatatggcaaaaccctgtctctaccaaacaaacaaacttagccaggtgtcgtggcatgtgcctgtagtctcagctattctgaaggctgaggcagaaggatcaattgggcccaggaggttgaggctgcaatgagccaagatggcgccattgctctccagcctaggcaacagagagagaccctctctcaaaaaattttaaaaagaagaaaaacaaagtataagagtgttaaggttaaagacgctaaggaaaataatttctttagagatagccattggaaagctgcggcattttctctctccaataggtgagtgaggagtgtgttcaccccaccccaatctgatgagaaggatttcaaagagatgacctgttcgatgtacatccactagactttaggggacacagagaacttggcacctgtctttcatgtagaaaaactataaatgacaggctgaggcagtctgtggtagtagagaagaggttgcgtgggggtgaactgtgggtcttactcccacaatcacacacactccacaagccagatgtggaccctctggacatgaacaggctgggttactttagaaagagggctttttgctagcatcaaggtgacctcagcaaaaggagactgaaggtacaccatggggcccggggatatattaaataactggttgggaaagtggcccttcctgcatcaaggaaattgcagtcaggggactccagctaggacatctccaaggaaaccataaagtgtcaagaacaggaagaatcagtctttggaatctgcaacatagagagggcatcagtattagattacaactttgttagttaggtcaaactttttttgcccattgtatctccttccttccttcctcacccactacactcaagggccagagatggcctaggtgttgagtgggggagaaagggaagggagaagagctagctggaagagtaaagaaagaaaacactgagcatgttctttttgccactaaaatctttcagcctgaagcaggtatttgctgggagagagcttttcctttaaatgaactttattgttttcaatactatatgtgattagacttactttaaaactaaaataagactaccactgaccctcagaaattgaaaggataagggaatattaagaacaactttatactaataaatttgacagacgaaactgataaactccttgaaagacacaaattattggctaggcgtgatggtgcatgcgtataatcccaacactctgggaggcctaagtgggcggatcacatgaggtcacgagttcaagactagcctggccaacatggcaaaaccccatctctactaaaaatacaaaaattagccaggcatggtggtgtacgcctgtaatcccagctactcgggaggctgagacacgagaatcacttgaacctgggaggcagagattgcagtgagctgagttggtgccattgcatcctagcctgggtgacagagcgagactctctcaaaaaaaaaaaaaaaaggagaaaagaaagacacaaattatgaaagctcattcaacaagaaatagatcatctgaataacccagtatctatcaaacttttaaggaagaaagaatacaattctacataaactcttccaaagaattggaaagaggagggaatacttcccagcttgttctgtgatcttattatcttgattgtggtgatgtgatcctgggtatatacatgtcaacacttaccaaactgtttgctttattttttattttttggagacagggtcttgctctatcacccaggctagagtagaacaatcatagctcactgtaacctcaaactcctaggctcaagtgatcctcccaccttagcttcctgagtagctacgactacaggcatgtgccaccatgcccagctaatgttttttatttttggtagagatggggtcttgctatgttgcttaggctggtcttgaacttctggtctcaagcaatcccccccacctcagcctccccaagtgctagaattacaggtgttagccactgtgcccatccctgtttaagtacgtataatttcttgtatgccaaattaaaccacagtaaagggtttaaaatagctaaatcagtacttagagatagttatggcattcacaatgcttatattagaaaagaagggtctcaaatgatgacctaagcatccaccttatgaaactagaaaaagagcaaattaaattcaaactagcagaaagacagaaataaaaaagataaaagcaagaatgaatgaaatcgaggtttccatttctagccacaatagagtaagtctactacagcctctcctactgattattgcaacaaaaatctctgaacaaaatacataaagtaactacccgaggactctgacaagtcaacaaaaccaggaagactacggaggtgagccaaaaagtagagaagcaactcatacatcagtgggttccccttttatccctcatattctctctcaagactctgacccaaatacaggtcccagtgacttatgaacatacagaagtcctgagttcatccaggaactcttcactcaagagaaagcaaagctacataccaagccttgagaactgaactaagatttaagccacagctcaagtctgagactaacacctgagtgacaaatgtaagcagggcagtgaaggctttgaacactgcacaaagactgaacccaccactcgagtctctaatccctaaatggcacatgcacacgacagatcaaaaggctttgaaaactgaactggttggaactgacacccatagaaggtgagacagacctagtggtttattacctgataaagatgaaaagcaataatggactgggcgcggtggctcttgcctgtaatcccagcactttgggaggccaaggcgggtggatcacttgaggtcaggagttcaggaccaacctggccaacatggcgaaacccgtctctactaaaaacacaaaaaattagccgggcatggtggcaggcacctgtaatcttagctactcgggagactgaggcaggagaattgcttgaacctgggaggcagaggttacagattgcagtgagctgagattgtgccactgcactccagcctgggcaacagagtgaaactctgtctcaaaaaaaaaaaaagaaaaagaaaaaagaaaagcaataacgacacagtccaccactatccaggatggaatccaaaattattcaacataaaaaccaatcacaaagatgtgaccaattctccagggaaaaagacaataacagatgccaatcctgaaataacctaggtgctggaaatatcaaagacatttaagtagttatgacatctaagctccatgaggtaatggcaaacacctgaaatgaatggataaatagaagttctcaacagagaaacagaaactgtaaaaataaaaaaattataaaaatgattggaaaaaaaaacagggtctctggggacctgcaggacaataccaaaaggtccaatgttcatgttattagagtcctcaaagaaggagaagaagagactactgtagaaaaaaaattgcaaaaaataataaccaaaaacttcccatatttggaaaaagacatatatttacagactcaagaagcacagcacaccagaatcaatataaactcaaaagaaacaccagaaacattataatcgaaagcctggaaagccaacttaaaacatttctaatgcagccagaggaaaaaaaggtacactgcctacaaggaaacaaggattcaaggactgcaaaattctcatcagaaacagtggaggtcagaaaacaatggaacatcttaaaaatactaaaggaaaagaaatatcaatccataattctacatccagcaaaaacacccttcaagaatgaagacaagtgctcactgtctaaaattggaacatatactaaaattggaacaatacagagaagattagcatggctcctgtgtaaggatgacgtgcaaatttgtcaagggtttcattttttttataacacaaaggataaatgcttgaggggatggataccccattcactctgatatgattattacacatcatatgcctgtatcaaaatatctgatgtaccccataaacatatatacctactatttacccataaaaataaaaattaaaaaaaaaagaagacgaaatgtaaaaattatcaggtaaaggaaaattaagagatttttgtcaacagcagacttcttctaagagaaatgctgtaggttcttcttcaggtgaagggagatgatatcagagggaaacatggaactttgggaataaatgaggagcaacagaaatggcaaaatatatgggtaaatgtaatgtataatttttctccttttgaattctttaagatatatatgatagttgaaagcaaaaaaatataacactgtctgagggatttaaaatgttattagatgtaatatgttcgaaaactgtaacatgaaagaaattaaagatatctatactgttgtaaagcttctacatattacttgaagtattaaactataagtagaatgtgaaaggttgtgtgtgactatcttagtatctacagcagccactgattttaaaaaataacaaccaggcatgacatcacacttctgtagtccaagctacttgggagagtgaggcaagaggattgcttgtgcccaggagctcaagatcagcctgggcaacatagtgagaccccatcttaaaaaataaataaataggccaggcacggtggctcatgcttgtaatcccagcactttgagaggctgaggcgggcggatcacgaggtcaggagatggagaccatcctggctaacatggtgaaaccccgtctctactaaaaatacaaaaaaaaaaaaaaaaattagctgggcattgtggtgggtggctgtagtcccagctactcgggaggctgaggctggagaatggtgtgaacccggaaggcggagtttgcagtgagctgagatcgcatcacgccactgcactccagcctgggtgacagagcgagactccgtctctaaataaataaataaataaataaataaatagggcaggacacagtggttcacgcctgtaatcccagcactttgggaggctgaggtgggtggatcacctgaggtcagaattcaagatcagcctgaccaatatggtgaaacctcgtgtatactaaaaatacaaaacttagctgggcgtggtggtgtgtgcctgtagtcccagctactcgggaggctgagaaaggagaaacgcttgaacctaggaggcagaggttgcagtgagccaagattgcaccactgcactccagcctgggcaacagagcgagacaccatctcagatagattagatagatagatagatagatagatagatagatagatagatagatagatagataaagatagatgatagatagatagatagatagatagatagatagatagatagatagatagataggccaggtgtggtggctcatgcctggaatcccagcactttgggaggctgaggcgggtggatcacttgaggtcaggagttcgagaccagcctggccaacatggtgaaaccccgtctctactaaaaatacaaaaattagctgggtatggcagtgtgcatgtgtagtcccagctacttgggaggctggggcaggagaatcgcttgaaccaggatggtggagcttgcagtgagccaagattgtgccactgcactccagcctgggcgacagagcgagactcgctctcaaaaaaaaaaaaaataaataaataaaaataaatacatacatacataaaaatttaatttaaaaacaaggagacagtgacaaacagtaaagaggtatgtttaaaatataatatttaaattataattgcactactggaaattcatcccagggaaataaaaacttattacaaaaacctacagagaaatgtttgtagcaaatttattcgtaatagcccaacactggatacaacctagatgtccttcaacaggtgaacggttaaacaaacatgcataccatggaatgctactcagcaataaaaagaatcaagcttgatacatacaacaacctgaacgaatctctggaggattatgctgagtgaaaaagaactaatcccttaaggttacatacagtatgattccattatataacatttttcaaatgacaaaattatagaaacagagaacatattagtagttaccaggctataagaggagatgggctgggagaaaatcggtatgactataaaagagtgacggtcaggtgtggtggctcgcgcctgtaatcccagcactttgggaggccaagttgggcagatcacttgaggtcaggagttcgagaccagcctggccaacatggtgaaaccccatctctactaaaatacaaaacttagccaggtggtggcgggtgcctgtaatcccagctactcgggaggctgagacaggagaattgcttgaacccaggaggcagaggttgcagtgagaccagatcgcaccattgcactccagcctgggccacagagcgagaatccatctcaaaaataaataaataaataataaaaagagtgacatgagggatccttgcagtgacagaaatgttccatatttgatctgtatagatgtcaatatcctggttgggatactgtactacagttctgcaagatgttacctaccaatggggggaattggataaagggtacattacgatctctttgtattacttcttacaagtgcatgagaatgtataatgatctcaaaacaaaaagtttaagaaaatattcaaatgttccaaagaagagaggaatgggaaaatagaataacaacaatcagcaaaagggggacaaagaagaaagaaataataaaatggtagacctacatccaacaatatcaataattacaaaaacacaccaattaaaaggcagattgtcagttgagattaaacacacaagattcaactatatcatgtctacaagaaacgcaatttaaatataaagaatctgtgttcaacaagagacacaagaaagacagtgaaaagacaatctagactgggcgcagtggctcacgactctaatcccagcactttgggaggccgaggtgggtgtattgcctgagctcaggagtttgagaccagcctgggaaacatggtgaaatcccatctctactaaaatacaaaaaattagctgggcatggtggtgcatgcctctaatcccagctacttgggagactgaggcggaagaatcgcttgagcccgggaggtggaggttgctcaggaggtggaggttgcagtgagccaagatcacaccactgcactccagcctgggtgacaaagcaagactctatctcaaaaaaaaaaaaaaaaaaagacaatctaacaaagggacagtatgcttgcaataaagcattgattaatatgtactctaccgaaaatagtgccactaggcatggtgtctcatgcctgtaatcctaacactttgggagactgaggcaggtggatcgcttgagcccaggagtttgagaccagtctaggcaacacggcaaaaccccatctctacaaaaaaatacaaatattagctaggtgtggtggtgcatgcctgtagtaccagctactcaggatgctgatgaggaagtaggatcacctgagcccaaggaggttgaggctgcagtgagccatgatttcctgggcaacaaagtgagacactgtctcgaaaaaaagaaagaaaatagtactatgggccgggcgcagtggttcacacctgtcatcccagtactttgggaggccaaggcgggggaggggggggaggtggatcacctgaggccaggagttcaagaccagcctggctgacatggcaaaaccccatctctactaaaaatacaaaaattagccgggtatggtggcacatgcctgcaatcccagctactcgggaggctgaggcaggagaattgcttcaacccaggaggcagaggctgcagtgagctgagatctccccactgcactctaccctgggcgacagagcaagactctgtctcaaaaaaaaagaaaagaatagaatagaatagaaaagaaaagaaaagagtgctatgaataagtaggaggaaggcacataccataagaaataaatgagttgaagacttacgcaggcaccgtgtaagatttacacaagtcactcaagttctctataaaatatgaaatgaggatcaattacattactaatcaaggaaatgaaagtttcaatcacaataagatactaatacacacctaccagaatgggaacaaataaaagtctgacaagcagaagtggcacggagggagcatctacaaatgttttacaaaccaacaacatttggccttatctataaattattcacacctccagaacccagacaccacaacctaggtatatacataggaaagctctcacagcaaatgttcctagcaaacatgtaaaataatggcagtattatcattaactatactagccttaaaccggaaacaacccaaacaccatcaagagagtaaatactggctgagtgcagtggctaatacctgtaatcccacactttaggaggccaagacaggaggactgcttgaggccaagagttcaaaaccagcctaggtgacataacgagaccccatctctatatgaaaaacaagaatagctgagcacagtggcacatgcctatagtactgtctactcaggaggctgaggcaggaggattgcttaagcccaggagttcaagcctgcaatgagctatgatcacaccactgcactccagcctaggtagcagagtgagaccctgtctctaaaaaataaataaataacttaaaagagagaagagtaggtacttttaattgtgtgatacccaaactagaacactatcctgcaatgaaaataaacatcatggctgaatctcacaactatagtagtgaataaaagaaataagtcacaaaataattcatatggatgattctgtttttacaaagctcaaaaaagaaaagttcaaactaaacaatatattgcctgtgtatacaaatatagatagcagaagctctaacaaaaatcttaaaaataattacccccgaatttgggatacaggttacatccaggagagaggtaggaggatgccatctggaaggggtagagtcgtagttctcaacctgagtggtgattatccaggtgttagctatatatttcttctgaaaagtacgcacgtgttctaaatgctcttctgtatgcaagatatagtaatcaataaggatttctttctatctcaaagaaatagaaaatgaaaaacacaaaaataaacacaatcaaaagctggttctgtgaaaagatcaatacaatggataaatcttaagtcagactgatcaagaaaaaacatacattatcaatatcaggagaacaacattacagatcctacaaatattaaaaaataataaggaaatcttatgaaaaaaactttattttattttatttctttatttttttgagatgaagtctcactctgttgcccaagctagagtgcagtggcacgatcttggctcactgcaacctccgcctcccggtttcaagcgattctcctgcctcagcctcccgagtagccggtactacaggcacgtgtcaccatgcccggctaatttttgtatttttagtagagacagggtttcactatgttggccaggctggtcttgaactcctgacctcgagatccgtctgcctaggcctcccaaagtgctgggattacaggcgtgagccaccccacctggccaaaaaaaactttatatcaaaaacttggtagtttagatgagacaaattccttccaggccacaaaccaccaaagcttgctcaagaagaaaagagttatctgaatatacctataattataaaaaaacaaatttgtagccgggtgcagtggctcacacctgtaatcctagcactttgagaagccgaggctggtagatcacctgacatcaggagtctgagaccaccctggccaacatggtgaaaccctgtgtctactaaaaacacaaaaattagctgggcatggtggcgtttgcctgtattcccagttactcaggaggctgaagcaagagaattgctcgaaccaagaggtagaggttgtggtgagccgagatcgtgccattgcactccagcctgggcgacaagagcaaaactccatctcaaaaaaaaaaaaaaagaatttgtagttcaaaacttaccctccaagaaaactctaggcccagatgttttcactgatgaagtctacagaacatttaagaaataatgctagtcctatataaatttcagaaaacagaagaggaggaaacacttcccaactcattttatgaggccagcataaccctgacgtcaaaaccagacacaaacagtgtaagtgaagaaaactacaaatgattatgacacatagcatagatgcaaaataacaaaatatgagcaaaaataaataggagcatatcaaaggaatgataggtcattatcaagaggggtttacacaggtaatgaaaggctggttcagtatctgcaaattggctaggcatggtggctcacacctgtaaccccagcactttgtgaggccaaagcgggtggatcacctgaggtcaggggagttcgagaccagcctgaccaacacgaagaaaccccgtctctatatatatacacacaaaaaaaattagccaggcatggtggcaggtgcctgtaatcccagggatgctgaggtgggagaaacgcttgaacttgggaggtggaggttgcagtgagctgagatcgtgccactgcactccagcctgggcaacagagattccgtctcgaaaagaaaaaaagaaaaaaaaaaaaaagaaaaatctgcaaattgactaggcatggtagctcacacctgtaatcccagcactttgggaggctgagatggaggatcacttgaggccaggagttcaagaccagtctgggcaacacaacaagacctcatctttacaaaaaatttaaaaaatagctgggcatggtggtacatgcctgtagtcccagctactctggaggctaaggcaggaagatcacttcagcacaggcgttcgaggctgcaatgagctatgaccataccactgcactccagccttgggaacagaacgagactccatctctaaatataataataattaattaatttaaaaataaaggagaagaagtatgatcatattcattgatgcagaaaaagcatttgcaacattcagcatcaattcatgataaaaattcaaaaaactaagattaaaaggaataatcctcaagcattgtcagcccaccaatggaaaactctacaaataaaaaattatacttaatgatgagaaagtgagtacttttgccctaaaatcaggaataaagcaaagaagtcattctcactatgcctattcaacacaatactaaagatcctagccagtaaaaaatggcaaaaagaggccgggcatggtggctcatacctgtaatcccagcactttgggaggccgaggcaggcagatcacctgaggctgggagttcgagaccagcctgatgaacatggagaaaccccatctctactaaaaatacaaaaaaaaaaaaaaaaattagctgggcatggtggtgcatgcctgtaatcccagctacttgggaggctgaggcagaagaatcgcttgaacccaggaggcggaggttgtggtaagccaagatcataccattgcactccagcctgggcaacaaaagcgaaactccttctcaaaaaaaaaaaagagggcaaaaaaagaagtaaaggacatccagattggaagggaagaaataaaactgtctttatttacaactacatgattgtttacataggaaatgtcaagctatctacaaaaaagttacaagctatctacaaaaaagttacaagttttaatatgtacacttagaaaggtcccagggtacaagatcaatatacaaaaatcaatggcatttctataagatagtactggccaatgggaaattgaaattaaacaaaataccacttatagtatcttataagaacaaaaaaagctggtattaattaaacaaaatgtgaaagacttatgcattcaaaactacaaaacattgagataaaatttaagaagatctaaatagagatacatgctattcattaattggaagactcaatattgtcagtatatcaatgatccacagattcagtgtaatcccatacaaaaatccctgcgggcttttgtgtacaaattcacaagctgattctaagatttatataaaaataccaaggacctagaataggcaaaacattaggaaaggaagaacaaagttggaaaactcatacttcctgatttgaacacttaatgttaggctacagtaattaaacagtgtattaatgatgtatagacagacacatctctgttcaactgtttggttttttttgagacagggtcttgctataccccaggctggagtggcagtggcgtgatcacggctcactgcagcctcgtcctctcgtgctcaagcaatcctcccacctcaacctcccaagtagtggggagtacaagtgcatgccatcatggttggcaaattttttaaatattttatacacgggggctcactatgttgcctaggctagtctcaagctcctaggctcaactgatcctcccacctcagcctcccaaagtgcttggattacaagtctgagtcactgtgcccggccattcaaaggttatcagcaacgatggcaaagtaagtcaacaacaacaacaacaacgaagagtattttcaaaactgctgctggaaaaattggatatacatatgcaaaaagccccctgaccctcacctcatgtcagatttacaaacttaactcattctttgtcataggtctaaatttaagagctaaaattataaatcttctgaaagaaggcataggagaaaaatctccattgctctgagtcagagatttgttagataggatacaaaaggcatgaaccataaaagaacttgataaactcagccttatcaaaattaaaaacgtctactctacaaagcacagttaagaaaaaaagaagccataatctgggagtacatacttaaaggacttgcatcaagaatatataaagaacctgctgggcacagtggctcacacctgtaatcccagccctccaggaggccaaggcaggtgaatcacctgaggtcagttcgagaccagcctggccaacatggcaaaacctcgtctctactaaaaatacaaaaattagctgggcatggtggcgggtgcctgtaatcccagctactcgggaggctgaggcaggagacttgcttgaacccaggaggcgaggttgcagtgagctgagattgcaccactgcactccagcctgggcaacagagcaagactccatctcaaaaaaaaaaaaaagatatataaagaaccttacaatttaatagcaaagaaaaatggcaaaagattacaacaaatacttccacaaagaagatataaagatagcaaataagggctcaacaatattcatcattagaaaaatgcaaaattaaatcacaatgagatccccctacacacctactagaaaaaaggactaacactaacaataccaagtgctggcaaggatgtgaaacacgtggaactcacatacattgctagcggaaaaaaaaagtggtatagccatgttggaaaacagtttagcagtgttttataaagtattccaacctgggaataatgttctctcaagtttatttttgaataaataaagagataatataaaaaacaagagttgagtgggaggaaggtactgaaaacaggaggaatctgaaaacaggtggcatcaagtcagatttgtaagagtctgggaaggaatacaaagagaaaatagaaaacagtgtgaggtttacagtgtttaccacaaaataagagcaggcaagaacatggtgggtaccaggctgggtagagtaaaggtcaccagcaaagctttgttgcctataccaactccaaaaaataatgtatgataatttccttgagtctaaaaaaaaaaaaaagactccaactttcagcctgaaagggcccacagtatgcccaataaagaggaaatgctgacatttgcatctagtctggtaaaaatacataagcacaagaagggagaaaaagttctaaaagcttccagaaaggacagggtgagaggaatgagaaggggcttggcacttctcactaacaagccaggaggctggaaggtagaaatgggatctcagaacaagagtggccacaatctatgtgaatgccaagcaaagaacacagagcctgtaaccggcggccaggcagaagcctcatttggacatgacaacagttctgctcatcagagcctaggcatgtccacaagtccgaggctctgagaagagctcctgagcacatcccagaggccaagctctcaccaaccaacctggtcccttttccctggcctgactcacctggcctgtcctcacctgcacaggtccgtaccggggtccctccatctgccatccaggactcgtcacctggtcccaacctgaagatcacatctggcttcccaactagatgccctgtttaggggacatgacataggactttgttattaatgctgaggaattccagaacctaggcccacccctgcaggctgaaggtggcacggcctcggtgatggccccatgcacacagctatctgcccctcagtacagaacattcacatagcaagcaagggcaccaatatgctctccagtgtccaaaggagactacaaatactacacagtgggcagtaacccaaactcactgagggtggtaacccacactcattgttcctaggccccagagcttggagcagctgagaaagaaacacagtactggaggcattctgcatcaccctgtggcgcggtccctcacccacggacaccaggtggctgtagttctcaagcatgacatccctgtagaggttcttctgggcagagtccagttgctgccactcctccagggtgaagtccacaaacacgtccttgaaggtcaatgattcctgtaacggcacattcctctttagcaccccaggaccagcctggggcactgggacatggcacctcacacacacggagggcttactctgtgccctttgaggtcctttacatgtactaaagatttcagtcttcgccgccaccctagaaggaacttgacagatgaagagtgtgaggcacacagagcctaaataaccagtccaggtcacacagccaggaatgagggattcgaatccacgcagtctggctcccgcatccacgctggcctttctttatataactgttcttatgccagtcactagtcagtttggcatagcatattacatagagtatatgactaaaatcattttgaactttataggagaaagagatagagtatgagaaatatcttaccctggaaattcattcattcaacacatgtttactgaatagaggccaggctggtaagtcctgtgacataaagattgatacaaaatgacaccttggccgggcgtgatggctcacgcctgtaatcccagcactttgggaggcctaggcgggcggatcacaaggtcaggagttcaagaccagcctggccaatatggtaaaaccgcatctctactaaaaatacaaaaaatagctgggcatggtggcgggcacctgtaatcccagctactcgggaggctggcgtaggagaatcgtttgaacccaggaggcggaggatgcagtgagccaagatcacgccattgcactccagcctgggcaacagggcgagactccatctcaaaaaaaaaaaaaaaaagacacctcttaaactcaaggagcttcagtttagtggagggagaaaagcgacacttagacactcatagaagaaacagaggcagcgaggaagcctgcctcacagggacagtgacagatgtaggacggggtccgggttgtccacaaaggaagaagtcaattctgcttagcgctgacagagcaggccttgcaggggacacagagctacaacaaacagttctaaacatagctaatcaatcatgacaaaccgttctaaccttcactcatcaatcatgaaacaaagaacaggaagccagaggtttgtggcctgggcagctgactgaagcaaaaggggaaaggtctgtgcttggccttgtcaccaccaaacaagaactcacttctacaagtgcccccaattccttgcaaagactaataacccgcctgtttctgctccagatcctatcctgtaacgcccacacttggtggccttcaattcaagccactcgctgcacccataaggcccaaatcagccacagtggcaccagtttacccagctgtgcaggagaggggcaggaaagccagtgtgccagagggcggggacaggcaggtttctccagcaggagggcttctcagagcaatccaggagctgttagcccaatctgcccctccctcgtgatagctccggtgctggggaacaaaaccacactgcggagtgctaggatgatgttgcttggaagccctaacctgttccatagaccagtatctcttgtaatggtcccagtggcatggcttcgaggatcccagcaaaagatgggcccagttacatatcactgagtgacaatgtgctcagaaaaccccaatccatggcttcctaccagccagtcatagtttactcagtcctccagtccagatgcagtttgtttaaccaatccagagtcaattttatctggagtaatgtcacctggtttgatattgtgaaatatatatttggtttttgtcctgtctcctggcaagaagctcctgcaacccttggaatagcctctgaagtgatcaaagtgtcttttatatgctaatgagatgactgttagctggctgcccctaggtagcttctggatggaagctggtcaccagaaaaccagacaggattagaaggttgggaatttcatctccatcctcaaaactcctgggaggggagaggagatgaaggttgagttgatcaccaagggccaatgatgatcatgcctctgtgatgaagcctccgaaaaaccccactgtggctgggtgtggtggctggctcctgtgatcccagcactaagggtggctgagaagggaggatcacttgaggccaggaggttgggcctgcagtgagccaagactgcaccactgttctccagcctgggggacagagcaagaccttgtttctcaaaaacaacaacaaggacaacaaccaaagggctgggtgggttcagacagcttccacacagctgaacacttggtggttcccggatggtagtgagtccagagagggcatgaaaggtctgtggaccttcccacatcccttgccctatgcatctcttccatctggcggttcatctgtatcttctgtaatatcctttataacaaataggggaaattcagtttccgttagttctgtgactcactctagcaaattaatcaaacaccaggagggagtcaagggaacccctgatttgtgtcccatcaatcagatgtatagatgataccctactcgagactggcatctcaggtgggggtagtcttgtgggactaagcctcaacctgtgggagctgacgctaactccaggtagatggtgtcagaatggaattgacttagaggagacccagctggtgtccactggagaatgacttggtatttgggtaaacagcctggggcctgggattacatctcgtgtcaggagtgttgtgtcaagtgagagtagacagtaggaaaaacttgggtttccttccttatctctcagacccagtaaaacagccatcattccactgtcacgtttctagtcacacacagctaaatatgacaatgatgatgaaagttaataaccactaacagatcctctgagtagagtgtcagaggttacttcataaaaatgatactgcctgtgcacatgtaccctagaacttaaagtataataaaaaataataaaataaaataaaataaattaaaaaaaataaaacatatgtatgtggccaggcgcggtggctcacgcctgtgatcccagcactttgggaagccgaggcaggcgaatcacgaggtcaggagttcgagaccagcctggccaacatgatgaaactccgtctttactaaaaatacaaaaattagccaggcgtggtggcgggcgcctgtaatcccagctactcaggcggctgaggcaggggaatcgcttgaaaccagaaggtggaggttgcagtgatgagccgagatcacgccactgcactccagcctgggcaacaagagcaaaactccgtctcaaaaaaacaaaaaacaaaacaaaacaaagtatgtatgtgactctcttaacaactaaacctcctctattaggaatcttactactgtgttacttcatctcaaatcttttaatagtctcctggtgactttgagaagtatcatgcagaaaacctctgcattttcactccactttgaaactggtcatgtcttgggaactgactcattctactaatcatatagcaaagagaaaaaacatagttcttagtttaaaacatgagcaattcattgtgtcacatatctttgtgttttggtaaattcatcattagagagagagaaaaaacatcaatggagtttaaaccctttgtctcgttaagtcgcaaaaaaaattattggactaaataaaccacgcagtgtcaagttcaaaaaagaatgatactgccttcacaaaaattgtaagagtgagaaaattatgacattgaaagagatctgatctaaccaacccctatcttgcctttaacctccaaattacccttaatcattcctcggcctggcccaagaaaactttgagagacatttgttttatagtttaaaagataatagaccacaggtgtccaatcttttggctttcctgggccatattggaagaattgtcttgggccacatataaaatacaccaacactaaagatagccgatgagctaaaaaataaaaatcacaaaaaaagtcacaataagtctcataatgttttaagaaagtttacaaatttgtattgggccgcattcaaagccatcctgggccgcatgtggctcatgggctgtgggttggacaagcttataatagccttctgcaaaactcaaccacctttgtaaagctgagaggccacaaggttaggaggatatgaggaggctaaaatctgctaacatgtagacataaaagatttccagctattattccggaggtcacaagatttggaactccccaattactcccgcagataatatcaccattatagaacctaagattggccttttgaggcattttttcaagtttttgcatttctgacgaccagtggctccaccaggactggccaacctccaccaaccggtcctatggccccacccagaagctgaatccatggcctaccaaactatccttgaaaaaccctaccctccaaattttcggagattgatttgagtaataactccatctcccatgtggcatggccagacttacatcaattaaactctttattgcaatgccgtggtctcagtgaattggttttgactgtgcagtgggtgggaataacccactggctggttacagcaaaaataaatcagccagacacggtggctcacacctgaaatcccagcactttgggagtccgaggcgagtggatcacttgaggtcaggagttcgagaccagcctggccaacatggagaaaccctgtctctactaaaaatacaaaaattagccaggtgtggtggtgcacgcctataatcccagctactcgggaggctgaggcaggagaatcacctataatcccagctactcaggaggctgaggcaggagaatcgcttgtacccgggaggtggaggttgcagtgagccgagatcatgccactgcactccagtcctccagcctgggtgatagagtgagaccctgtctcaaaaaaaaaaaaaaaaaaatatatatatatatatatatatatacacacacacacacataaaatctatgcagaaaagatgacattaggaaaatctggtggattagtccgttctcatgctgttgataaagacatacctgagactggctgatttataaaggaaagaggtttaattgactcagttcagcatggctggggaggcctcagaaaatttacactcatggcggaaggtgaaggggaagcaagacaccttctttacaaggtggcaggaaggagatgtgcaagcaggggaaatgccagaagcttataaaaccatcagctctcatgagactcacttattatcatgagaacagcatgggggaaaccgcccccatgacccattaccttcacctggtcccgcccttgacacgtggggattacaattcaagatgagattttgggtggggacacagccaaaccatatcttctggctaggtatttatggaggaaaataactcaataaaactgaattacccatctcactctgaaccctcaaataaattacacagggatgagacaggtctccctctgtcatccaggccggagtgcagtggtgagattatggctcactgcagcctcaacctcccgggctcaagcgatcctcctgaactcaagtgatcctcctgcctcagccccgcaaagtatctgggactccaggcacacgccacctcacccagctaatttttgtattttttgtagaaacgaggtttcaccatattgccaggctggtctcgaacttctgagctcaaatgatccacccgtgtcagcttcccaaattgctggaattactggtgtgagccaccgcacccagccttagagatttaaatgtgtacaagataaccataaaatagatcaaagtttttataattttacagtggctaaaagcctttcttttctgtgttttttttttcaagacatagtctcactctgttgcccaggctggagtgcagtgttgtgatctcagctcactgcaacctctgcctcctgggttcgagtgattttcctgcctcagcctcccaagtagctgggactacaggcacccgccaccatacccaactaatttttgtatttttagtagagacggtgtttcaccatgttggccaggctggtctcgaactcctaacctcaagtgatccaccaacctcaacctcccaaagtgctgggattacaggtgtgagccaccgcttccagccggctaaaagcctttctaagcaatccccaaattcagaagacatacagtcacagactgatcaacatgactgcctagacattagaaatttctaaatagcagaatgaattttttttctttttttttggagacagggttttgctgttgttgcccaggctggaatgcagtggcatgctcacagatcactgcagcctcgacctcctgggctcaagcgatcctcccacctcagcttccctcgtagctggaactataggcacgcaccaccacgtccagctaatttttgtattttttgtagagacaaggttttgccatgttgcccaggctagtctcaaattcccgagcttaagcaattctcctgcctcagccttccaagtgctggggttacaggcatgagccacagcacttggccaaaaattatattatgaaacatcaatatcaaagtgagaaaagtattagaaatatacaaaacaatgggctaatttcctttatacactaaaattctaacaaatcattatgaaaaagaccacaacctaacatataactgaatgaatataaaataaatatataacttaccatgtatccctttcatagtcttaaaaactaaaaaggttaataatacttagtacagtcaagtatgtagaaaaaacaccaaagaagttataaactatttacagcatttttgggaggaataattggttaatatatatcaaattttacattgcaaataccgtttaacaaagcaatgacctttctaggattttaccctatacctttaacacatcagtaagaagagacagcccaacagtatgaataaaatgctcatagcaacagaaatgttagaggcctagaaacacaaaaagattataagcctcactaaaagtcacatatatgctcattaaataataagatattgtcttttatccataagagtcactgctgatgaagagtattagaaattaaatactctcatataaaggctgattgatacataatttggttatacctattaaaggtatttgtttcttactttaaccagcagttgcatttacaggactctattctagtgaaatatttatgtgtacataaggatgtccaaggcagtcctattcgtattaacaaaaagtagaagaaagctctaaaaggtctggcacagtggctcacacctgtaatctcagcactttgggaggccaaggcaggtggatcgcttgagctcaggagtttgaaaccagcctgggcaacatggtgaaaccccatctctacaaaaataaaaaagggctaggcgcagtggctcactcctataatcccagcactttgggaggctgaggcaggcggatcacgaggtcaagagatcgagaccatcctggccaacatggtgaaaccctgtctctactaagaatacaaaaattagctgggcatggtggcacgcacctgtagtcccagctactcaggaggatgaggcaggagaatcgcttgaacctaggaggcagaggttgcagtgagctgagatcgtgccattgcactccagcctggcaacagcaagactccgtctcaaaaaaaaaaaaaaaaaaaagttagacgggcatggtggtttgtgcctgtagtcccagctactcaggaagctaaagtggaagaactgcatgagcccaggaggctgaggttgcagtgaaccaaaatcatgccactgcacttcagcctgggcaacagagtgagactctgtctcaaaaaaaaggaaaaagaaaaaaataaaagaaaaagaaagaaaacccaaatgtcctgtgttcctgggaaccccaaaatggtagaacaacagctgtattaccaggtgacattgcttatgagaaaaatgacccctgattggtaaataatctgcatgtggactaggactagagcgtagttaaataaattgctccatctatactctggaactgtcatgataaaaattgactcacacaggacgggtgtggtggctcacgcctgtaatcctaggactttgggaggccgaggcaggtggatcaactgaggtcaggagtttgagaccagcctggccaacatggcaaaaccccatctctactaaaaatacaaaaattagctgggcctggtggcgtgagcctgtaatcccagctactcaggaggctgagaaaggagaatctcttgaactcgggaggtggaggttgcagtgatccgagatcgcaccactgtactccagcctgtagagcaagattctgtctcaaaaaaaaaattgactcacacataaggatgcctgggatacttttgtctaaatgaaaaaaaaaaaagcaaatttcagaaaagcacagtaggagcatattttcattaaaaacaacccatgcaaaatgttgtggttttgtatatatataaaacaaaaaaattctgaaaggcaaacagtagaagggctgagactgggttcatttgttggaatgcaacagaaagggaggaatgaaaattggccctgttttcctggcttgaaaactggaaaaagtaaatatcctttcaaatggcatcatatttttttcttataaattgcctgccttatctttttgactcctttctaccacatttttttgttttttaatcattgttcatattacatacataaatcctctgtgtattatatgcattgcaggtattttctctcagcttcaaatatgtcttctgactctacaggttttaacattttaatacagtctaatctgacaatatttccctttatgatttctgggttttccatcttcattaaaaatgtttcttgcagggccaggcgtggtggctcacgcctgtaatcccagcactttgggagattgaggcaggcagttcagttgaggtcaggaattcaagatcggcctggccagcagggtgaaaccccgtctctactaaaaatacaaaaattagccaggtatggtggcacatacctgtagtctgagctacctgggtggctgaggtgggagaactgcttgaacccgggaggcggaggttgcagtgagccgagatcgtgccactgcactccagcctgggccacagagggagactccatctcaaaaaaaaaaaaaagtttcttgcactgcataaagttatccatatatcctcctaaatttttacccaatttttcaaatatatatttaggtctacaaccaatctagaattcacttttatatgatatagaagagtctttgtttccatacagatactcaactgtgccaccatcattcagtaaccactttttccacataactgaaataccatttttataatcttgactcacagaatcctatataagcaataaaagaaatctagaagtcacaaaagattgtgaaattagaccacattaacaaaatgtaagtgtccactccccaaaattaataagacaagtcaaagcaaatgaagtatgaaaaaatatttgcaacatatatgatagagatcttatttacttgagttaacataaagggctaccatccagcaatcaaattaattccacacccaagagaaaaggaggcaaatgactagaataaataattgaaataaggaagtacaaatgatggttaaaaaaaatgaaaagaagactgggcacagtggctcacacctgtaatctcaccatactggaaggcgagggtaggagaattgcttgaattcaggcattggagaacaacctggccaacacagtaagactccagctctacaaaaaattgaaaaattagccaggtgtggtggcatgtacctgtattcctggctacttgggaggctgaggtggaaggactgcttgagcctgggaggttgaggctgcagtgagccatgatcacaccactgcactccagcctgggcaacacagcaagactctgtctcaaaaaacaaatagcccagtgcaatggctcccacctgtaatcccagcactttgggagaccaagacaggtagatcacttgagctcaggagttagagaccagcctgggcaacatggcaaaatcctatctctacaaaaaatacaaaaattagccaggtgtggtggcacacgcctgtggtcccagctattcaggaggctgaggcaggaggatcacctgagcctaggaggtcgaagctgcagtgagctgtgatcgtgccaccatactgtagcctgggtgacagactgagaccctgtctccaaaaaacaaacaaacaaaaaatatgaaaagacactaatttcaggaaatgtgaattaaaatgcaccattcttatatgctgcatcatggcaaaaatcaaagcattggataatgcactgtgattgcccacttacgtgaaaaggcatatactgccgctaggagtacacatcagtatattctatttggagggcaaattgacagttctgaatcaaaattcatgatgcacatgaatctgacctagaaatctcacatctgacatactcacatgcaggcaacggaatgtactgtacattgctatgctgtttatagcagcaaaagactagaaatgtcctaaatgttcatcactaggagaaaggtaaatgaatattggtgttcccatgcaatgaaataccaagcagttgcttttgcaaacaaggtagaccactggttttaaacattggataattctctcccctaggggatatttggcaatgactacagatactttggttgccaaaacttggggagggattctactggcacctagtagagatagaggccagggaccctgctacacatacaatgcacaagaaagcagccacaacaaataatgatcagaaccataatgacaatagtgccgcagtaagaaaccctagggacaactaaatacaagtaaagtggaatgatcatgaagacaagaccagaaggaccagaatgagctctaatttgttagagaaaaagcgtgtcagagtgagaactagcacacacaggagtgagcagacaaagagattcatacatcctggccgggtgcgggggctcacgcctgtaatcccagcactctgggaggccgaggagggcggatcacgaggtcaggagatcgagaccatcctggataacatggtgaaaccccgtctctactaaaaatacaaaaaattagccgggcgtggttgcaggcgcctgtagtcccagctactcgggaggctgaggcaggagaatggcgggaacccaggaggcggagctcgcagtgagccgagattttgccactgcactccagcctgggcgacagagcgagactctgtctcaaaaaaaaaaaaagaaagattcatacatccagacagataagcatacatattctctgaaagactgtaccaaaaaatgaaggaatcttgaggatgggagaattattttttgccttttcttgaacaaaactttcatttgaatttttactatgtgtatgcattacttttaaatgttcaattttttaatgctctattcagaatacttttacattttgacatccatgttcttaagggaaactggtctataattttcttttttgtagtatcctcttcaaatttcaggttaagtggcttcacaaaatgaactgggtaccttttcatctttaatagcctggaaaaatggaacgcagaaattatctagtctttacatttagtgaaaggagtaattatgaaggatttcggagggcaaatttaagtctcactaccttttagtcaaaacccgacttccaggtataacctccataaacactggtactacagagcaagtagatacagagaaaattgttcatgaggtactgtatacaatagtaaaaaaaaattaggccaggtgcagtggctcatgcctgtaatcccagcactttgggaggacgaggtgggtagatcacctgaggtcaggagttcgagaccagcctggccaacatggtaaagccccgtctctactaaaaatacaaatattagccgggtgtggtggcacgtgcacgtaatcccagctacttggaaggctgagataggagaatcgcttgaacctgggaggcagaggttgcagtgagccgagatcacgccactgcaccgcagcctgggcgacaagagcaaaactccatttaaaaaaaaaaaaaaaaggccaggcacggtggctcacacctgtaatcccagcactttgggaggctgaggtggacagatcacctgaggtcgggagttcgagaccagcctgaccaacatggagaaacctcatctctagtaaaaatacaaaattggctgggcatggtggcacatgcctgtaatcccaggtactcggttggctgaggcaggaaaatcgcttgaacctggaaggcggaggttgcagtgagccgatatcgcaccattgcactctagcctgggcaacaagagtgaaactccgtcacaaaaaaaaaaaaaaaagaaaaagaaattaaaaacctaaatatctgtgaatagaaaaatagttacatgatacatccatactatgaaataggaattaaaacaatctttatatattgacaaggaacaccacccaggatataatcaggttcagaaagcaagatgggtatgggaatatgatgccatttgtgtaaaagcataaaaaaaatatatacgtgtacgtttttagttcattaaactgacataaatgcatctaccccacagtttcacccaactgttaacagtggacatctctaaggaggaacgtggtactggggggagaagaaatagaaactttattggctactagtttcttctatgtacattaaaacattatacacaaacttattctcttaaacacagtaaaaaagaccaagcgatctagaagtgaagaaagaggaaaaagcaaggtgaatctatgtatttaaacaattcttctctgagaagaagaagaaaagatgaggtacagtttctggaagaacaagtagagagaggtatctttttgtttttcctctctcctggtgaggggaaggattagagaaaccagaggctgaggacaagttgaacagaaaacagccagagaagaggggataattggtattttcaagtttattatatagattccaaactttgcctcaatttcactggaaaaaaagtaggggtacattagaactcacctgggacatggccatcttgttgtgctcctgcaaaggatggagatctacaaatacagaattagaagggttgagttcagtgggtatagacataagatcatcatcaccaccctaataataattacctttgcaccctgggaagaatcatctaaaaataaggcctggtagcttcagcctattccatgggacgctactaagatcatgtgggttttgcacatgaaactttgtctcccttactggacagatgtatgacttgtgtccaaagccatctacatgtcagaaaccagtaacaacttaacatctcctttatctcaagagttctattcctagcacaaagatgcaaaatgttcaccattgtcatttccactatgaaaaatctgcctataatccctgcatgcggggggcgctgaaggaggattgattgaggccaggagttcaagaccagcctagacaatatagcaaggccttgtctctacaaaaccgaaaattaaaaaaattagctggcgtggtggtgcatgcctgtagtcccagctactcaaaaggctgagatgggagggtctcttgagcccaggagtgcgaggttagtgagccatgatcacgtccctgcactccagcctgtgtgacaacgtcagagcctggctcaaaaataaacaaaaaaataaaaaaatcttcgaagcaactaaatgtgcagcaaaggggacttagtaaaaaaatatgacacgtgcaaaacaagcatactacacaggctttaaagatggtttctgaactttgttttcagttcctgggtgtttaaagggaggttccaacaaagcaactgcagtgtaatctcatttttgttaagcaatatgtacaaatatgaagtctcaaacagcatttattcttttttttgtttttttttgagatgcagttttgctcttgttgcccaggctggagtgcagtggcatgatctcagctcactgcaacctccacctcccgggttcaagcgattctcctgcctcagcatcccaagtagctggaattataggcatgcaccaacatgcccagctaattatttttgtatttttagtagagacggggtttcatcatgttggtcaggctggcctcaaactcctgacctcaggtgatccatccgcctcagcctcccaaagtgctgggattacaggcatgagccaccgcgcctgacctcaaacagcatttattcaaatgctgacattggttacattgttcggtgattttaattttcttgtttatttgcatttttgacaaggaatattaattactaatgaaacaaaaattaaaatttattaaaaaatcacttcttatcaaacagagccctagaggtgaaaagacactctccaagtgtgtatgagtaagatctcttcatgtggtttggaggaaggagcccaaccagcgctcaaagggccgcagggaaggagaggtgtggggctgggtgggtaacagccaagcactgtcagttctgtgaggggctgaaaaccactgtgcctgcttccctgcatccacctctctaactggccacctaccctgctcccaccccaccacttcctcctttcccatgatttgcattttgattgccatgctcctccttctttggcagattttcaaaagaaagttccagcaaggagattctgtgcagagtaaccatttcatactgcagcaatcactgtgataccatcaggacaacagggttcagctccgtgtagcttagcaggtcatgtcccctggcccactttcattaagcattgaaataaggcagcagagctggatgacagcatacctagagactactctgaaattctataaactaaaaatatattttctgcactttggtcaggatgaacggacactcagcatttcccctggaagcaggtgcctggttgatggtgtggggctgactcaaattcagaaatagccaatggcaagagaaggaagcatgggggtgcacaaataggtgtgctaggagaggccaatcctctgtggctggctgtgatccttcccagcctcatcccgcctttgcaggtactacagcagggcacctgcccccatgggggacatccatgcctccatccacctgtgactttcacctgtccctcctccagcaggaatcaaactgcactgtcacatggtcctccatggcacctggaagtagagccagctttgctctgtctcagctgaagtgagggacaaaggccactacgggtccagctcttctaggacctgctgtcccgtgagcctcctttgctctgaggatctgggtctgggctcttgctgaggcttctcctccaactcgcctcagctcagcgtacctctcttgtgtccaaggcggcaggaccaagggattcagagacaaacacaccccagttggggccatcactatagcactagatctctgcctgtgacccagggaactcacctcttcctggggcctcagcctaagtcttctgcgactaagtggggaagccgaggcacagataaactggagtctgaaatcggtgagcagtggtctcaggtctgcactctgaccctggaaacacaatgaccacaggagattcaattagcaacacctatgctcccttccatgcagtgaagttgagtgaaacccaaaggtttttacccaacagaagagggacaacccctcattctagttttaagagttaacattcatgcacagctcaattatcctcagtgagcgaaaccctgccttcctgagtccgggctttggaatcaactgactggctgctgtgccacttttattcactgaagaaatgattgccttccatgagccggttctccgtgttgcaaatccatcagtgaacaaaatctcaaattcccagctccagatttctagtctggaggaagagacacactggaaacaataaacatgataaacaaagtacaggaaaagaaaaagaaaaaggattcctcgggtttgctacctacgggactttggacaggttgccaagccacactgtaccgttttctctctataacatgaaaataatcatcgtaacacctcacagggctcctgctaatgtgaaacatttgcaagagtgtctggcagttaccaccgggtgaggatacaagcgctgagtgactcaatcaattagtcactcgctggccccgaacctcgcccccaacactcacgcccaccgcctgtgtcactcaatccccacaaggacgctcacccgtggccccatgaccccacggccccgtaaactcccgtcattcctcccgtccccccttcccccgatcaaaaccatcaccacctcaccctcccgcttacttcactgccgacagcctgaaacctcaggggcggatgacaacagccagtgtgaacgaagcgccaccctccgggtcagccgagcatttc

SEQ ID NO: 1461 - DNA, 47733 bp, Homo sapiens; identical to SEQ ID NO: 1460

SEQ ID NO: 1462 - DNA, 47733 bp, Homo sapiens; identical to SEQ ID NO: 1460

SEQ ID NO: 1463 - DNA, 304770 bp, Homo sapiens
aacgagacatctagtacggggctcacaggtaacagaactctgatcagatccgccccggctcccacacagctataaggttgcctgcctgcctgcacagaaatgacgaaggacaaaaacagcccagggtaggtgggatctatcagcctccatctgttgttacttcctgtgttatgaagaaaacgtttcctagttccattataaaatagctctctgatttctgtgcaagtgagaaatcaaatctttgtgtttatgggaccaaacagatggatttctgttgccatttggttcctggcgaagtgggaccgtgaacaaggcagactgccgaaaacataggtactaaagaaagggaaaacccttctgatatgtttgctgtgcagtattcattgcatacgatccctttcaaagtcatagttcttcgtatttttaaatgctgtttttcctaatttcagctcggcaccacctatcgtttatgaacacagttttattgtttggtgtaagcggttttaaatggcttagagagataatcataatttgtattctcaattaaaatatattaagcacatatatttcagtatgttgtattcagcttaaatatattatttaaaataatctaaaattacttgaaaaaaacaaaatcatgaaaaatgttgtctatattattctgtgaataatagtttcaaccacttaatattttaaactaataatagcataggtctagcaacaaaaaataattattggaaattcttactttcagttgttaccggcatagacctcattacaggaataggcctcattgcccttggtagatgaccaggtgctcttttagaaaatcagttaaaacaaaagtgcagaaatctaccacccccagaagcaaactacctttactcatgaattctcattattcctgactgtaagaatgcattttctttttcgttatttctgtcaggtatagataacatcattgatgttgttaacatcatttaaatttcaagattatattatgctcttatataattaaagctattttgttctctggtataaagtttataggtgggcaggtaagaaaaacacaatttttgaaagttgagtacttaaccagattacttaattagcaccctcttctgcctggcttgacatttatagttaatcatgaatttgcatcttggaagccagaaaacaacaattatctggaaacttaatttaaaaaatataaattttgcctgacttatattttaggggttgaaattgccttgttaagaattaacctccctcagctgatgttacccctctgatcacttttgactcttcgtttaattataagtaaataacttgcagtgcttcttgcctcccttccatcaatatttaaacaaggaaaagcattcatagctgtgagccaaatgcagctagctacatagaatatggtttagtcacagaaccaatagaattaccagaaacctcagcaagttattcctttagaagtagtcccagatacaacaccacttctactcaaagccaaagttattgttgaatgtaggctacacactgttctgtatgctttgcctgtgttaacggcatcatcacaaccactcctgcaaagtttgtattgttataattcccattgtaactgatagcatactgagataagaaaagagtaagcaaattatccagctccacgcagctagtaaatgatgatggtagagtccacagaagcttggtaatagatttcttaaaaattaaaataaatccaatcccaaattacttgtttaaaattccttttacatttccttcattagatattcaaattacaaaatatgtacatattgatacaaataaaagaaaaatcttaatgatgccacattaagaggatttcttttacttttttgtcttttaatttttttttgctgtcccttggagtcagtaggggccacatcccctttctaatcctactctctgggcatggagagcactttcacatttttcttcatgcttgccacatgtatgctgtctcacaggcatgcacacttttaaacaaaaataacaatataaacattactctgaaacttgatatttcatgaagtcatatatcatagtgcttactccaggccagtaaagttgtagttgagctttgcattgatgcataatatttcatgtgatgaatgaatcataatttattcatgcaatgatggatgttcagataagagaatgatcaattccttgagtgttttaaatagacacctgacagaaagagtgaaatgagctaggtgcttttaccaaagctaaggtctgcttatgaagacgttcctcataacgctgcaatttcttagtgattaagtgatcaaaattatgtctggatgcctcccaagtacacatttcttaaattactccatatcacctgaaagaatgtggtgaatcttttcatgtttgtccgtgtgctattttcagtttagattctttgtagcaaagtggaaggaattgggtacatttaatattaaatttttgttgttggaaagggaaaaaaacactaaattattgcagttctaaattatggtttgaaaaggaaaagcaaaagctatcaaaatacgaagcaggaaaagagaggcagctctgaaatcaacacattgcctaggacattctccctaagagtctgctcttcttggctgatgcagcagcagtgcactgtacacaacaaactgccagtcccaaactccttgtagtgccaactagcattccaagtaaaacagagcagaccttttaaagccacctaagtatctcttgagcataggagtatgattccttaaatgctcttatactttcattttacagagctctgaaagagggtgctttttttttttttaagttttagttttaaggcaaagcaaagctttggcaccgattgataatttgcctgtgcacctcagaaaagtaattcctttcttaagaacaaacagcttatctagtcattcccctaacttttcttgcttctagaactgaagcaaatttgctaattttgtagtattctgtaaagcagcaaactgtgatattcagtgaagttctcactgcaaattgggaaccgagaaaggatataacacatcctttgcactcctatagaacctatcaaggctaaagatgttgagcctgactctcttaacagctccagtgtctgaaataaatattctaatgtctaaatgaaattgtgctcattccctcagggtttagtgtaaaacaatatgctcttgaggtgaggacaagaaggccgtcacctgagcatgtgagttttcatgttgatactctgaacattccattctagactacctggaatcaaggaccacatctgagtgtgttatacttgcaaacagtttggcttattatcattgcaattggaaatcttacaagcatatatactggctctaatatatattttatttatacagatgaattatgcccatttaaaaacaaaaaagttatctgtagaatacattatagttttcattcttatacatggatcagaatagagttaagaatgtgttcttttagctttgccattttaagcaattttgtatatacataatcattcacttggaagccagttcagtttcaatttatataatgattgtttttaatttagaataacaggaaattttcttttttctttcaaatattagttttgataatgttgaagtatgctggttgaaaactttatgattttgaaatagcgcagagacaggcattacgttgcttgatatagtataagattttgattgttttctagaacatcgtctctgttgagattagcaatagaagttttaagtattctgcatatatttccaatttggttcaacatacatttctttagcttttattttttgcatgtcccttgactttttttaaaataagaatattcaaaaatgaataaaacatgattcctgctctccagaattttacaggttagtgggtgagactgagagttacatgcttaaaaacaaatgtgtgtaacagcaggaacgctgctactgctcaaacagtaggaagttaaaaacacgagaacgtgagatgatttggggagcgggagcatatttgactaaatgtccactgtgtgctcagtttggggtcccagaggctagccgacatattgtatgcaggacacatggaacatagtctagctcctaactccatctgcatttggtttctgtctggtaagctcatgtgtaattacagactcaggacaaagaggtggttaattcttcaatggtaaattaaatatgatacaagatggaaaccgaactccacaaatatccagaagagaagcatgatattagctgaaatttttattccattgcattttcttaaatctgtgaaatccatgtaagtctgaacttaaagacagcactatcttttaatttagcctataaaaatttcagcaaaccaaaatgtttgttaaaataaccattaaccacatatatatccaaatattcattatatatataaaatttctttaaaatatcatgctcagaaatagagtaagttttaattaacaggaaaattgtttcatatcttgttatctttaccaaaaattaaaaatcaccaccaacaacattctgtatctatggataccttttctttctgttacgtcaaagtgcatcatggaattattctgaaaatagggccacctgctctatttgatattggacttttaaagaaacaaaagtttaacttggtcaccaatttactgttcctggaattgtactttatgagaacatttcaaattaattgcatccttaaactggggtcacatttgaaatcttgtcctttgctttttgttgtttgttttgaaacttgttgaaaattcttcccaggattctttctatgtggaatccaatttacagtacattttaagggcctttttaaaaaacataaaatgaaacataggcaatcctttagtggatctgtcctgttttaggactaaattgatatcttttaatagatgtaaggccttttggattatctgccccgaacttctcccactattgataggcatcttgtactaagccatagccatatattgaaaattgccccaaatgtgctctgctctttctcacctctttgtttttgcacaagcttacctctgcccaggatgccctttcttgcatcgtagaagaatgtacaatgacttccttgtactacttcctcaagtgcctggtcagatgtgactgccccttggagatcttttccatctccagtggtgctgtgcacttcgagctcacccagttggctttactgcacataatcacattggtgtcatcacatcacccatggatctctctctccctcacctgggaagactcttctttgtattccctgggcttagcatggtgccttgccctaagtgttgggctaaccaaaggtaaagtacatggaccactttgaaaatgaaaaatatgtttgatgatagaatagctctcaaatgctttagtatatttccatcaatgtgaaggcagttgaaattgtctgctggatttctttgatcatgaactatgagcagtaggaatcatgttgattaaattctcttttttctttctctgcctgtgaccatgccttaattcaggcactcattatctctcacacaaactatttcaagacttttctaactattcctcctaccaccagttccttttcctgccttctctcctatatgccactgctagagctaacttccctcaaaatgtttctgattgcatcactcctattcttaaactctcatggtggcatccaattataatacatagtccaggcctttcagccataattcaggacctgagcctgtaagcactgtaagatgtgagacattgtcatgttttcctcactgttatccccccagcatatagcatagtacttggcatagcctaggtgcacaatgcacatgggctgagtagcccatttcatcaaatctaagatggtgtgatcagaaaacacaccattattttacacactgctaagaaaaaaacctgccaattaaactaaggcacaaagcattcttattctttgaatttttattttattcttattgaaaaaccatttttatacttcaggaaaaaagattttattatatgtcactctaatgcataaataaaagggaaacataagaaaaatacattggttaaagtaattattacaactttacattttaagtttgacctttatgaatctctttctacctgcaaatcattgagatttgtgtttttccacacagtattctccatttcatcaggagtattagagttgaagcatttcttaaaagagtgattttaggcaagtgggttgcctgacctcaggagtttgagaccagcctgggcaacatggtgaaatcctgtctctactaaaatacaaaaaattagccaggcgtggtgacatgcacctgtagtcccagctactcgggaggctgaggcaggagaattgcttgaagctgggaaggggaagttgcagtgagccaagatggcgccactgcactccagcctgggagacagagtgagactctgtctcaaaaaaaaaaaaaagaaaaattatatatgtatatatataaaatttaaaaagtaattttatttcaagttgctgacacctactttgcaagttttgatgtccatgtataggtagtgacaacatcaaaactgctaccaacccaacagcatcttcatttcagaggtgttaaaatgttaaaaaataataataactaaagtccgtctcagaattgatgatattaattgtcttattcgtggaatcaatatatggtatttttagtctgtccccaacatactcttccagtttcctcttcccactactcaatccctcacacttttactccagactatgagattttgtgaactggggcagatgcttttttgactctgtgttgttgcattcattccaatgtaattgccatcttcaagcctttcttacttccccagatggacggggtctcttccgccttgccaccctctgagcattttgtgtatacttatttgaatacttctgacaatttttagtatgcatgttgaaagataagaactaacactatagtacttttgtctgtacccttgctgcttgcacacagctattatttgataaaacttgattaaatatggtttgatatatttccttccttttatttgcttatggagtggtttagagttccagagttgtccagggaggacttctgttactattgcttttatatgacttggtgcccttggtcaagcatcatttaacaaaggatttgttattttgagttagtcagaatatttaagttttgtgttggccaaggcccatgtcttacaaaataaacaaataaaaagctcactaacccaatatttttgtgcatttcatcaggattgaacaatctatttgataaatgacaatttatatcttcacaatttttacactaaaatcatcccagagaccggaacctaaataagacaactaaaagcaattatagaactttcaggagcaagtgtaaagtctcagttgaaatactgtctattgataaaaacattagccaaggtcaaatgcatgtcctttaaaactgtcttctcatttcattactgagtgttaaaattaagagtctgtgtctgaattcctgatgttagtcatgagtcattctatttatagatgttaatgtaattctcaaagagttgccaacaaaggaacaggtgatgaccccctagagcagtgttactgaaaatattgtcagtccaatcagtcacctggcatactgggcagaaatgcagttacctggggtcagagtcatacctttggactcttttgactcccaggattctgagtaattcttaaagaaaaggaagtttgaaagtttgtatttttagattatgatccattgaatctgataccatgaaagatatatttagtgttttcccaatagacctagattaatacccaaattccaatagagctcttgcttctggactgtacaattcaatgctgtttagtcacataattcaaaaactttaaaaaatattttctataacatttttataactagtttttcactattaaattctgtaaacttaatgacatttcacttcaatctatacaggaagttaataacttttcctttgaatagatagaagaaagaaataaaaagagatcattttgtattgtatgctttccagcggaaatgatctatgatatagaattaaataaaaaactttttaaaacaattctgagtcactgcaagcactcagagagatgtgagtcaccataggtcacccagaggatgaagatatagctgggaacagaacgaagatactgtctttctgtcccttacccacttgcctgcttcctccaacaattcaaattcattcattgagtcatatgaccgtctcatagtgttgttgtttcctgaatagctttttattaaggattttctgggcttctagtatactccgcagaagcagaattaacattatttatcttaaaaaagcattggattatttacgaaataaaaacaaaacttgaaaaaatgatcaaataatggattttgatacatctagcaccattgccttgttttatttttattgataaaataagtatgttggaagttatttaatgccatcaatgtaatttgaagaagaaacaaatggaatctatcttgatgagcaactattgtgggttttttttctccacaccatgatttcacctacatgttttctttgcagcttgcataatctatagaatatccatccatgataacataacaatacattggcagctatttgattaccttttgagcgttgttaatccctctgcccagctcttctttgaactggtcatgaaatgaaacattaagtcccatgtcaaccaaaggaatgatagatggatggagactcaggaatccaggagaccaaataaagaaacatgtgtgtgcatgtgtttgtgtgtgttgtatgtgtgtgtgttctttctgaaaattccagttgcatttattatttgcattgtacataataacacatcatcaaattgacctttaattaagtggctaagccatctgagtggcattattgtttagacagttctcatcaaaatttttagtagttctccatttcttgagctagaatttattagttgaatgcctacttatctattaaagacatttgataaatacctccaatgtgccagtcagtgtgccaatcactgtgctaggtactgggattcactggtgtgcacaataattactttggattaggtcaccttttattaaaagattaatgctgttgtcccagaagtgggttagttagttgtcttgggataggtttctgataaaaagatgattttggtccctttccctgtgctctctaatgttttctttacattctaccttctgtcatgggatgatgcagcaggaaggtcctcacaagttgctggcaccttgatattggactttctagtctccagaactttgagaaataaatgtatttcctctttaaattacccagactgtgttattctcttatagcagcaaaagccagactaagacagaaaattggtaccaagaggtggggctgtgccatcataactacctgaaaatgtggaggcacctttggaactgtgtgacaaatagaggctggaagaattcagaggagcaggctagaaaaggctagattactgtaaatggagcattaaggacaattctgatgaaggcatagaagacaggagctatagggaaacctaaatcttcttagggattatttaagtggttggtctcagaatgttggtagaaatatagacagtaaatgccattctgatgagctcccaattagaaatgtagaataaggtattgggaactgaaggaaaggccatccttcttacaaaatggcaaagaagttggctgaattgtgtccgtgcctgaggactatatggaagacagaattgaagagcaataaactaggatatctggtggaagaaaatttttaagtaaaattttgacagagctgtgtagctgcttttaactagttatagtaaaatgcgagtggagagaaatgatttaaagactgagtttatagctaaaaaataagaacagaaaaatttggaaaactctcagcctggctgcataaagaataaaaaagcatgttcaggagagaattctaagggtctgaccaagcaactgatcactaaagagattaatatggatagaaggaagccaagttctatttatcaagataatgagtgaatgaccccaaaggcatttcaaagatttttgaggcaagctaggaacttgagggccagatttccagagaggttcccttaaaagctcaatatttgctgcccaggtctgccatgggactctgctccctgcattctggtgcagtgctctttggctgccccaactgtggctcagttgggcctagatgtggctcaacctgctgctctggaaggtacaagctgtaaaccctggtgggtgtccacatggtgctaattctacagacatgcagattacaagagctgtggaagtttggctccctccaccaagatttcaaggactgttgtggatagcctagtggcccaggaagagatttctcacaggagtagagttactgcagagagcccccattaaagcaatacctagtggagccatgagagtggggccacttccaagatctcagaactgtagagctaccagcttgcagcatcagcctgggagaactggaggcatgagactctaacctaggagagctgctgggtggactgagcccagcagtcccacaggggtgggactgcctgaggccttaggagcccaatgcctgcctcagtatgcccaggttaattctggaactatgaggcaatgttgttttccctattaggttttggacttacttgggactagttagccctttcttcttgcttagtcctcccttttaaaatgagaatgtatacccaatacctgtcctaccattgttttttggaagcatgtaatttgcagacttcataggctcattgctagagagaaatttatctaaggatgaattatgccttgagtctcagccatatctgatttagatgagactctggactttgggcttttgagttgatgctggaatgagttaagacttttgggactgctgggatggaatgaatgtattttgcactgttagaaggacataaatttggtgagcctggagtagaattctgtggtgtgaacatagcccccaaagttcatgtgttggaaacttaatccccagtgcaacagtgttgggagatagggcctagtaagaggtggttatatcacctcttattaaagaattaatgctgttattggggagtgggctagttattgcgttattgggtgcctgatgaaagggtaagtttggcccccttccctgccctctcttatgttttcttccccttctgccttctgccgtggtatgacacagcaagaaggccctcataagatgctggcactgtgattattggacttcccagcctccagaactgtgaggaataaatttatttttttattaaatatccagtctgtatttttccattatagcaatacaaagcagacaaagacaagcgcattacctatacataaagccagcatactcttatctgaaaaaaaaaataattacttccttctaactatctagcttctagcacaggttaggaaaaatcttctttattcctgtccccatctacaataagctaaccattatctgttctatgcaggagctcttcattagaaggaaggcagtcctaaatcttgaaaagcccaggacatagcatatctgttgttccttttgcttaatatgtctgtcatgatatagcctcatttataaatttcttgtgtttcctattgcatcagctgccacactgtgtacttattcactaatttcgtaaaagacactccttatactaaaggctgtcagaaagatgatacatggttaactctcatttttcatcaggtgccacaagccagcacatgttacaatcaagggaagatggagcatccatacgtttctcttcctctggctatagagttgactgttgactgtcaactcctcacagtcacttattcattaattcatttacttgttttaaaataaaatgttttttgagtgcctgctttgtggaagcactgtgctaggtacaagagatgcaatagttgacaaggcagggatggtcctagccttaggaatttcagtttgtcacttgctactcacgttaaatttacttttaacaccattgctctcaatcactgacttctaagttgacagttacccaaagaatagatcactgagaatctctttacacctagaaatatctgtaaagacttacattacaccatcggagtctgccctatcctttaaaagctgcctttgtcagtttccatgcacaggattaagtgccttcatctttttatatatgagaaacatgactcgcaatcttatattctgcttccaattatctgaggactgcacagaagacaatgatgtggattctaatgagacacaaagacctgtgttctacttcctactattccattgcttggtactttgaaagtatttgcaccaagtaaagtgatgccttggtttcagaagcagctctaatggtggctaggggcttaaaagtctctaaaagtggctgtgcctcatgcctgggcaaaaccaggttcactgctggtgaaacaatttgtagaatattgtcattttataaaagtaagttaataagcattcatctgatggtatgtttcaaaaattctgggcatgttctccttaacatgtctcgttaaggaaaagactttctgtaaggcaaaatcgttccctgtactgagaatgtactagccatgtacactggtctaagacagatgactgatggatgagccaaaatcatagactaatatgaaaaggatgttttacagctatttatatacatatgtaattacgtataattggatgatatatttctatattagaagttatatataaagtgcaagtaagttaatgggcacgtgtatattaaattaaaatctatattagttatatattttatatttatatatttaagacatgaagagctgaacaagcagatgtttagcctgaaggaaagaacactagggggacataatagcaaagcacgtgtatttgtgaatctgtttattcaagagcagttagatttgtcctgtatggcctcaaaagcaaattagggctagtggtttgagattacgggaatggattttagctcactatgaagaaaaattttctcaaattcagatctggctagagtaagagtagtctcccctgggagacggtgagttctctttccttagatgtacttaaatataaaataattctagagagaaattcaccaggttcagtggctcatgcctataatcccagcactttaggaggctgaggtaggtggatcacttgaggtcaggagttcgagaccagcctggccaacatggtgaaaccccatctctacaaaaatacaaaaattagccaggcatggtggcgtgtacctgtaatcccagctactcaggaggcaggagaatcacttgaacccaggaggtgaaggttacagtgagcagagatcacgccactgcattccagcctgggcaatagagtgagactgtctcaaaaataaaaacaaataaataaaggaattttggagaggaatcaagcattgggaatgcagtttaaatacatggcctttaaaactattttaagcctggaaatacaggattcctgctgattctcagtttctttatttgtaaattgacaataatattacctgtcttgtcacctgcagattgttttgcagatcggaacagataatatgcgcagtgtcacaaaaatataaggaatgagtgtttctattgcaccaaaggaaattactcattaatgagtgtgaatcagatgtgactaataccacaggttattcattatcatctataagaaacattcaaattaaaacacctaaagatgcaacatgaacttgcatttttgaaactatgtttagagaaaaggatcctgactcactttaaagggacttggattactagtgaatttatttccattttgtgtttaattttagtcatttgtattaatgtcttctttttctaatatgtttaagatgatgggtgaccttacagactggtttttgttggtttattggtctgttggtctgttttgtatgtcttacattaaagaaattatggaaaaggataataatctgtcccagaaaatcctacctctgcaaataatatggcagaattaaaaccatttagagaacttaagttagatttcccagatttatgtattcacattcctataatagtttttattaaactttaaaagttacaaggtttacctgattgttatgcttcaggcagcgcacagatgtatacatgagatattatgttgttcctcttaattgctctttctgcattgaatatgttagtttgttttttcacctctgtttaaatcattacccattcatatactctacaattcctgggtgaactttgggaaaacactttgcttctctgaatgaatagcaaatgcaacacaagaccttggataagctatttaaaagtcaaataagagcctctgaagaatgaatcagtcagcagaaacattatcatggtgaaaacatttcctacttttctcagcatcatcatttattttgttttcctaaaactaattaatatattcaaaagtcaacaaaattttacttattaataatgtgcaataaacagaaacatttgccagaaagcactgcatcaggagttagaagacttggttctgatagttgctaattttgtgaccttgggagatgcattcacttccctgaaccacattttttctcatgtgttcaagagaacaaataatgatcaacccaccatatcttgaggaaggatcagtggggacaatatagataagtacacttaaattatttctgtagttcagtaatagtaagtgaaaccacctacattctttccaataataataatacctaacatttttataattctttattacacctcattgtttattatttccattttataggtgagagatctgaggttcagagggtttaaaatgatctatcaataccagtaaatggttgacccataagtcacctccactcttttgagtgaatacctgtttccctaagcccatattttatacactttggagaaacagaacagcaagccaaggagaacacagaaaaaattatggggagagaggctggttgtcagccttaataaagctcgatgctctccttacttaaatgactgtttcatgtgaccttcaactacaatagtattctaagtggagttaggaagagatttaatgggaggggggtttattgaatccattttcaatgtaatgcataaacatttagtttttctctgttaagtcaggtatcaatcgaaggcagtatttctcaacatgttaataattgtgcatgcctctcaaataagaagagttcttagacatgtttttcataatctccccttaataaaatgttaataacacaaatatacttcatgtctgtttatgttctttggccctttggagttccagaatcattatgctaagattttttcaccccaagacctaattttgtatgatgagaatacatgatggaaggctgagcaatgtatctctgcttagagaagtggcatagatgttgggagcacagcgaggctgtatcagtctgtcttgattcaaatcctagtttagccacttacctgctgtgtaaccttgctaaattacatatctgatctttgtctaaacgagcctatccgtgaagtagggattgtaagagcagcagcatcatattgttactcatataaagtgcttaggacaacactggcatttaggaagagctcaataaatgcttttttgctatattatggaatcctgatttagaaataggaaaacctgagctctaagcctgacttatctgtgtagcacagagtcaattattgctcagagcctcagtttcttcatagatacataactgatttcactcaaaactacagatcgttccaattgcagaatgtagttatagggtctcatctatttatctctacggttaagtgaacttacctatttttttctgttacttatttattaattttattttagcctacgaatttctaaaaatctctgattatattctcatagttttgtcttattgtagcctagtgacctgaacccagaatcttcatagaaaggtactgtattccacaaatatttcctttggaataataatagcagttaatgctttaaaaacattttcaagcccaatattgcactaatcctcaaaacatcttgtgatggagatatttttattcttattttgtgatgagaaaactgataccatagttaatggagtgaagtcaagctatgaggaaggaaatccaagttgtctattcctagaccgaaaatattaattaattagatatgtgcatctgtgagaagaggcttattgcccccgtgacaattttttggcattaaaaaatgcaaaaattgaaacaaagacataaagaagaaactattcatttcctgacttctattatggtatttttttttctcttcctccttgagtgcaggagctttcgacgtgacaaatgtcagcctatcgcagctatccttaggagatatccccaggttgcttggcactagtgcagtagaagtagcagtgagacagactcttggcagtcagtccatctgccttttctgttattgacttcatagttgttgagtggcaggtcttacttatcctgtagctggaagaaatattttttaaaaaacattcatttatttgatgagtatttattgagcacgaagcatatctcgggcttcattacgcaataaccatggactgtcatctcttatctgttccttgttctgtatcactgaggatgggcctcttctctgctgtcactacatttatactcattcattcattcaatgagcatttattgagtagttactatatgctaggtactagggataaagtagtaaggaaaacagtttgatcaaagttcctgccctcattccaggaggaaaggggagataagcaaggtaccttaatatatagagtatgttaaataattttcagtattaaggagaaaaataaaaaatggaagggggatgtaaaatgttgggtggggtgacattttaaatgattggccatggaaagcctcaatgtgaaggtgatttgggatcgatactggaaggaagtgagggagttagctgtggatgtctgcgagatgagcattcccagtggaaggaaagtaggtacaaaggcctgaagtgggggcatgcctgatgtgcttgaaggacaatgtgattaaagtggtgttatcaaggtggcaggaggggtggaggagtaataggagttgagttcagagaggcaataagaggtcaaaccatgtacagccttgtagttcattgcagagactttcgctttaacactgattgatatgggaagccactagaggtactgaacagaagagtgatgtgatcagatttacatgttaacatgatcattttagatgcagttttaagagtagactaaggcaaagcagagagaccaggtaagagatgctgttgacttgggctagagtaatggtagtgggaggatgagaagtcgtcaaattattgataaattttgaaagtataccctgcaagatttgatgagggaccagttgtggagtgtaagaaaaagagaaagaacaggaatgataccagggtttttgttttcagtaactagaagactagagctgtcattagcaatatgagaaacatcatgacctgtcaacatcctttctcttatatcactagatttagagtggataacttcaccaatttgaacataatggcaggatactattatagtactttatccaagagagaattctgagattggtttctattcttgagtattccatgaactagccgtatgatgtatgattcaaccacttactgtaagtctcaaatttattcatttgcaaatgagactgactcagacattatcttctctaagaagccttctttaatatcattgtccaaagagtattcatcaatgtctctactgacctacttctataccttgtataaacttctaatagtccacatattttgtgcttgatatatctgttttccttactataccatttggtcctcaattgagtcttataagtttttgcatcctgtgtacagcaacacatgatagacacttaaaatcttactttagatgatttctgaatttaatgaaaagatgaacatttgtcattgtttcatgaaattcagtgttcatagtataattttagaaaatattatagaagtaggaaggaaatattaatattattgttttgaaatatggattataccacccagagtcactttttttgtggggagagtgtggcagacaagagggacttctttttcaatgccaattcttttatccctaatagtttacattaaactagtgtagtttgatcatgctcgtgattattcttcagaagttaaacctttaacttagaaatcacatggttatctttggatttttttgctctcaattcaaaaatttacatcttataaacttaatttataagaatgtaatgtatttccaatccagtttacatttattgacttcccccccagaagaaatacatttttataataagtataaatgtagaaatagaataatgatgaaaggctcaaggcctgccactaagaaaatctacagtttgcatcatgtaatttagttatactggaaaacacataccacagtgttgcgtcatggaagagcctcaacagatgtcatttttctgtatacagacaatatcctcataatggatattgaatacatgtaaatatatgcaaaatacaaccctgattaagcatattaaaatataacttatactattgatggctaatagatatttttatttgatattgtacagctgataaatgatgatacttattgattacttacaacatacctgatatagtacttggtatttcatatttgcatctttattccacaacactataaactaaggagtatcctttccaatttttagttaaagaaagttgctgctagtgataatttcaagttttcagcccaagtctgttcccaaagcctgacatttttttcacttccaaactaccttccagagtatttcatccactgttgagagatgagatgaccaagacgtctcaaggtcaggtcaccagctgaaatccacttttcacttacttccttcattctgtctagtttagcaaacaacaagcaattattatcatgttcatgaagagtgggcttttttgtactaatattttcagggctagtcttggtgatggaagctgtattctgtgactatattgactgaacttgaatacttgctaacaaatatagtagtgggattcatcgggtctcaaagttgcttttaccctatttgcaagttagcctgtcactgcttcatggatgaccacaaagagctttattcctggtggcttgataggcagcatgaccctcagcctaagtccttgcttctggcctccatatctcacagggatgatcttgatggaagctatacttacaaaagaatattgagctttagaaatccactcattttattgtaagcagtaagcaaacctgctctttgtctggaagggtgacattatctcattaatcaagattgttcctggcaaatacactctgagaagtggccagggaaagaaaagccaaggccttacttacatgctttgcactcctaatgagatgtgtaggagcacaagacatccatggaggatatctctccccactggattcttgtatttctgaacttcaagaatctaatctttcttagagacaatgttgacaaattagtaaaaccataatttcaagtatccaaattgtaccaatggaagatagtaacgttttgctaattatttctttgtgtttagatattaatcccaaatggcctgggtgattaaattaggttaaagtatgagggaaaagtatgtttagagctagaaagagagtgacagagatggagatggatggataaatttttgatccattagtctgtggtggtaatgattatgggaatgagacaggaagacaggaagataagtagcattgtgtatttattcattctttatctatttaatgataaatgtttgtccaacaccagcccccattctaggtcttggagagaacagccatggacaagaccaacaaggtcttcaccctcaaggagcttacattttaatgagtatagtaaggaaacaaacatgcaaacagtaaataggatcagaaagtgacaagtgctatgaagaaaactaaacaatttttgagtttactttagttaccatgttcccagaagacttctctgaggtgccaacatttgagcgagtatgtgattattagaagatagctatacatatactacatccacacacacacacaaaaaacaacaacacttcaggatgagtaagtattctgggccaaaggaatacatagtcaaagactgtaaagcagaagtaagctgggtatgtttgaaggagaacaagtatgtcaacgtggtggaaagagagtgaacaagggtaagattaagagaccatggagaaaaaatattagtcaaggggatggtcaggtagtatctttggggaagtcatggtaaggaattttgtttgtcactgaaagttttaaattatgatgtgatatatttggatttatggttaatatgggctacactggctccttatggcttggattgtggaacggattgcagttggacaagaaagaacacagagagtctaataatgtttgcagaacttgagccaagagaaagtacattttagggattacttcgtcatgagagacaaaaatatattgaagttagttgaaacagcaaagaatttatcgtaaggaagatagctcatgaaaatcaagggcagaaaggtagtcagtcgccataagaaactgactacatattccttttgcctagaatacttactcatcctgaagtgttgttgtggtcattgtttgtttgtgtgttgttgttgttgttgttgttgttgtgtgtgtgtgtagtatatgtatagctatcttctaataattacatattcattcaaatgttaacacctcagagaagtcttctgtgaacatgataaccaaagtcaacagaaagctatcaggaaccaagggattcattcgtattcatactctctttctcgtcctctttccctccctcccttcttgcctatagactttctctgctttggtaatctatggccaaccagaagttcttcagctccactttacgtaatttcccagtttgaatgcatgagaatggttacatatcttctctgaatctatgttcaaatttcactgaagaaactcttcacttgatttgccctgggccatatgtctacttctgatccaattggtcagaaatgagctgagctagaatacttaaattgggatggcaggagctgtgagagcacagttatacatacaagagcatgtacagtattggcttatagctcaattaatttctgcctcagctatagaaatataaaggaacaaatgtgttggctgttagtagacttgaatgcttggctagggttgacagaaagtaacaggttttgagtaagcagcacaatttagtcaagtaaatgggcagcttgtgattaacagtgtcagtatcatgagttgtataaattagggatcctcaaggtctcccttggtgttcccacatgtagaaaggttaaaacaaaagtgatattcaaaaacaggcaacagatatatcttacgatatgttggtaaagcctgaaataggcatctggagtgacaagggtaaaatcaggttgcagtaataaagaagttggtcagacaggtctgtagacctcattgaagaaggtgagtttaagcaaaggtgcaaatgaagtgaaacaaaggcatgaatgaaagacacaaatgaatctgcgaaacaggtatctgtgggggaagcattttaggcagggcaagtaggtagaacaaaaccccttaggtaggaatatacttgatcagtttggggagcagcaaagaagccagagtggctacagtgcaatgagttagtgaaagaatagtaagaaagaaagtcagtgaggtaatggagttggaggaagtatctcgtgattggcctgtaggctccctggactttggttatttttcagagcaaaggatagtcattgcaggactttgagcagaagacatcatctgtaaatactaaattttctcatataaacctattaaaagtacatacatcctatgaagtttgtatattaaaaaccagaagatgcactaccagaaaaatataatggaaaccattcttccagttatttccgtattttgaatgtagagctaagttttggtggcagattggaggtgagtgtgaataaaagaaggaaatcaagaataagtccgagtattttggcctgagcaactgaaaaaatggacttgccaccaaccaagatgggaaagactggggggtagaatagttggagggaaataaaagtttagtttggacatgtgaaccttgtgatgtcctttaggtgtccaaatggagatgccaataggtttttgagaattttggagagatctggtctggagatagaagtttggaaattgtttgcatataaatggtatttaaagccatggcttcactgaggcagtaagtgtagatagaaaagagaaggccaaagattgctctggggcatccaacattaataggtcagggagaagaggtggatctagcaaaagagactgagaagaagtgatcagtgaggtatgaaaagacatatgagtgtgacatcttagacattaagtgaaggaagggtatgaaggaagagggactgataaactgtgccatctgctaaggtaagcactgataactgaccattaggtttagcaatggtgattgctgaccattggaggtcattgctgaccttgatgtgggcagttttggtggtatggtaaagtgaaaacttgaccagggtggatttaaaagagaatgaaagagaattagagacaataaatatgagtccatgcttttgaggtgttttttggcaaaggaggcacagaaatgggactgtagtggctggggaagtgggatcaaaagaaagtatttatgagagtaaaaacagcatgtttatatgctgatattaacagtttagtagaaagggaagggtggattatagaggagagaggggaaattattagagcaatgggcttgaatagatgataagaaatattatctagtacataagtagacgattaataattttaatattaataattagcaataatttatctgggaaagtgtttctctattaattgcttagagagtttttcatcactgctcaaaaaccttttgtagcagcccattgcctattcaatccagcctaggaacctcagcccagcaggcaagatggttgtactctgacctcagtgtaccttactggcttcatttccttcagttctccctcctgtgcctaagttaaagaactttcacattaatctttgtttctttgtgtattgcatgcgatagactaggttattcagtaaccatagacctggtgctgaagctacaatacagctagattgcattctagattgttcccaatgttgttcccatgttcaaggatctcatgtatataaggcagcataccaagctagtgcttctgattttaaagtaataagagatttttttaaaatttgctctgaaggcaattctgaaagataagtttcaaaaatatttgaaacaacaacataatcactggggcattttcacgctacgtgcttttttttggtctttaccattttattttgaaataattttagacttagaggaaagttacaaaagtagtcacagcattgacgtatgtcctttaccctgcttcacctagtgttaatatcttacattaccatagttcaattattgaaatctggaaattgttatcgatgaaatactgttaattaatttaccaaccctaagtaattccattagtttttccactactgtcttttgtgtggattaggatctgattcaggatcagtttgttgttatgtctctttagtatcccctaatctgtgtcagtctttccttatcatccatgacgttcccattttcaaagagtaagggtcagttattttaaagaacgtttgagtgatgtttccacatcacgggattcaggatatgtaggagaatactctctggaatatatgagccaggatgcatttgtgcaaaaagtagtaatatgttataggcaaacaatataatcttaaagaccacattttaacagtttggggctggtttttttccccagtttaaatctactgaggatttcctattcacaaataaaaaggtgactcagtaaatcaagcaaaaaatgcttgagagtatgaagtaaaaacatactgttacgtgcttcaggaaatacaaggaaatatatgacataatcctttacttcaaatactgtacagtcaggctatggtgacaagacatagagaatatgttcattgttaatgaatttcttcactattaaaatgtatatgcacaaaagtttaaatgaaaagcattttaacagacaaatttactgctacagtaaaaggtatgtctacatgcagacaacttgctatcccatgcttaggtaaaggaagagacttatgcaattaaattacattattctgtcatccgtgtcactccagtcttttttctttctaatgttaatatccacacttgccctccatgtaaatatcagtgtccagtggttctatttctcaggaatttctctttgttaagccagagtaatcagtagtctcactccctatggtcttttagtctggactacaggtgactaaatttttacagctgttcttcttaaccttatactcttgagttttttgttttgttggttgtttttccctaacagtaagccatgttgcaaacttcctaaccagtttctccatcattctttttttccccagcattacccaaattatacattacttgtatgtagtataaaatctgcctttcactgcctttcagttgagtttaccataaaacgtttgactaggaaggatataaaaatttgtttacactatttggaaaaggagagaaaattctctgaatggggtaagtggattcttggttggaagctcatgttggataaaatgaccactcaagtgtttttttcagctctaagtcaggatggaacttaatggcacagcacaaatcggctgttgccacaactgggcaactggaaaatgccttttgatgatggtgattaaataaaggtcaaagaatatcactgcatcctaatggtagtcatcacacaacatcagcctttctcctggtgcctttgaaaatgtcacttgaaaagtctaaaaaatgctatgtgttttgtttaggcagaaaatgccctcattaagtacctcatgttttcgttagaaaaatcaaagaaatgttagggttctgagtactagattgtaggtttaaaagaaaattaaatgtaaccttttgttatgtaaaataataaactcctaaagtaaccataaaggctttatttttacacaaagcgtatgtctgttttctaaaaggctctaaaaagagccatgtgatatgatctcaaatctataggatgaaaaaacccacgttactgaagtagtagttaaccgtgaataatttctagtggaaagtgaagatttcttaagagagttattttcattttttaaggtatgaacttgagcatttgcggtcttgtcagggacagtagttttagttttgcctactcagtactcttaagaaaaatcagatacggagcctcattttctttcatattctgtctattcctctttttttttttgccaccattataagtactatagcccttatcaatggaaggcagaaaggatgtccaatttaaaagcaaaagtttacttagttgtactatgctatcatgaatctagttatatattatatatattatatataatatatgtattgtatatttatacacacacacacacacacacacacacacacacacacacacacagtatttcatgtaaatttcatgctaatgttcccttaggactgacaatatgtggactacgtaatctaaagttttgtttttttttttaatttaccaggtaaattgacatccccatgtgacaggggtaaatcttatttctcaaagtatgcttggaagtcatgagctttcgaatgtctgatcatgaacagcagcatactactggatgtgtagcttccagtgtctaggagggtttatggtaatctaaagaagcacattttaaagagatgcctatgtacattcaagtatgagaagtatttctttagattacagtgttttgggatacaaacactggaggtgaattacctgagagtaatatataaactccaataatctcaagaaggtatgtcaagggtagacaaatgatagctgcaattctaaatctggcctattgactatttttgtatggccttcaacctaagaatagtttgtactttgtaaaaagttgaaaaaaaaacaaaagaatattttgtgacacatgaaaactacataaaatttaaatttctgtgttcataaatgaagttttattagaacacagccatactcatttgtgtattatcaatggctgcttttgtgctacgtcagcagaggtgagtagttgtgacagagaccccatggtctgcaaagctgaaaatatttactatctatccctttccagaaaagcttttccaacccttgagcaagatgattttattcaattacttagattctctgtgcttcagtttcttcatctgcaaaatgaagataataaactgtacctatttcatagaatttttataagagaatgaagaggcagtatagtgtaatgatcacagacatagattctggaacccaaactgtctgagtttaaatcttggtcctctgtttaatagcttttggcctaggcaagttacataacatttctgtgcctgtttccttatctacaaaataaggaaaatatagtactagtacctacctcataggatttctgtaaaatcaaatgagttaacataggtgactcttgtacagttgacccttgaacagtgtaggagttagcggtgccaatctcccacacagtcaaaatccatgtaagacttttgactccccttaaaacttaactaatagcctactgctggccagaagccttacttataacataaatagtccattaccacatattttgtacattatatgtattatatactgtattcttacaataaagtaagctaaatgaaagaaaaatgtttacgaatatctaaaaaagagaaaatatatttaatatttattaagtggaagtggatcaacctaaaggtcttcatccttgtcttcacattgagtaggctgaggaggaggaggaagaggtggggttggttttactgtctcatgcgtggcagaggcagaagaggtggaggaggtggaaggggaggcaggagaggcaggcatacttggtataactttctggaaatatatcatagtttctgtctgatgttttttactttttcagtctctaaaaatgtttctgtactgtactgtaccaatccttcttccactgtttgctttagtttcagtgcccatatcttatgagtccattttgaaaatgaatcaaagaagtcttgaataattggaacccttctgccagattttctaatgtcagtttgttttctggcattgcttttcttatgccttcttcctcattgtctggcactggttcgaaagcactcatctccatcaagttgtcttctgttaattcctgtcttgtggtattgattagctctttcatttcttcaagattcatcccatgaaaccctttatttctcacctttctttttttgccatatccacaatctctttcatgagttctttgattggctctgtcataaattctatagagttgtgcacaccctctgaacacagtttaatccaggatgaatttcttgctttgggctttatggctttcacagctttttctataacaatgatggtagcttcaatggtgcagtccttccggattttcttgacattctctttatcagttttctcttgcataacactgacaactctttccatagagtactgtgtgtaatgaaatttaaaggtccttatgaccttctgatctagaggctgaattagagatgttgtgtttgggagcaagtagagcatcttcagttgaactcatggaggtctgggtggccaggagcattttccgataccaaaagaacttttaaaaagcagtccctttctggcaagatacttcttgaattcaataactcaaagcgttgatgaacccaatcaagataaagggttatcgttgtccagaccttcctgttgtgcagccaaaagactggtagctgatgtctatcatttcccttcaaggttcagaggttagcagctttatagataaaggcagtcctgattataaacctgactgcatttccacaaaatggtagagttagcctaacccttcctgcctttaatcctggtgctcacttctctttctcactaataaatgtcctttgtggcatttttccccccagaatagggcactttcatctgcactaaaaaaactgttcaggcagatatcctttctctagtgattttcttaatggcgtctgggaacttgtctgctgcctgttggtcagcagaagctgtttctcctgttgtcctgacattttaaagccaaacctcttgctaaaattatcaaactgtcctttcccggcacctcagttctccaactttagattcttcaccctccttttcctttaatttgtcatataatggcttttctttttctggaatcctatttgagtctgtagctatgcctttcttatagcaatattgtgcccacatgaaagcctcgaggcattttgcaaagtgcagtgtttctgtgtttgccaacagagctgcagccacgactacacaaattttcttttctcttttcacaatggtccctatgctggattcacttatcctgaaatggtgggcaacccagctgcagacctcaatctacagtacatatcaagcaattaaacttctccttgtaatgtcatgacttttctctgcttcttgggagcacttcagcatcactaattacactttatatgggtcctgtggtgttattcacagtttacggtattgtaccaaacatgatgaaaagtacactagaaccatgagaaatcactttttccctgtgacatgtaatttactggagagacagactgctcacacagagacgattaccatctcatggtgttttaaggcatactcaatacttgcaacacttgagctcaccacaataacaacaggaggtgggtacaaaattattatagtagtacagtacatacatgtattactgttaattttatgcagttatgattgaatactgcatctttatgtttgtttacttttctctagactttgaatggctctgtgtagggtcttcaagtgtgtaagttttaataaatttcaacttttataatagatggtgtatattttatggtaataaatgataaaatagactagtatctaaacatattttatgcatttgtgacatacctttttatttttttcaatatttctaggttacaaagttcatctacaagtttttttaaattatcacaaatctccaaaatattttccagtacatttattttttaaaattcacatgtacctggattctcacagttcaaatccatgttgttcaaaggtcatctgtagtgtctggctttaatagtgtaatttttttattattggtgatagtattgtgattgttttcatctacctcacaagattattataagaattaaatgtgataattcatgtgaaacttagggctcaataaatattagctgttattgtttgttattgatgagacacatttccagctgtaatgtacaggtgtatctgtgattctcatgttgactggggattggatggctgtcagaataaaagggagtaaaagggaagtaaatttaaaggccttccatatgattgatacaatatttattcctacatttaaaatcatcggtgacactgaccttaacttgacagtaattattaactagtgctagtgtccttattgaccttgttatataaatagttgagaatagtttattatcagtgtgcgaattttatgtaactggtcattctacaaagattgagtgtgactgaaggagtccttaactttttgtgtttatatcattatttcacaaagcacactatccttaatatattaaaaaaaataaactgataagccttctagccaaattgccgtgaattcaaaattactggagtcaaagtagattactttttattgtattatatattttaggccatctcaaatcaccagaagttgacaaagattacattttaattcacacttgcaaagtagaataaaagggcaataaaaaaatctcatggttgaattcttttgtgtcagaatagtaagtaaggaagttcttggcaaagagagtaactatataaaaaaggatgaagtgaagtgcttggctggtagagaattttttgtttagagataaatactggacttagttaaatccagaaaaacagaatattttaggatgacagttgggtaagttagagtgagatgtcaatgcctttgaggtaatcattaaatttaacataatacgtatgattaattctaaaaaataatttgtactattatttaatttttcctactgcttgcttttcattataaacccattatgaactttagcagtaagaaaaggttttcctgcaagcaagatttaaaaattagaataggtttctaagaaaaattggacagtgtgtatatacgtatatgtgattgtgtgtgtatactttgttataaagtaggaaattaaatttaactacatttaaatagtctatgatagtttgtttcttatccaattctcttccagtcccatacttttgataattcatagatatcctccattaaatactatagcaattcaatacccagaggagaaaaagtgtgacttcctcagaggagaaaaagtgtgacttttcaataggttgtttcacttttacaattccatcctaactaaatactacattaacataaaaaactacaacaacaataattagctttttggatctaaatattggcctaaatatttagaataatacagtgttagtatctgtcttatattgtctgtttctctaggattgtgcctgtttaaactacttttggaaattagtaccaacctaatgctgttaataattatgcatgccatcatgtcatgatacctaatggaatcataagttaaagtctttcattcaattcccattaacatagtctatgcactgtctcatctacctaataagtctttattgccttctgtagtataactttggattttctctactgctaataggaaacaattacttccactaaattcacttacactgttgcattgtataattccagagagcactattgcatcattgctccccaccccaatccccctggtactgtgcagtacacagcctgcctgaccatccacagcagccatgacattgctttctttgcacaagcacagaggaatacaatttgaggtatttatgtttactatttagagacagacaattaattgacataggatttacataaactagcattttcataaagatccagaatttgataacatgacttagttaatataaatttaatcaatattcacatctgttttattctttggcagttcatagttattcctaaagtggaagcggcacttgggaatataaagatttggactttataatttactctccaaaagattatagagtttttactttgatttaaggaacaaacgtgaaagactttactggaatgtaaatagttttggcatatttacagtgcaatgttttcagttgtgaagttggttagttatgtaggcgggagctgtaggagttgtgatagtcagtatattacaagcattttgcaactccctgatttctctatgtttttaacaactatggtagcaatgcctcaaatttctgggatcctctgttaccccacagtggttccaaaagaactgattactttttcattaatcctcaagctatatgtgataaataattgggaggatggaaagatgatggaaaagaggaaaaaccttgaaagatcaactgattttgttaataccacacaccaatatgcagacccagctctgatctcttttttttctgcattgtgatatttgtccaattatcttgcttctaaaattcaaacctattatagccatttcattttctgcattttttctcatttcagtgtaaaggccttgtgggagaaggttttactttagtctttaacttggcatatggaaaaatattaactgctatgtgtataataattctcctttttttccttaaaatgctatttcctttgtactactaatgtactttgattggttgactggatattgagtgttaaactatagaagtatttcagaccacttgagtgatagctttgcttcattctttcgtgtgtttctatatggttttataaactagataatgctacacaataagggtttactgtgagccctcagtaaacccttattttgtagcatagcaaaatgtgctccaacaatgggggaggtatctggctttatgcatcccttccgccaatcaccagccatgtaaatttatacagtcacataagatttctgagccttaaattcctcatagaaataaaaaatacctgccttgcctatctcacaaaagtttgtgtggatcaaattatttaatgtacatgaaaaaactctttagaccaataaaatgtcatatgaatccaaggaagagaatgattgaatacttctcaaatgaattaaggtgacagttatcatataaaaacttcattgcttcaggtcactgagtaaaaataaattggtaactctgactcctacgtaactatccccagcactgttaggacagtgtatggcttaccaagtaaataaagaaaaccaggtaatagctagaactaagcaagaataatgaggtggataacagtagcctctcatttctttgaaaaatttatgttgtgctgatcataagacaggcaagtgctttagtaaaacatactcagatcttagaatcttaaatagttgggccgttgtcacacataagacccttaatgttacagactggagattgaatgggaaggccttaccatgaagctgtataacatggttttctgctacctacttaattcggcatgttaaatttaaacaaataagcttttagaaaatcatactaaagagtttcaacaataaagagaggctgactctcagaaatataagacaaccagatacagaaggcttttcaatattgattttttaaacataagaaaactttctaaggccatattaaatggttctccaataaagtgttttaatagctccagtaagaacatctgactggctgctttctatgtgagcaggacttgattgaaattgaggaaaagatgaagcatctttaagctagagagcccggagggtaaattattaaaatgagctatggagaattggggagagcttgcactcaaatttagtttttgagaaggaaaagtacaaatcattctatacatggaccaactcaattttgccacctgttactttaaaattttaacctgttttactttgaaaacaatgctaaaacataacttgatggactcatagtttgattcctactaggtcgatattgtgtctcagaattaaattgtccattaatttttattgtattctgtagcatcttccacctaatagtgatgcaaatgaattatgggtagatgaagtaattctaattttcctatatacttataattctcttgggcttccatgagcagaatatgtaagataatacatttgagatactgttatcagaaaattggggataggagagtacacatgaaaaaatgacatgtacatagtattcaaggatgccttcattcattcattaaacagacatttattgggtgccaaatctgagacagaccccttgctggtttgcatttaaatatatcgtgggtatttaatgaggaaaaaggtatgaaattgccaaaacaacttagagtaagtaacatcaagctgccctcatggcctttctatacttccgcatcttggtggaggaagtattagtgataggggctgtgaagggctgtggtatgggcatgcctgctccaagcccccagattatctggcagaaaagaacgaagagcaagaattaaaagccctccccaagggatccattcaagtaaatgttttagcaatgagtgagtgagatgatgaggcagtgtgggatattgggaagaacaagagttaggaactgggggaaaaaaaaaaaaggctcaaatcccatccatggcccctgcaaagctctgtgatgttgagagagttacatcgattttctgaacgactatttcttcattatgaaatggagtttaaaaaatacctactactcaagcttgcacacagtgtcccgcatagtttttggcccatggtaagtaattaataaatatgatgtaattaataaatatgactttccttattactgtattgacacaacaatatcagtagtatagtttgatgagcatcagatatccatagacttaaataacagacaaaatacatctccttcatctatcttattaactgtagaatttcttttcactcattttgattcaaattaagtatggaccatctgttccaggcttcaaaaactctttcaaatgagcagtggttttacacatgtcatgatgtgtaaaaatttagatcaatttttttagtaatgagtacagagtgtcttaccagatatcatttcctaaacacttagttgtatgagctttaagttactatgaagataaaataatcttcacagttaatgacaccgaacatgtgaaagtgctttgaaaattgtcaggcaatatcctaggtcacttggtcatctgactccataggaaaatatggcagcaacagcttgctctaaccattaggggaaaagaaatacaatataccaataggtatattggtatattggatattgtaaagcaaatatcatgcttcacagtagtcagctgagaatgattcacaggcaagctttgacttgaggttatgggcatttctatacaaaagaaagtgtcagtcagtagagagttagtagcaatgaaaagacaaaatggcaactttgtgagggacgcttgacctctagtgccatctggagtgggggacagggtggatatgaccatttaaacatgattgaatttagaaagtatttcctgataatgtcattattaggaaatactttaatgtagccattaaaaccatccacttaactgggctcggtggcatgtacctgtaatcccagctgtttgggaagctgaggcaggaggattgcttgagcctagaagtttgaggcaagcctgagtgagacctcatctcaaagcaaacaaaaaatccacttaaccccatctgcaccaagaagtttccgattataatatagttatgaattattagtttgcatatggtccaatgaagtatctggtccacttgaaaacatttctatttataaattaatgacttggcattgtgatcttaatgtattagtcttatggtaatttgattatatgcagattttctcccatggatgaacaaccaaatttccaagcccacagagttgaggaacagattctgagaaatagtgatgtcattataagctaagggagactatctggggaaccaacctcccccagataaccttgctgaaaaccttctcattcaaaatgaagctattatatcctagactcaaataaaatgattgaatgtacatttgattttgaagaactcagcccaagggaatttgaatcacttgttagtctctcactctgtttgtaaaaatgtatgactaggaaatctagattcccttgggtatggtgatgatttctgaggtacaacactaatgacatgatccaaggaagaaaaaaaatgataagctgaactttattaaaatagaaaaatgtctgctctgtgaaagacattgtcaagagaatcaaaagatgagccaaagactgggagaaaatatttgcaaaagacatacctggtagaggacctttatccaagatatgcaaaatgctcttaaaactcaagtataaggaaaaaataggacaactatagttaacaattattgtttatttcaaaataacaaaaagagtagaattgcaatgtttctaccataaagaaatgataaatgcttgaggtgatggatagcccagttgccctgaattgatcattacacattgtatatgtgtaccaaaatatcacatgcgctccataaacatgtattaatacaactattatgtattcataataattaaaatcttttaagaaagcaaacaaaagaaataaaataaaccaattaaaaatgggtcaaagatcttaacaccacactaaataaaatatacagatggcaaataagcatatgaaaagacgcttcatatcatatgtcatcaaggaaatgcaaattaaaataatactgagataccactacacacctattagaatggccaaagtccagaacactgacactaccaaatgctgacaaggatgtgtgacaacaggaactctcattcattgctaatggaaatgcaaaatggtacagccactttgggggacagtttggtgtttttttaaaaacaaaaacaaaaacaaaaaaaaactaaacatatacttaccacatgacccagcaatcacactccttggtatttatccaaatgaattctcacagaaacctacctactgatatttaaagcagctatatttataattatcaaaatttggaagcaaccaagatatccttcagtagataaatggataaataaactgtaatacagccaaacaatggaatattactcagcactaataaaagagctctcgagccatgaaaagatagggaggaaacttaaattcatattgctaaagaagccaatctgaaaagactacctactgtatgattgaaactatatgacatttgaaaaaggtaaaactatggatacaacaaaaaaatccattgttaccaggggttcaaaggagagagagataaacaggtagagcatggataatttttagggtagtgaaaatactctgtatgatactacaatgttggatacacatcactatacattcttccaaacccatagatgttcaagagcaagagtgaatcctaatgtaaactatggactttgcattattatgatgtgttagtataagtttatcaagtgtaacaaatgtaacattcttatctccccctaaatgttcagcctctttagtagaagagccatgcctcacttagtttttgttttgtaggacctagagcagagcactcaataaatgttttttagttcatttatcaaatagttattccattgattaatcaagcaaaagaaaactgttcacctatttcagagtgttagtctcagccatttgttttatacatttcaaagaaatgttacttaccatatggtccagcaatctcattactaggtatataggcaaaggatgcgaaatcagtatgtcaaagagatatctgcacttacatatttaatatggcactatttacaatagctaagatatgatctatcaatggatgaatggatggagaaaatgaggtatatatacatgatggaatacaattcagcctttaaaaagaaggaaatcctgctatttgggataacatggatgaacctggaggacattatgttaagtgaaataagccaggcacaaaaagacaaatttgcacagtgtcactgatatgtggaacctaaaaaagttgatctcataggagcagagaaaagaatggtggttaccaacagctgggacagagggggtgggggtggagtttgaggagatattgttcaaaggatacaaattttttattagacaggaggagtaagttcaagagatctattgtacaacatggtgactataattaataatatactgtattcttaaaaatgctaagagagtagattatatgtgttctattacaaaatcacgagatatgtgaagtaatacatgtgttaattctcctgatttagccattccacaaggtatagttgttttaaaacatcatgtagtacatggtaattatgtaaaattttatctgtgattttttaaaaaataaaataaaacatttttaaaagaaatgttacattacaacctctaattgcttccacttttacatttagctaatttcacaagctgcacgccatgtttcaaattggttttcttctagcaaattgtgcatgtgtgtattctctcagatatgaccttccaggttttagagtccactatgtcaagaagtaagacatattaaggaatctgatcttggtaaaaatttccagagtctacctacttgtcttttctaaatttgtttaatcagatggaataaattagagaaaaatactggtcgttttgtgaatttttaacaattcctttgtcttttttgcagtatttcaattacataagtagtaaaatttgtgtttatatgttaagttgcctgaaactgtggaaaatagacctatttttatttatattaagagtttttgagatttcttgtttcaattttcatttatattcctgtttaatttacatgcataaaatgactcttttcgtcttgtcatttgttatttaggaagaagtaaaatttgtgggtttccagtatagtacagcagttaaattcatatgcagagtaacttactgaaatgacaaggtagatgttattgtattataataagttataataattatatggtaataataccttcaacatcaatgtagtttttaacctgaaaaattttgaagttcaacgaaacaacagctttgggtaatagtgggtaaatatcccaaatattgtgaggccttccttgaatattaatccagacacttttttttttttttttttttgagacagtgtctcactctgtcacccaggctggagagcagtggcaggatctcagctcactgcaaacttcacctcccgggttcaagcgattctcctgcttcagcctctggagtagctgggattacaggtgtgtgctaccacgcccagctaatttttgtatttttagtagagacggggtttcaccatgttggccaggctagtctcgaactcctgacctcaggtgatctgcccgcctcggcctcccaaagttctgggattacagatgtgagccaccactccctgatctaaaccaggtatttcttttttttttttttttatgctgtttattttttaatttttatggatacataacaattgtacatatttatgggatacatgtgatattttgttttttttattatactttaaattttagggtacatgtgcacattgtgcaggttagttacatatgtatacatgtgccatgctggtgcgctgcacccactaactcgtcatctagcattaggtatatctcccgatgctatccctccccaccccccaaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttctggctgcatagtattccatggtgtatatgtgccacattttcttaatccagtctatcattgttggacatttgggttggttccaagtctttgctattgtgaataatgccgcaataaacatacgtatgcatgtgtctttagagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagttttcctatttctccacatcctctccagcacctcttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctttttagtttaattagatcccatttgtcaattttgtcttttgttgccattgcttttggtgttttagacatgaagtccttgcccatggctatgtcctgaatggtaatgcctagattttattctagggattttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagttatgtggcattatttctgagggctctgttctgttccattgatctatatctctgttttggtaccagtaccatgctgttttggttactgtagccttgtagtatagtttgaagtcaggtagtgtgatacctccagctttgttcttttggcttagtattgacttggggatgcgggctcttttttggttccatatgaactttaaagtagttttttccaattctgtgaagaaagtcattggtagcttgatagggatggcattgaatctgtaaattaccttgggcagtatggccattttcacgatattgattcttcctacccatgagcatggaatgttcttccatttctttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttaaccaggtatttctaatgctgctgtgtgatttggcagagacgggataagccctgagagagcacaccccagcagtaccctcacttgggtgagtttgagcaattgccaggaaagctcagcattgtaagttttcccaggagatagatttcctttaataactatgatatgtgccaaaaatacaaacatttgatattagtgtatctgacatatatcatatcttatatgtagtagatactaagtaaatatttattggttgcttgattttgccattttgaggactgtattgatatgtttggaatattaaataaattagtgatgatatagacaacacaaaatatttatatgtattaagggaattgttctgatatggtttttaaaaaaatttcaaaaactatttcattttttgaaatagtcttctgtacttatcatgtttagttttatgaaaaatacttgcattctgttggcttgagttttgtgggctttattaacaagggattcttagtccttttatgtgctgtgattttgggaaaataatttaaccttttctactgcatatatttctcacctatcacataacttttttcctgtacataaggtgatcatataatttttgtccagattgaaatagttcagagagaatgaagtattattaaaaattataccaggacaactggcttaaattaaaccatcccaggcaaattggaatgtgggatcacccaaccatagccccattttcattaaataccacaaatctttattgagtactgttatttccaagacattgtgtttcagaccacagatttttaaaaaggaatacctttccccttcaccagccatcttcgccaccagccagcagtgttctgctttgatgtagtattttatttgtttttctttcaacaatacgttacctgcttaaagtatttgaaagccactgatggattagagtgcaggaatatggtcagtgtcatgagagagatttaaaatgctatgataaacagaggtaaaggaaagcatgtcttgtggaaggtaggaggatgcggtatttgattgattgattgattgattgattgatttttgagatggagtctcactctgctgcctaggctggagtgcagcagcatgatcttggctcactgcaacctccgtctcccaggttcaagctattctcctgcctcagcctccctagtagctgggactacaggcctgcgccaccacacccagctaattttgtgtgtgcatatttttagggaagatggggtttcaccatattggccagactgatctcgaacccccaatctcaaatgatcctcctgcctcggtctcccaaagtgctgagattacaggaatgagccactgaacccagctggatgcactattttaaaagagtgctttttaggatgatccttgagggatggtgagaaggactgaagatggaaatgtaagtgggcaagcaccccggggaaatatctctggccaagagtaagccttctattctgtcaccttggcttggaaagcacaagagaaggataagatggatttggcgtgtttagcgtgtgtggaggggggagctgtaggagataatgccctatagcattatggagggttggtgagccaatctgagggatatatacatttatatatttatatgatttatttgttattaaacaaatgatagtgctcagccccttcgcttgtcctgggtgtcctatctgcctttatactgactagtgtaatctcaatctggggttatcattcatttccctctgctcttttcagatctgcttcctcgacgctccgctcaatatgcaggcatcctgatttctactgacttgcaatgtgatagtcacagactttctcttgtctgcctcctttctgggaggagttatctctgccaatcttacttagatactggccttgctttcctttctttttcattttcttctgacttctaatttatctttgttcttccatgagtattcctctcaacagtttttagttgacattttatttcatttaacacacctgtaattaatatgtatgtgcagacaaacatattcatttgcctacagacaaacacatacatatacccatacaccagtgtgagcatgttgtttttccttgtttttaagtaacctttattttcacattttaactaatctgaaatagaactcttttaaccaatacataccattaatgtggtgatatatctcatcttcctaatccccataaaaacttcctatatgatctgtggcattttagaagtgtgcaaatattggtagtgtgaaatttctagttttcaagcctgtgaaagcaagcagtggctagttgaattatgtgtcacacactttgatacacttctgccgggtgaggaccagcaatatggtggttagaagaaccacctccaggggcacatggtctgctcctaatgtgtgtgacttctggcaattgtgtcaacctcatgtgcttcatttctttcctgtaaaatgaagctaggaatgagaaattcataggtatcaattgaggtggtttacgtgagtgtttagatcaatgcttaacacatgctaagttatctttgtcacctttagtatgttacctctcaatttaacaatgaaaaataaatgaaaaaaacaaaagtgatataaaatgctatctggctatattttattggacacaccagaggttctcaaactttctgggtttatccttatctcagaattttgtatggggcccccaaactaaaataaatacctaacattttgtgtatgaaataattaggtccagacaactgaaagataacttttgcctgatgtccatctgatatcaatgtgttttctttgaaaatttaaaattcccctgataccctgaggtgcctgggtcacagtttgggaatgacagaggaactcatttgttcagctcttactttctgactgctatttaactcatccaactttcagcaagtgctatgtgttgctaattcatgacttccctgtctccaaaacattttgatctctttagatagttagctcagaaggccctcagatgaaaactttaaaaagaaagctaaaacttcgggtaaagtgttgttttgtgtccaatagcctcagagaatctaaagcaaaatgggaggaaaataagagactaaattctcagtgtgttcactatatcagttacagttgcccttaaaacctgggaatacctgcttttatggttctctgaggttctttggcaggcgtaccaagtaggagctacttgaaggtcacctgcacaatgatgtgtgtaaaaggaatgtcttatgtttaccattcccccctccaggctctggaaacagacagcaatataacattaacattgtctgcttactgtctttcagatcctttacaagcttttaagttactgtctacaggtatttggggtataagaagctgattaggtctttgggataagaagctatgcctcatacaccttaaactctcaggccaattaacctctcaaatagtatatgttccatattaatgcttaccaaattgtgttaagacttcaacgaactttcaccagtccagaatcctaaataggagggtctgtgtttatgaagatctgggggatagacagggacacaagcctttatatatgaactgatgttaaaaaatattttttttctaaaatgcattgtggattttcccacattctggaaagctgtagttatatgtacagaagtacctggagtagaccttcaggctaggagacttttttttaaaaaaattgaactagtattcatagtaaatttttctaaaatgcattataaattattatacattcttaaatgctacagctacagctatatgggtagctaactggtggggaccttttgggttaagcaatgttgcaactatattacaatttagagaaaagctattttagcctgcagaaccatattgcttgacatgcagatgttagcatgctgcctctgtcgggttccagtatgcatttgtcatatacctgtattccctgcaggtgtcttctcattcctccttgttttcctttgagtgtcctccttttatctcttaccttttcccttcttaactcattttacacactttgttaccaccatagccaagaccatggtctatggaccatctgaaaccagacgggcctgggagcctatttaaaatgcactcccaccaaatcagaacctctgaggatgggccccaggaataagcagtgtaattaacttcccgtttgattctttcatgcttatattaactaacaatgtcgggccacactgaattctccatttgaaaaaaatacgtttttgctcttttgggactctctacacatgaatgtgtttctctcccttcctgagatttcactatcttcccaagccatgcttatgtcttctgggggcttaggatcggctaattgaatatcaaggttatacttgtttacattctacatttatatttatggttattataagagaggatattgaaagaaaaatggagctgggaatgaaggctaatttagtattacattaccaaaatagctctgtgaagcagtgtaagctaaaggtaaggacacactcttagaaggctgctttctgaactgggtatcaaagtagctctgcaagtttacatggtcttgactaatatattcaaccaccctaagcctcagttatttctttataaaaaggagatgatgatacctaccttgcatagtcattatgagatttataccagaaaatgtttgaaagagtttaaatctctgaaaattgtaagcatgttattattactaaacccattttacagatgagtcaaccgaggacagaggaagtaagagaacatgctgcagttcatagctcataaaccacaggaccagaaggcacctttcacccctacctgcccccttctacaggctttttcttgccagataattcattgccctctaggagctgaggattctgtagcatcaagtttttgcagtattaagattttagctctttttgtttcagtttttgtagcatttgatgaaaacttaaagctgattatattgtgtgtggtctcactaaaaacagtggcttttccctattttttaaagaaaaatttatatttgacgacctttcaccacacacacagtaggtgtgcactgtaaggaatgaaaggagccctgaaaatgatcccagttcccttaaagcctgaagacaggtgtctgtaagtcctaaccctccccaactcccatcagtatcctgacttatccacctgcatctacagtatgtagttggcttatgaatattgactgggactaaatgaataaatattgaatacctactatgtgcaactatatagtcacttataacagtgcttctcatttatatataaacaaatcttctgggaagtgatcaaaatgtaaagtccagttcagtaggtgtagaatgggacctgagactgcacttctaacaagctgttagatgacagcagagctgctggtctgtggacgaggtgattctggtgcacatttaagtttgagacacgctgtggtgtcccattctgccttttaaatctctgtgtaatactttttggcatttcttcattgttcatttgttatttattacttacatcccccagtagaatttaagttatatgagagcacagacgtttctaccttgatcatcactgtgttcccagcacctggaatagtgccagacacgtgtaggtactcacagtagggtagtggagctgatagccgatttgcccctgcacaccactgctcagtaatatttgtgattcagtacatgagtaaatgaatataggtattggtaatatgcatagatatataatagttatctattatttaatatacatagatatataatatttatatattgtttacataatccacataacattttgaggaatctattatcaaccacagtttgtaaatatgcaataatatgtgtctatttagtattacgggcaaatacaataaaacttactgaaatcaggtaactattgaaagtgttaggaatgaagagctagagcttgcactcatcctggaagaagacaggcaattctataaatagagagagaaaaggagaagagggtattccgtgtagatggaatgtagtgggataattttctgaggttttattcttaagttttattcctcttgacatctccatatttctgatcaattatccagttccctagttttcctgttgtagggaattttgagtgcaaaaagcagaagttactagaagtttgttctttctacgttttgtaaattccaaaatttgctgaaattatgctgtgtatcctggggtaagatagaagagagatggcttcttttgcagacagctagtggaaagagaaattttcccaagacagcaaagaattcggtctgagtgagaggatgataacttcaaatattaatcctttctgcaccacaatccccttcagcagtttgatgaggatgtcaaaggaagcattatattaaaaattgtttataaaatactttagagattggaataagtaacttgtgtgtttgtttattaattcataaaatattaatatctagcagcagatcaagtaattaaccttcatatagtgatgagcacagatttttaactataaaattatataaaaatctgctttttattcactgtagatttatagttactactaatactattgtggttcattatctgcatttataataaaaaataaatattaaattttcagttagaggttaattaaaaaacggacattattattttcctactcaagtccatggacccctgaggatggaccccaggttcagaagaagggcttgtacatcactttgaggcagtgcatatcagtcaggatagtctaggtcagtggttctcaaagtctaatccctggaccaataatatcagtatcatctgggaacttatcaggaatataaattctcagttccaatccgagtgttactgaaccagaaactctgggagcaggaccaagtaatgtatgttttcataagctctccaggtgattctgatacatgctcaagttttagaagcactaagctaaattatacttttgtaaacaaacaattaaaaaaaacagcctcaaatctcagtagtgtaaaatacatggtttattttccatttgatcttcattttcatcacagatagtatggacttattctgctccatgtctcctcaatccaggaacctggttgacagaacagccatcatctccaacattactagtactataccaggatagaaagagagctggagagtctcacattggtgattcttggtgcagaagtgatgcatatcgcttctactaacatctaattggccagagctagtcccatggttccagccagtaactacaaggagaggaagggcctggaagccagggagctaatgatgactaacacactatcaagatacagcaagatctcagagaagatggtctgctaatatccctagggagactattacagtcgcacttatgattcccttgcttgcagcaggcacagaaacagcagaatcacagccatgaaggatcagctgagacagtgggtgaactagtgtggcccaatgtgttccatgcaatctgtgacggaggtagaccaatgtaaaccaaagactgggagggtcaaggaagggggcacttccttttgctttagagatacttaagatcctgggatttttgcaccattctgggcacgggaggaaagcacaaaagtgattgagattgaatttcctgccacaggacgctcagtgttagatttaagttgattcagagaaatgtgatatttctgacacacttcaacacggggagaaaagttcatatccactagagctgttatctgtgtaaagtgcactagttcagcacttaacatggggcagtttagaggaggatttcataaatgcttggaagatgataaactcttcatatactttaacactaaattgacatattgacttagaaaagcctgagacctataatttttgtaaattcatattggggattcaattaatggagaaatatgagtcgttggtagttagtcactttttgtgattgtgacagttaattcatttttatctattagaaaattttacaggcattcagctagtatttttctgttatataattttccctgcctgccttgctttcatctcaaaataaagagaaggtattagccacgtagtgatgagaaagtagtcatagtaaaaattgaaataatacagtcttgggaaaatgtctggctcatgtggtgaaggttttattacttcacacttttggaaatatttactggagtcttagccactatgacaccataaatgtgtatttgatgaagatcaaaatctacctctgaagtgcacatttgtattgaatgactctgatgtttgtttcagttgcattgtaatgtgtattagatgattaaacccctcttccttgggggaaaggtttatggtagaaaaatttatatggtcaccatatgtgtgtgtgtgtgtgtgcacacgcgtgtgtgtgtgtgtcttcattgcatgtcagagagtgaggccaaacatatgtttcaccttctcactatgaaatatggacattttaatttctgcccacttgtggccctgtttttttccccattcttaccatgtatgtgtattgctcaggaaaactgatttatgggattaattaatgtacttttaactgggttcaaatgtactgtctcatctctgacttttgtatgtttgacttttgtcttctgattataattccatgctagaaatttgcttatagtcgtccttaagcaatagccaccaaaagttcttatggagactcctggaaatatgcttctgttgtttgctataaattacatttcacaatattgtagtaaaatataattttaggaaagtggtacaattgcatgaacatcaagtatctacacttattaacaccaaacatttttctcaaatgtatttttgaggtttattgcctagataataaatctatacatggagtattcctttaaacataaatcccaaaaccattttgctttgcaaataaatcaatcaagcgtgtgactcagatacaataaaaatatatggagggaaatattatatgtgataaatagtaaaaattttgcttactaatgaagaaatttcatgagacaatttgcagcccacatattgtagttttgatcaaaaagctttatacgaaatccagaatcctttaaatcacagcatggaccatagaaatgtgttttatttaagagactttaattcaagactgttgttttaaatcatgattgcatctttatgtttcattcaactcacatgttaagctgtgtgtgtgagtgtgtgtgtgagtgtgggcgtgtgtgcttgtaagtgcatgtgtgtgcatgtgtatgtgtaaattacatgatgcatctgggcactcattgcagtatgtcacttaaaaactttaaaaaaatgtttggagttaattttgttccaagataattttatgtgccattagttcatctcatcgtcttatataacaaggaaccaactgatgcaggttttacctttttagctaaagaattaggagatggccgggcgcggtggctcacgcctgtaatcccagcactttgggaggccgaggcgggtggatcatgaggtcgggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaagaattaggagatgtttaaatgttatatcctgttttccttgacaactataattttgcttgggagatgattaccagaatgactgctaaattactatttttctattggtctaatattttattcttatgaaaaatgttatttctagtggtctttattgaagaccagttgatgagggtcctcctaagtcaggggaaagagtgtatacgtttcatgtaaaatatccttcctctttgtaacccaaacctttgtatagcttggtttctctttcttagtctatgttgacagcagtacaaatagcataatagattcttctctgtatatttagagggtttttttccataaacttatgtgatactttgcttttactgtgtaggaatgatgaaaacacacaacagacccaccaccacctccaaaattgctgctgccattaatcaactcagtgcatgacagaaattatgaacaagtttcacaattttctcttttcttctttgacttttgaataactggtagagttttattctatgtttcatgtcacgggagaaaggaaccacaaaaatataactaatatgagataaagcaatatttgggttctgactccagcaatacccttgaagtcaaataggagcatgtgtggtagaaaaaagacgtgttctccccctaaaactctgacttgcttgtcactgtctcagcagtgacttgcaattgcaaatcattgcctgaataattaagcagcatttctgtggcctgtgacgctgagaagtgaatgctaaatatgtagtcactgagctttcatttgcttactgtgccaaaagccagtgacccaggaatcacaagtgactactgtctagctgctggctgtatgctgtatggatttttgtgctacaaatcatcatcaagtgtagactacttaaaggagctcctgtgaaattaccaaagaaataaaataagttagtatagtcatcaaggagaaatatagcatatattatactgaaggaagagaaagaccctctcatattattttatattgttttatactcagtacctgttttaagaaaaaacaacaaggaagtaaaaccaaagacaggcagtccggcgccaggcccgaaaccaggcctgggcctgcctggcctaaacccagcagttaaaaatcaactcatgacttagaaaccgatgttattcatagattccagacatcgtatagaagaacattgtgaaactccctgccctgttctgtttctctctgaccactggtgcatgcagcccctgtcacataccccttgcttgctcaaatcaatcacgaccctttcatgtaaaatctttagtgttgtgagcccttaaaagggacagaaattgtgcattcagggagctcggattttaaggcagtagcttgacgatgctcccagctgaataaagcccttccttctacaacttggtgtctgagaggttttgtctgtggctcatcctgctacaatacattgaagcgttacatccaagatgtcaatcttttccctgtatatttaaaatctctgcagagaaactgtcattttttaattatagcaagtgcataatgttttccttttagttaatgcagagtgaaatatgtgaatgtgcaacaaaattgctatatcatctaaatgtctgttctaagcactggggataaatcagtgaacaaagcaggcaaactttcaactcttacatcattagtaaaagggttaaggtcacagatgattcacaagaaaatgtatcattgataagtcgtctgaagaaaacacaaaattgggtgatggagagagttgacaaattgaagttgggtgatcaaggaaggtctttctgaaagggaattgtgagttgagaccagcatgacaaaaagccagatgtgaaattttagggaagatggatttcaagcagaaaaatcttcttgtacaaactcatacaactgcttctttgttgtttttttaagggacagagtctccctctgttgctcaggcagtgacacaatcaaggttcactgcagcctcaaactcctggactcaagggatcctcctgtctcagcttgccaagtagctaggaagacaggcaactgccaccacgcctggcttgaagttggtgcaatttctcagaacagaaaggaaagtgtgaacagaacagagagagggaggaggagcatagagatgaagccagtgaagtaggcaggggccaggttatatgggatcttgcagagtatggtgagtggtttagaatctcctctcagtgggatgagaagccaatggagtgacggacacgatctgaattatgttttttaaaagcactttgctcttcgtttgcagaatggaatgagtgagaggaaagagtggaagcaggagaaggaagccacagtggtatccaaaagaggaaaagtgggttagcctagggtgatagccagagcactcttttaggagtctcccaatgatccttgttctgaaatgcctcctgcctctgcagaacaaaatcctttccatgtaaatagttcgtgttttaatgcaaatgggaaggatggtgtacttcctccacatctgtttcctgttgcagggcttgggactgtcagtgctttttctccacatggaggttattttgaaacatccaggtggttttgatcaaatcatgtattcttagaatattattcttaagcttcaataataaccctacagatagaaagattaacataaactgactaaagaaatgttaactgccaggagattaaggcaatatctcaattcataatctatagtactttggggttaagctttgacttgcaggatgtaatttactgaccagtaacaaagactccacctagctggaacctcattccagaaatgtttcttttgataagattcttagatactgaaacatcatttttaaaaagctgtgctttgggaaatcaatttgggggattgtatcaggaattacaggcagcaatagcttcataaatgtgcaacccatgcagcttcccagggcctgtgcttagcaaggcttcacacttggtttaatgctgtgccttcattgtcttgaattcctaataattttttaacaaggggcctcacagttttcttttgtaccaggcaccacaaattatgtagccagtccagaattcagggctcaaaacactctatgaaaatctgttcgtctgctataagatatagaaagatagagacaggaaaggagcagacttgaataaaggaattctcagaaaagcaaattcatcaattataaaatttgagactttttagtctagtggttctcaggtgcctgtttacagtccatgcccaccagatttttacctctccatagcaaaatcacaagaatgatgatgccattgggttcttattttttagctaaatgtattcaactcaaatgtctgctctttattctgagattagattcacctataatttttgctgtaaaaatattttcgttttatataataacatgttggcaataggtagaagctttttctttgtatttaaagtaccttctgtaaaagaaaacttgaccatctcatttcagctcaatgcttcttggcagaaaagaagaagtcctttatcccactcctgtacctttacctgttttttctaatcccaggctcacttttctcttattgtaattattctcaataccaatgcctcaccattcacaaataactaaactcagttttgtacaactgagtaaaaggtaatcagaaacaaatccacacgaatattagaacttctggcaaggcaaaattgaaattggggaaggattaccctcttgcaaccaaactacttatctttttttatagttttattttataaatccatcctttttatgccccaaaggatagcaacatttttcttttcatctttgtgtctccagcatttagcacagggcattgtactcaataatccttcaatgaatatgtagaaactaaataaatataaataaataaaaattttaaactagaaatggaaggatgtctctcttccatttacaccttctttggcagtttcaacccttccttagccagagaacaataatgaccgtaagaaatgttaataaagatacactacatctgtaacaggaagttaaaattagacattttctctatttcagctaaaactgagaaggtaccttttactccctcatttcaaaatgaggcatgagcccaccaaataaagccttgaaaagctggtagacagggactgatttcatgacccttggctgaccgcccaatacaacagtgtggagattagagcaaggttttcagagagggctgttgttgatgttctgggaatcctgtcctatcccaacccttaagggtaaggggtgagggatgcctttaccttatcccaaataggtaagagccttcattgaaacaaaccaaagagcttgggggaaacaatggcttagactttgagtcaaatacgagaaatgaaaagggggagagactacagctgcttggagacctgacaaggggatgtaaagagctgccatccggtgagtatgctgaaacctgcggggcaaagaatgtttcgtgttggcaagatgtggccttacaagagagaactggcctgaaagagtcttggatcttgtccagaactgtcctgcaagaatcttagttctcttctacctgggggagggaggtaatgcgagcagaaagaacatggaggtctactgtcagagccctgggaaggagctatgagtgaccagtgggaagagctgctttcagtcacaaagagcaaactacagatatctctctagtgaggagaagacaaagaactcctaaaatatcccacccaacaagagagagtcagctttaaacacctaacaaaatacaaagagctgatgccagcaagtaagatccctggaatctagtacagtgctttgaacatagaagggactcaacagatgttggggaacacaaagacctgttccctcgttgggctaatgttgcaggaatgattctcagctttgtacacatgaaggaattatgaggttcaggttaagtgcctcacttcaaaatttaatttttagtccagaccagtgttgttttaattttactacactcacagttaagaggagtccagaggagcacccttgaaactatagtgctaatatcaagtttgtgatgtagagcaactaagtgtttctgagagggcttcaaggcatcctttcctgtgctgtttttacgttccaggttattaagcttatcttaggtgaagtcaagctttaagtggtagttactatgtgcctggcagaatacagggcactgaaggctcaaatgagaataagacaatccctgacctcaagtggctgatagcaaatggattaaaggcaattgtttatcatttacttaatgtatagcacgagctcaagaaatcttacatttctatagttacattactgtcactataacattaatagttgaactaggcttcccaacagatgtaaaagccttctaatctagagataaataaagattgtactttttgttatcatcagattttattattctttgatgatgattgactaaatatactaatgaggattgaaaaatatactgctttaaatagttatgtcataatttctatcagtcatgcaattagaagtacatatatggatacatattttttctattgccccttttttcctggctttgttaatgtataatatattgcttttctgcattcactctccatttgatttttctcctaatgtaatttaccacctgcagaagtatgaggcctggaaaatgcaggtgtgaaatgctcattagcacaataccaataaatcaacacatgtttaaaagaatcttctacctaaccctatttcttaaactgtgtattcagtcataattttcagatttaaaaattggtccaggttatagatcaggagatagctgtatttttacataactattaggaatgctgtggttttctaaccagagaaatatgacagtaatttcttgcgaaagatttgggacattgtgactgagccaaactaagaatgaaagaagatggagaaaataaacataaccacatgtcctataagtcttctgtatgaagacaggtgtgaagcctatgaggagggggtcattgattcatgaactgattgattcactcatttattaattcatatagtatatgtttttggtgtgcatataattgcaaagcactgtattggatacataaaagaaatctacttccttttgaagtgacttctaaaagacactccccatcagagtgtctaatgaaatgagagagacagaacaaagtggacatgaacaaatctgttggtagactttatgataaacaccatgagaagcaaatgagcagaatgcagtgctaaagagtaacctggggtgaagtgggagctagggaaggaggatgagagacaacctacttaaaattgtagggatggtctttcagaggagacttaaaaaataagaagcaatcagcaattcaaagagcattccaggtggaggtaagagcatatgcaaaggccctctggacagaaagagattcacatatttgggaatcttgaaggatatcaaggcaactaggacatgggcaagaaaagtggcccaagactatcagggcactatggaccattgaaagatgcttagaaattcatccaaccacagtggaaagccattcagttctttaaagtcagagaacaacccatttgcttgatgtttaaaaatgcttgctctggttgctatagcagagtaggtagtaggggaccaaggtctaaccagagagagcagcatggaggctttggtaacagtcgagagaaatgatgactaggaaatgaagaaacttaagatataatttggaggtataatagaaagggtttattgatgaatcagagttggaaagtgttacaaaggaaaggatgaaatatccttcaaggtttctgtcatgagcgactgtgtaggtgcctgctggtgccatttccagagattgggaagacaaggaggaaagtcagggtcaagtttagaaatcaagaatttgttttggacatgttaagtataaaatgtgttgcatgtaatggataatgccaagtagctagctgaatatttaagttccaagtgttgaggaaaactttggaggtaaaaacagagagttttggccaggcgcggtggctcacgcctgtaatctcagcactttgggaggccaaggtgggcggatcacgaggtcaggagatccagacaatcctggctaacatggtgaaaccccgtctctactaaaaatacaaaaaattagccgggtgtggtggcgggcacctgtagtcccagctactcgggaggctgaggcaggagaatgttgtgaacccaggaggcggagcttgcagtgagcctatcacgccgcagccctccagcctgggtgacagagcgagactccatctcaaaaagaaaaaaagagtcttcaggatataaatgtttaatcccaaagaaatagactacaatatctagggaaagagtgaaaatagagcagagggaggcccaactggaccaagtggattaggcccctggatattccaaaatacttagggattgaatcaaaattacaaaatatttagaggtcgaatagaaaatgaggacttgggtcaggtgtggtggtttatgcctctaatcccaacaagttaggaggctgagatggaaggattgcttgagctcaggaattcaagaccaagctgggcaacataatgagaccctgtgtcttccagaaaaaaaaaaaagttgggcacagtggtgtgcccctgtagtcccaggtccttgggaggctgaggtgggaagatcccttaagcctaggagttcagaggctgcagtgagctataacagctgccctccagcctaggagacacagtgagagcctgtctcttaaaaaaagaaaagaaaaagaggcttattcaaggaatagtgaaaaagggaatatttggagaattatgtcagggaatctatgaaagtagaatgtttcaagatagagggagtggttaaaaaaagttgagtatttatatgtgccagtgtgtatcatgctgaatactttatctggatggtgttatattatccctcctatagactattgagttgagtactgttattagatccattttacaaatgaggaaactatggagagattaagtaatttgcccaagatcccataataagaaggcaagtgtcgaatgccaggcattctaacttcagagtccatagtcttaacccttgtgctattctcttccacaaatacacccagcaggtaaaagactgagaaaaataaatatcaaaaagtaccttttgaaattgactacatgaagttacgaaaacctgagttgttttgtgaaagcggtgagtacaaagcagtattttggagagggttgtgcagggaatcggagatgaagctgtgtgctgaaaaggagagaagaaattagaggaagggaatggtggccttacagagaaacagacttgaagtgatgtgaagtgtttgcgctgggtgaatgctggcaggaataagtgagcagggagcgagtgaacaggataagagagatcacttcggagtaaagccttgaaaagggagtgtaggaggaagtttttctccctttcctgcatcccttcctttgtgcgtaaaatagaaatgttcttcctttctgaaggatttcaaagagaatgttggcttttctttcattctccctgactcatgcctccccagaggaagaaaagtgacttctgaggctgtgaaaaggaaggactctggctgcatgacccagcctcctctggcttcttcttttgggacctgatggccctcagcatgtccatcttaactcctgctccccctggggcaatctcaccaggacactgcttctccaagtgccagcttggggtggggtccttgccccctgtgtctatttctcaattagttcaggacttacagaaggaagagagtggttagtacattaaaacccccagtataaagagggaatgcaattaggtttagagaacatgtggagagattggctttggcaagaagaggatcatgttctcttctgtaatagaaagaaaagttttaaaataatggggaaagataatgtttatagagtcactgctgagaagaagaaaagtgatttctgtaatgtaatttttaacattttataattttttttctgaataaagtctgaaatccaacttggttgtattgggagcactacatagctttcatgtgtgaagccactatcatctaagcagaagaaaactagaacagatacacctagtgattctcaaactgaggaagaggatgtggcatgccctgtctagggtagctaatccgaatttcgatagggcagctttcaaaagaaatcatttcaatcaacaatgtaatcagtaatgcaatcgtacatttttaaaaaccacaaaatgtcatttttacttaaaacatttataatgacttaaggatgttttatattcatcaataggatgatttagtttgaagaagtcaagaaacaatgggttacccagagtgttttccacccaattcctgaattaaaatgtagctaagaatcatattttctgtaccttcttttcctgtcttttgtgtcttcttttggggaaagttaagagggtagatcgttggactacattgtcattttaactataaaccactggactttggcccagattattattacctgcagaagctatcttgattaagtttggagttgccttatgttgtgcataagcaaaactacattttaatcagcttgtccatatgatttatagagatagtttgtaataggccttgttaaaaataggtatctttaatcagcaatattggataaaagcctaaagtcttaaaatagtcatatttattctgattccttcttcctaaaatgaataaacagaaagaaatcgatgtggcaatagcgtgttacaaatcactccatcaaaggtaatgaaattaaatttcatctctgtgagttactgcaaaagactgtttaacatttacaagaatttgacttccaaatccttcaagccctaatctttggatttacataatgtgttcctactttcagccttttccagttgaaagactttgaagttccaaggcaaaaactgaaataaattggaaatttgtgtaatttcaaagtgaatgcttgtgatatagtgacataatcagaaagcacatgagggaaaacccatacaaattttgctactattaactcagtgtttgaaactttatagtagaaagatgatatgcaaaattcttaaagattgctccaaggaaacatgctacatatttctaatcaataaaattaaaatatctgatcactagtttgttgaaagcgttagatcctggacttaaatctagatctttgattttagagcccttgccctgttttgtcccccagggcactatagaaaatttttgcatgatgatatcaatttatcaaaactgcagagtgtttatttagaaattataaaatgacttagtgaataaaaaattgaggtattatttggatttatcttagtattaatggtggagaagaaactgtttcttttatctaagctccaacaaacattctttattttttctttaatcagagtctcgctctgtcgcccaggctggagtgcagtggcgagatctcagctcactgagcctctgcctcctggattcaagcaattctccttccttagcctccctgagtagctggcactacaggtgcacaccaccacgccccgctaatttttatatttttagtagagatgggatttcaccatgttggccatgctggttgcgaactcctgacctcaagtgatctgcccacctcagcctcccaaagttctggaattacaggagtaagccactgcacccagccccaacacatattcttataatgggatagggaggaggctatgttatgtggatgcattaatttaatcattatatccactaccaaatatcaagtcttttttttagtttattttcataggtttttatatgtagacatgctttcttctttgtggtttttcccctgtaatgaaaccattcattcattcaacaatttatttcctaagtgcctactctatgactagctctgtgctaaatcctaggaatgaaatgatgaacagactagaatttccatgaatgtagtaattaagttgatctggtggtgtgcacttctaatagaaaatgcttctctcatattacctctttctctgaactgatgcaagaattggaatataaacaaaccagctggcaaacttagatgatttagatgtccttttcattaaaggtcagtaagaaatgctaacgttttatgttagcatttattaaactctgaagaggcagaattagtttggggtttaatttctagtattcatagcataaaattaggtataatagcagtgaatctatgtatgcttctatataattattattattctttatactggcctagcccttcacagagttaaattcaactacatttaatgagagaatttcttgtttttttgttagaatttctagcaaaccatttctgcatgtcattgcacctgtggcttaattcttacattttctgttctctgaatttccaagatagaaaagcataaatttcttagagtgaatacagggttagaaacacatcttgttataacaaactatctagtttcagcatcccattaactgttccaacaccaatttgaattcccaaaggatacttctgttgaagcatttttgctttggtttggaattgcaaaagtagattgagtaattcccgattccacgttaatgagactttctgtcttaatcctcctgtttaagggcacaaagaatagtatggccactgcaattactgagtgggctagaattggaatattctatacccccaagggattgttttcttcttttaaagcataagtttccaatctatcatttcttctgtggttgagtttctgaacatgcttgggttttgctgattttatggtttgtttttagctgctgatttttagtcagactgtataggaggggtaacaaaaacccttaattttgcaatgtgaaaattctttatgcatttgctcccgaaagcttatttttgagtaacttgagacttttgcagcagccacagtatccaacttggaaaacctgcattctcagcagctttcctactttaaataatattcttacattagctcttttaggaagcaaagagacagcttccctaacagtaacaagatgtgcaaaccacagatggtcttcttgctggaaattactggaaaggactacgagtgttcggcctttggggcacagtcattcacatgcattcatacacctcacacacacatacacacacactctctctcatacacacacacacacacttgtgtgaatatacaaatgaataaggcaaagtgagaatgtgtatagctactactagtatatagatttctgtggaattttatacactgctttaatagaaatgaacatattttatgtttacaatagctttcttaggtagagcaggcagatatagcatgaataccattattgtagataagacttagatagtccaggtccttgcccaagtgtaagagctgaagtttatctatttctcctaattccagaatgtggcctttggttcaaaatgccctggttgtatttcagcttttctactttctagttccattactttcttaaagcctcagttgatacctctaccaataggacatatgctacctacctcataagcttgttgtgatcagtaaatgaaatattgcgtgtataacatgtggccttttacctgatacattataaatgctcaatgaatgttcatgtttgctttttcaaagcaaacatttatacgatacttatgccaaatctaagtactttttcaaatattagtctaatcttcatgtcaattttatgacagatattgttaatattcccattttacagatgagaaaatggaggcaaggaaaggttaagaaaattgcccaattgcccaaggtcacacagctggtaaatgccacattatggattcaattccagataatccagtccccatgtccatagtcttaaatgctattctgttattctcaatgtacacagtgggatatatggaaatgtgagttgtatatgctaattttatactgctttaaattcctaaggcctagggaatattcccatatgctatagtgggttttctcaactgttgctactattaccaccaatatcttaggactataataagtggatagaagaagatctgtttttttttccagacaactacagaactcaggaacatatccaactagttataatccaggcacaatttgaattccacttgatgggagaggtgattccagtgaagaactcaattaaataaaaacacttttttatgcgtttcagtcatatcatgatgtagtttaggctcaaggtagagttgtatcatgtagtatttagaccagattacaaaactattaagagatgcagagcatgatagacgaggaaagatgaaaagcattgcttggttatgacgtgaggggatgatgatagaagggtggagatagtaggaaagagaaaaccccacagatgtgagaggaaaagggaagataagacaaaaaaagtaagacaagtgataaataatggtttataagggctaaaagtgaagaagcttgaagaaagatttgctacaaagaaagctattgaaataaagaattgacccagatgttgggagaaaccctccacagtgagcagtataaagccacattcagtcactgttggcgtttgccctgggctttgggatgtacgttcattcatttaagccaaaaagtgcatttatcctactcaaaaagtgatttagaaaatgagtgtaagatttcctatgcttctagtaaaatagaaataaattatgcaagagtaaaattagctaattactgtaagaatcattctgttaaaattagtgagttttggatattttctgccagttctttttttcactagtttctgtgacttcagatttcattatcaacctaccaggcctttcctgctccttggagagctggttgaaatgggattgaaccctattttcacagagtaggaaagtcaagatccctcctcaaattgcattaccacttcttgtccttactttttcatggttctctggtttccatctatgctcctgagtttgctgtctcaggtcaaacctgcgtggatttatacacacacacacacacacacactcaggtgatctatctgatgggtttagttgttttctgaaagatttggggattgtcgtgaaagaaataccacattgcataccacataagggacttgtattcagttagttctcttgttatccttcactcctccctcaaaacccacactccagaatgagtcaagcctccttcaaaatgcagtgcagtccctgcaggttcagtgtttatcgaaagtggtacaggaggaaagaagcctgagaagcggatataatttcctcagcatccctgggaattgtgcagaacacaattatagcatcttacatactcttacaaaatgattggaacttgcatttatagagagcttcctgtgtagatgctgtgctaggcactttcacatatggtgtttattgattcttagaacctttctgggtatattttatacccgttttatagatgaggagagtgagtctcagaaaagcacccagcattgttaccatgctgaaggaaggcattggaatacatgtgcagaggaataagattgttcttttcttctcaaaagcagaaggacaagaaaaagcaaaaattaagacaaaccagtctgcttataggagccatgccaagagagatgtcttcttttccttatttcctagtctctgtctaaggcttcagcacccattttcctttgggaatgcaaagcacattcaacaaagaacctcgcagtgcctattaagagcttatttttgtcttcatttttaatgtttcatttattatcaaatagggtactttatctcgtgcacacctatatgttccattatgccatatttacatttgtttaacgcatttaattaagaacattgttaaaaatttaaaaagacttcccctttcacgaaatttggaaattgaaggtagcatttaacgggtttccttgtcaaccacaatactcatttttagaattgttagccagtaattcaattacccacacagttctgctttctaagaatgtgcaaatggaagtcttgtcttatgcaagccagaaaacctactagcagtattctaaacttagaacaaaaacgtgatgcccttcgagtcttggttgggaagagtgtttggtgaggagggggagaaagaagaaggggaataatagtgtcattttctgtttgtctttggccatctggagctcagtgccacgtcctttgctcattctacggagaatataaaaagggcaatgagatgcttatatattttgtagtgctggcagagcatcatttgttataatatctatccctttatcaaatataagccatcatataagccaatatgagactttagatcaattctaaaatgggccaatgtaaaatacaaacagtttctggtgataaaataatctgctatgtgaattgaaggtaaaacatttataaaatgtaaataattgttaataatgataattattgctgagaacaaaagagcagctggctttttgtataatttcacacctttcctttaaatatttactcctctgaaactgccttcccccaaaataacttactttatattgaaacttaaatttaattttgaaataaaatttataggatcaactatagaatattgacattttgtatgtcaaaaatggttgaatattagggatttcatcaggttcaacataatactgttagtgcagtctaagtcttggcgtgtgtaagtgtgctctcctggaaagccatgctggtccaaataaactttgttgccttggtgatctatagcttatttatcttcttttttattagttgaaaaataaaaattatatatatttatagggtacaaaatgatgttttgaaatatgtatatgctgtgcaatggcttaatctaattaacatatgcattacctcacatatttattttttgtggtgacaacgctgaaaacctactctcagcagttttcgaaatacactacattggtatttaccatagtcacccatgttgtatagcagatctcttgaacttatttctcctgataaaattttatatcctttgatcaacattatacccatctaaattccttatatccttcattctactctgcttctacaagttaaactattttagattccatataagtcacattgtgtggtatttgtctttctgtgcctggcttatttcatttaatgtgttccaggttcattcatgttgtaaatgacaagatatttttttcaagttcagtagtattccgttgtgtatacatgcaagttgtttcttaaactgctttttttattattaatcttaatgccttcttaggtgcgtatagtacttctgtagcttttagctctagtctgaaaacacctaagataagaatggtgttattgggaggaacaaggcattaggaaaaagtagataaagctatacagtgtaaatccatgtttcctcaagtatatgacaacataggtgatttttggttactactccttgaaggactccattcagcttgcttaactgtgagatacagctttcaccctaatttccacaaagcagctcagagtgattcttttaccatgtgatgactgctttgctcaaatcctctcttggcctcatttaagaaccttgaagctctatatgatttggcctcactcccctgccctcaggaccatcttgtttaacttcatctccagcttctcactccctctttttctctgttccagccattgtgccctccctgctccactaacatcacatacaagtctatttctgaaatgctgctccctcataactgctccctcagttatgatcatagctcattccttcagtctcttctcaaaagtccaatggtctatgagccctacttggctgtcccatatatagcagtacaaatgcataccttcattccctatctcttttactgtgcttgattttaatccactgcactttttgccacctaatttgttatatattggcttgtttacttatcacctgtctccctccataagaataagggctctaggactacagttgttttgcctgtgttgttcactgtgtatccctggtgcccagaacagtgtagggtggagagtagccattccaggaatgaatgaacagttcatttcagctcatgagaagtagggcgctggatagggagaacagccattcccagtggaaaaaaagggttgttcattaaatgtcactctactctgtcagtttctaggagtctggaatgaaaagagcttcactctatttatttttattaccacctttttgtggcaagtagtcattggcaccatatataatcttcattgtaaatgaatacagtagtaccaccttatccacagtttggttttctgcagtttcagttaactgcaatatagtacaatatgatattttaagagagagaaagagagagacctcattcatgtaacttttattacagtatattgttatagttgttctgtgttattattgttaatctcttactgtgcctaatttataaattaaactttatcatatttatgcatgcattgaaaaaaacatggtatgtactgtatagggcttgttactatctgtggtttcaagcatccactggaagttttgaaatatatcccctgcagataagaagtgattactgtatggtaaaagtcaatttctcatgaaaatgttttattgaaagtataacatatacccagaaaaatccaaaaatcgtagatggttaaatgttcacaaagtaaatacatcctggtacccagtgcccagatcaggaaacaaaacattaccagaatcccataaaccccttcatgttgttgtcaatgtaataactccccaatgtttagcctaccattttactatcatagatagtactgcttgtgtttggacttaatatacgtagaatcatagggcatgccctcttttatatctggattctttgctcaaaactatttttatgaaaatcattcatgttgctgctaatagtcatagttcatgcatttccattgctgtataaaattccattctaccattgatagacatttgaggtttttttcaatttttgtgtattacaaatcctgctgagattaacatccttgaatgcatcttttggttaacacataaaaatacatgccttgaacttcattcaaaaatatattgccagacatttttccaaagtaatgttaccagtgtgcaccaccaccagcagggcagaattccaatcgcttctcatcactgcactttgtatcatgtcttttacattttagccactgtggtgggtgtggtgtgagtgcaatgtagttataatttgtattcctcaggactactgctgttgaacacttaaaaatgtacttgttgccaatctgagttacgtgaatctattttcatggatattaagataatataggtcgtatatggataaggtagaaatcatataggtcataatttaatgactaaaatttagtagacattgctttcattaatgactcttttagtacttgatagattgtattatcttcacaaagcttttgctgtggaaaattcagttcaatagaagctaattgtgggttaattatgaataaccctccatgctgaatggtgtgaggctaccaaggtccacgtcatgggaagcttcccagatgtcacgttgaagctatgtctaacaagcatgaacagggtctgcaagcaaggcagaaaagggaagccaacgtactagaaaagcctaaatcatatttgaaggtatgaagaagtatgaaacttttaggaaattgcaagtgttcagaaaataaagaaaattgccaccatcttgtttatagggaatgaaagacttgaaaaatgacacttaacatcagcctgcagaagtaccaagggccaatagtaaattggacttagggtttaattacattagttgtgtagcttgaaatgtttgaagttaactcaccatcatttacaatgatttgtatgccaaaggaaatatgcatgagcagggaaatatttcctggatagctttttgctttccatgttaggccttatgtcagctatctaaaatgtagaagtgagcaacacatttattgttactgagaatgcatagtaaaataacatgaattctatcatttttacagctaagatgctgtatagattaagcagaaaaacactggcagcctctgattaaaaaataatgattttattattctttttggagttaacatttatttttaactaatgtttcactgtattaaaaaattcctttcagaactaaatactatagtcaaatacattatctttgacactatattttaattggttattgaaaaaataaaagctctttatcaccttatattttaatgcaatctttcaaaatgattaggcagaagatatttttccttctagtttcaaaaatatttgtagaatttttcttaaaatactgtagggaatgtctatcatttctgaatagatgtggttctatctcaaggttaaatataactcaattgttgaaaaaaaattataaacatggaacaaatgtgtctctagaatcaggattcatagcatgtggtcttctttacttgtaggctgaagaaaaagtcccagtcggtggatattaatgctccagggttcaaccctttggctggtgcaggaaagcaaacaccacaagccagtaagcccccggcacccaagacccccatcattgaagaagagcagaacaatgcagcaaatactcagaaacatccttccagaaggagcgaactgaagaggttctacacaattggtgagcaccagatgttttatgcaagtgaatagatgaaatctacctaaatggcattgagaatttctgggtctgtttagttaagtggctccttgttataaaacatgtaaatctttctgatggtttatttggacattttcttatgtggtctgaacataaagatggaaaactactgaaaaactttcagcaaagttaaataaaagcaggcttgaggaccttctatatcctaacctaggggaagtaaatatacatatacgtacatatacgtacacatatactatctctctctctcttaggtttttcaatttttaactttgtgtgctattttcattttagccattgttcagccagcacctttcttgttttttgtttttgttattttcattttcccttcaggctcccaggtctctgaacctgttccgtcaggttgttaagactgtggttgacgttagcctgtaactaacaaagccagtaagaaagtaacgttattacattctgagagaggacagattacattgtgggtctattttgaccttgcaccttgctttactttggaaaaattgaatgacatccaggcccttcatagggaagagtaataggatatggcttgggttgtgcaggcattacattatttcccccagatataatgatatcctgtaatttttgtattttaacatttaatcagacagttgtaggcaatcagtccaaaccaatcaaattaccaactttagtgtaccatattagcccagcatgtctttggccttgctttttaatgaacaatagcagcttttagtgtcttcagtctatctgagacaaaagttactaaacatctagtatatgggaaagaatggtgtgtaggggagacaaatccacccaaaaagagtgtggctgctttggccttgcttgttacttcaatttggagagatttggtcacatccaaaagctgtaatagtagagactgtggcttaatgggttaaccagtgttacatcaaagagggcctgttttctttaaaatttaccatcctcaccactccagtatgagactgtttgctttaagatgattgaaatctttttctttgattttttagtagccattcctagaaatgatcatcaggagaccagatttctagttctattgaaatctttttctttgattttttagtagccattcctagaaatgatcatcaggagaccagatttctagttctaattcctacaacaatttcctgtgtgactctgtcaagtcattttccaatgtctttgggttaaattccttccttcaagctgaagaaatgcctccatgtaggtttagccttatttcagaatttggctgctaaaaccatgctttctctttccaccattttatgtcctcttcttatatattcattctcaggcttcctttttccagatggtcaagtcttattttctaaaaggcaacaagtatggtgtcaatgagactgtccatagtcaggtaatgagaattaataaaagtgtagacaggcacatatttccatttttaaaacctatgctagcacagttcctcaaatcaattgactagaaaatctcacaaagtctacataactctctccaattaccactatccttctctcctctgcaacatgtctgtcgccttctattgcttttctaattagcgaaaaagacacaattagtattttttccttcagcaaataaagcttatcctacaaactcaatgttccttaaaaattagaaaaaaagggagagatactgaccaacttggccaccatgactaatgggctaagcctagaaaatagaagtctcaaaaggggtggattgcaaaaagatgaacgatgagttattttaaataataccaccactcatgaattcttcactattgaattggtaacaatttgattcataatcaatgggagtggcatgtctattgtgttaaaagagacatctgaactgttaaatatactctatctatataacccttttagtaatttggacctggaaacattattttcaaggctaacatattagcaaccgtataatcaccggtattgaaagttccctttacaaaacaaatgtacttctatgtctcttagtaaaagtattagtaataaacaataaaaattttcatttattgataatttcatatgccaggggcaatttaagctcctgggttttatcctcaattcaccctcacaacagcttggacaggtaagtgttacaccctatttttatagatgaggatagagccatagatcatttaaagatggggtcatgagctgtagagagcaggctctgcaaattaaatctatgttctcttgtgacccgtcagaatcaggctttctctgactctcaaaggttgccatccctgcgctataataagctggaggagtgttgttgtttgagacggagtcttgctctgttgcccaggctggagttcagtggtgcgatctcggctcactgcaacctccacctccagggttcaagcgattctcctgcctcagcctcccgagtagctgggactacaggcacatgccactatgccctgctaattttttgtatttttggtagaaacggggtttcactgcgttagccaggatggtctcgatctcctgacctcaagatctgcccacctcagcctcccaaagtgctggggttacaggcatgagccactactcccggccagctggaagagattttatggataatatagtggagtgatatttttaccacaagtcccagagaatctcagtgaaggaagccttgccaacgaacgaacccgtctacaagccaatatgctcattcattgaaagatatttttcaatatctcagtttagagtttatactcctggaaaactctaggagccctcttgtggccaagtaagtgcatttaaatttagcaatgaagtttcatactatagttactatatacattcaagcaataattttagggcttaaaggattttcaaataaaaaataataactagaaaaatgttacagccattgaagtgtcttttagtggctgcagtggcttttctagaattattttcctagaagtacagttattctttagtattcagggagtagaggggattggttccagaaccctcacagataccaaaaatctgcaaagcccaagttcctgatataaaatggcataatatatgcatataacctatgcacatgctcctgtatactggaaatcatctctaggttacttataatatctaatacaatgtaaaagttatagaaatagttgttatactgtatttttagtcagtattgttttatattgttgcattgttactgtttattgtttttactctggaatattttcaatcagtggttagttgagtccatagatgcagagcctacagatatggagggatggctgtataataaaattccattgatttagaataagtaggggaaagctagtcactattgatgtgaaataaatgaatcttcagataaaaggaaagtaatcaccatgtcaggctgtggttcaggaaagagcattttctgccctgcttccatcactaactgtgtaatctggcacaagttatttaccatcattttaccttaatacttacatgtgtacaatgaaagagagaaaccaaatcttgtctttcagagttgtttttcttcttactctctttttatgatcacaactgaccatagaaagtactgtataagttttctattgctgtgaaacaaaataccacaacgttagcagtttaaaataacaccgatttatgaactcactgctctgtagttcagtccacacggtatgactggattctctgctcagggtgtctcaaggctaaagacagggggctagctgggctgtgttttcatctggagtttcaaccaggggaaaaattgcttctaagctcattcttattgttggcagaattcagtcccttgcaattgtagggctgagctacccgttccttgcttgctgtcaaccagggaccactctcagctcctaggggccacttgcttttcttgtcatgtggtcccctccaccttcaagtaaagaacttcacatcaaatctatttcatttggatcctctgcctcaaccaaccaagaatactctctgctcttaaagaattcatgttattgagtcaggatcacccaggtaatttttctgtcttaaggtccacacaacctaatcacaggaataaagtccatcataaattccagaccctggagttatgcaggtatgtacaccagaggggtgggagatcttggtgaccattttagaattctgcctatcacattttacagcaccacctgatatatacacatgcaaataccaatatatctcagatgaaatttcttaaaagcacttccattactattttgactacttatagaatggaatattctatagaatatgaaatagaatacaatattctatttcatttttttaaaatacagtctcaactcactaagtttatttcatagtccattaatgggctatgacctgaagtttgaaaaatcactggacttgatatttgaaatccttcagatacttaaacttctattattctttgaaaaatagaatggttaattagagctagaataaaaaacattaacttagtggagtagcactaataggtaaatagaagaaaatggagtggaaatttttttttttttttgagacggagtctcgctctgttgcccaggctggagtgcagtggcacgatctcggctcactgcaagctctacctcctgggttcatgccattctcctgcctcagcctcccgagtagctgggactacaggcgcccaccaccatgcctggctaagtttttgtatttttttagtagagacggggtttcaccaggttagccaggatgatctcgatctcctgacctcgtgatccatctgcctcgacctcccaaagtgctgggattacaggcatgaaccaccatccctggcctggagtggaattttttaccactccaattattgtttgtgttacataaaaccatttgaatttgacagtgagcataagaaacatatccttcaaaaccacagcccctacttaaagatagataatgaagccaaatagtagactcagatatttgtgataatcagcttatttcactacccttcattcaaagaactacatataaggacttctgaaaaatattgtaaattaagcatggaggtagtaaagaaaactgtgcacacaggaaccaagcatgtacgattgctccctaaggtatacctgtacagttctatgtgatattgattcctcacttcagggaactggagctggaattcatatatcacggtccagcttctgcaactattagtaaaagctcctgatgtttttctatatggaggacttttgctggacagttaggaaataggaccactcttgaatgaatatccacacgatcagaatcactcagtgacacaccaaacagtgattagtccctgatcaatccctgctgtgtgaaggcctcatagaagatgctgctcagaatagaatgaaaaatgaaacagagagagccctgctttcaaggcagccatcgtatgcgttgggaaagagcgtgcctggttgaaatgagcacaccggtaagcaaaatagacaacagagaatgtcctaaatgccatagagatgggagagagggtggtgtgtaatgaatgagggagggggcagcaggagccaagggatattcagagtaccctggaatccacaaaatggagaaatctcagattgtatagatgctcagagggcctttatgggctccatagagcaagacaccctcaccatcctcctctgtttttgcttatgagctcccctggcatctgcacttctctgtgcctcctgttttcttgtgttggcatgtctgtctccatactggttctcagttcttaggaggagggaatggtgcctgcaatcttattaatcccagcacttagtgcagtgtgaggcacacagttaagtgccaaataactatggagggcagagaggatagttagaaagggttatgaatcttgtcctttgaagtggaagaggagaggagggagtctgctcagaattcagttggaggacgagcttaacatttactgtgtgccaggatctttaagcaatttattcacattatctcactatccaaagctcagtgacacagggtaatggcctcactttcatgaaaatcagaagtccagagaggttaggagatttgtctaaggtcacagcttccccaaatagcctagataggatccagacccagtttaatgtaattgcagagcaaaggctcttaaacaccacaacgtgctatctgtttacccctcaccataagtatacagctaaaagattcttctgtctgtagtccattagagaaggattggaatacctggtgtagcaaacaataagtaagataattacaacctttatgtttattttttaaaagtcctcttttattacttatgccacctaaatgctctctgcaacttcgtagaaaagccagaaaagctttcagtttagcctttcctcggcagggctcctgaataggtccaaaaggggggctcctcggctaacaggtgtttgaataatacctctggaactttccttcagttgaaatctctccctctcagtttctcaccttgtcaagggaattgacagtctatttgtcccttttaatcttgtttgtcttcaggatcaacctctcccttttatcctatctaaactaatctcactgtaacaccttcttgtaagacacagtctacgattaatcatccaatgttctttacacagccatttatagtcatttagtttcagataaatgaattaaataaatatgtattgaatgcctactatgttccaggctgtgttcaaagtcctgtgaataaaagattaaactaaggccagccctcaggtgcttatattctagttgggaaggcaggcaataaatatacaatcaggtatttaacacactgtcaagtaatgataagtttttaaagaagaataaaatagattaagtgagagaggtgatatgttattcacgtaaaatatgtttaaatcttatacaatttttatggacattctagatgatgaattgtctcagctctaactgggaactcaattggctggattcgattacaggacattagacgcattaataatagatttttcagagttgtttttcaccttccttggaatcagattagcttatgaaaagactaatggaattgatatttgcagcatgaaggagaaaatgattgaggggaaatttaatgaccctcatgcttccccacattgttttcaagaggaggtatccagatgtccatttctaccaacaatgaataaggagtgtggattaagctataatttagagtattgaaattaaatatcagggaaaatgtaacaagtattagtatatacagggaagttggttttttgtttgttttttgagacggagtctcgctctgtcgcccaggctggagtgcagtggcgcaatctcggctcgctgcaagctccgcctcccgggttcacgccattctcctgcctcagcctcccgagtagctgggactacaggcgtccgccaccacgcccggctaatttttttgtatttttagtagagacaggttttcactgtgttagccaggatggtctctatctcctgacttcgtgatgcgcccccctctgcctcccaaagtcctgggattataggcgtgagccaccgcgccatgtatagctattgtctcttcagagtggtttaggtgtcagcttgccagagggaaggagaaaattagctctcaaagatcctaatttttttgatcaaggccatgaaagctgtgtagtcattcagtgggtgtttattgagctccttcttttgctcaggaaggcaggtgaatcaatggtgaggaacttggccttgagaatctaaagtccaagttggacctttatattcctcctgctagttatgagaccataaacaaagtagttagaatctcaaatcccagtatgcctctttataaaaggaaataaaactgttgcttactgaaagggctgtggtgaggtgtaagtgaggtaatgtatttaaagtacttatattagtgcctaggacttgcaagttctcagtaaatattagtgagcttgttgttgttgtgaattaaggatagagtatgaatgaagcaccatggtacctgctctcatggagcttatatgaaacaagcctcttgtcttgacctttgtggatctgatcaagtcatcccctgtttaaaacccggcagtggttccccacttccacaaaataaggttgttactctatagatctttcatactgcgcttacctttcatcagcttcattgcagacctcagccctacactccagccaagctaaaaactctttgtggtttctcgaagttgtaattctgtatgatgtatcttgggcttttcctcctgcctagaatagtgatacctccgcctcttttagccttctgattaactattcatttgccaggattcaatccaaacgtcctttacacctggccacaacttctctaaatctgattaatatgaatacatttcaagcattttaatatacagattgtcagtcttttaggtgactaacatattgaatttactaaatttaataaatgcttataacatttttatagagtgagtggaattaagtctctggaagttaaatgacttattcatggtcctactgtaaatagtttcaaagccaagggaacaatctaagtaaaatggccagtggtaaagagctcatcctctacattgattttcagatcaaattctcttttcaaaaacaaaaatgaaattagatcattgatggagatctcattgagtggttccccaagtgctagtctataccattgatggtgaaaacgatgcaataataaaagaacagtagtttttcataagacgatacttagttgaagtgactgtcctttccattttttctttcttttttcctcttttgtcccctccctctttcctttctttctcccttctgctctttcttccaccctgtttcctctctttttccttctttccttccctccttgtgttaaaatgaatggtcttttgtgaaatgactgcttagttatggtatcagtttaggatatttgtttaagtctgttcttttaaaattattttacttgtcaaaatattaagttgggaaatggtccctaaaatattctcttaaaattgtgatggtctgtgaaattgcaaattctaaaatccaatgcaatgatcctgtcttttgccctgcttgcaggatagaataccttcaacattccaaacttaacgatgcacagttaaatacaaatttgtatcttactaaccccaggctgcttacatattgaaaagagagcctatggaattaggggttccctgggaattcttctcagtagtaggcaaaattaaaacagtaataactagtttggaagctctgaagagaaaagcaagacacatatttaactgctttttaattgcagtacaccagacactttaaaatatcatcacataacttgtacgcctctcatttaataaaaaagataaccctaaagtaacaatactataacaggaggttaaaaaataaaaggaaaaaactaatcttgctagaggtggcacattctgcagtgtgaaactaggtcaccactgacctggaacgttctctccaagttagaagattcttcatggaaaagcaggaagtctctgtgatttaatcaacagaactatcttggcatgcaggtcactgtctataagcacagaaactaaaacacatagctgctctgaggattccaattaaattaaattcttgagaactatgactttgtttgaattgaaatttgttttgacagtttgatggctttttacattttctggatcacaaaaatttttagggaaaattatttcatttgctgaggtttcttgttacacatggaagctaaaagtccctaagtggacctgggcatttcacagcttttgaagagtggttcaaagtttgtgtaagtagccaatatggaatttttttttatcaagatagtggaatttgaggatatcaagatttcaagtttagttttttggttcatttgtggattaataagaccatgggattcaatatatgtttctgacagtctacatctccatgtgcatgtttgttgggggcgatatttgattgggattttattttacaacatttttcatttatttcatttaatatctactttaaaacatgagattaaggaaatcccacaagctgaaactactttcaactctaaaattaatatgaaagctttatttctttcaagataaattagattttttttaaccaatcatttatgtaattttaactaaaatttaccaaggaaccggaggtattctcagaatgagaaaaaatatgtttgcttgatattcctataaatttgtagtgcctataatttgttaaataagcttgccaactctagttttatagcattagtaccttattttatagatttgctttattcttttttgccctgattctgtgattgttctctgtcagaagtaatcaacccagaatcaagaaacacagcttaatcatggccatgataaacagattaagaaatgtcagtaaccctgaggtctccttgagcaaatggttttggtattatgtctgagctacagcctaatagtcttataacttattcaaaaacaaattatatctgtcaatttatttaatgatttctaaactgcccaattaaacctatactggtttaatttatggaataattaaaatggacattgttcatggttgagaaataagcatgatcctgtttgaaatttcctaaatcactattaaaattagtctttcactgctgttagcaaacaaaacttgcccttttaacctgctaacacgtctatgaacatcccatttcactgaataatggtgaggggaagaaaatgacaaattattaagcaagacctactctattttaaacatttatagatagaactaatggcgatttgaacagtgaagtaatatgtctacatttcccaatgttttcatttttttaggagtatgaatttaaagagcttctaggatcttgctcacattcagaaatgaaactattggtatctcctgattttttttaatttgcttttcttcccacgttgtacctaaggatatatattttcttatttgttttttcttcttttatgagatgaagtctcagtgtcatccaggttggagagcagtggtacgatcatagctcactacagccttgaattcctgggcgcaagtcagccttctgcctccagggtagctgggattacaggtgtgcataaccgtaccgagtcaagatatttctttacatgtaaaaatactacaggatttatgctggtcaatgaaattttgaccatgttaacagttatgactgaaagaatattacttatgagaatggaaaaataggtaaaaaccagacacaactggggggagaatcttctattgctgtttctaccaaagttttgaaactacttttactatagttaaaaactgtgaattcaactgaagattataaatgttacagtgaccattcatgatacattccctatatattatgtgtacatctacatagaagcaagctattagtaaacagctttaaaattcactaactgaaattttgtgatcatctgaacaaactgagataaaaagtctttgtgttagtacaatatgaaaaaaaaatctatgtgggtttataactgaaacatgatttcaggacacagaagatattaggttcagcaatttagcttagaaaactgctttttggtagggaaaaatatgtactaagagaaattaataagttggttttaaagtaaggttatttgttagtttattttatgttaccatatatgtttgaaaataataaagtgaaattcctccaaaatattacatgaaaaagtttagttaatttagattggtatcttttgagggagaaagcccataatgtgtccttaattatgaccaacaaatcttagcattctgtttgatcattaatttgataagcctctttcataaatctgaaccttctgtcttacagaaaaagactaatatgctttgtagaaaaaactaatatgcgttggatttaaatgaactcttttaactaatgtaacataaactcttaatgaatgaattattatatttataaaccctcttagtatgagaaacactatggattaggcatatagaggcagctcaacccagtatacaaatcagtaagacttttaacagtatttgcctccctgctgcatttcaatgttctctatttgctaggatttgtactcaaagattcttggaggttattgtgttgcttaaattttcatacatgttgatagaaagggcattgatatcctctcttagttttctgagctagagggggcaaaaattatctttgataacatattgtagataaaatatcataggtgcccacagagagttgaaccttgtgactctgatttattgagtgtcttacaggccaattcaatagaatttcttttccagttagatagattccgttttgaagtctttttcaagtactatttcaagggaggcaagatgtggcaaaatcagcacaataatatttactctaagtaaagaaaaaaggtacgtggtgtgctgtttggggtacaaagtttttacttcctgctttaaataattctctcaagttgcagatcttttgtgatatgaaaaacactcgtgtaaataaacgtatagtgagtgggatggaatggggatagccaaaaagatgcacttaaggaaaaggggaatataaataataactctgtctctccatgctttcttctttctttttcacctccacccctatataagcctgggtaaacctcaattcagtggacaattttaagaatgcttactcattcatttaaaaatatgattgaatgcctacattatcaactaccaatagttggaaacaaggcttgagagagaggagagggagtcttgtgtgctacaccatggaatttgggcttactcttggcgtcttaggaacttgtgaagggctttgcctaaggcagtgtcttgatgagattgctttatagagagatatttctagcatcacatggagaatggttgggaatttatgtgcctacaaagagaagaatcttttagccatatagtgtaagagctaaaaagatagcatattatgttatttaagagccttggctctggaattacatacaattggatttggatcctacctctgctattctgggcagctctgtaaccttggacaagtcacttaatctctctggacttctgattttcatgaaattaaggatattacctggtattactcagatttgtaatataagataatgtatataaattgcttaaatgatcctggcacacagtaagcacacaataaatgttaattaaaaagcaaattatcagaagaaaaataaagaggagtaacaagaaccaaaactaagaggcagcaggacaagcaaaagattccagacagatgcagtatataaatctagatgaattcatgaccagctagaaataagtaagaggaagattttccagtcaatgctgtgatttcaggctttaaatacttgaagccatagaagctaaccttttcatttaaaaagatatatcctctttcatgaacaaaataaatatctctatgggccagaaaaaggataaaatgcataacaataaatgagtgttgaagctatatgccttttgaattaatatacattgaatttaaaataaccttatcataaatatcagaaacatcatgcattgagcatatggaggacagcctgttaggcacagtgttgatacattgctattaattaaatccattcttcattcatatttccttactttttacctgacatcgtttttcttttccaggatcctatccagggtactacattatatttagttgtcacatctggggtttttctcagctgtgacagtttatggtgtccttttcctagttacaatgctagagttgagctcttggctgcccctgactatttctggaccagagccctaaagggataggaagagccaaataggaaaggacgttgagaaccaatgatcagagacatagaaggcaatctttgttgtttcttcctgctctataatccaataaatttgttaattcttagcctctgctagtaattaggaaaacaaatgaaactatgtcattcatatgatgaaaagtacaaaagaagacgattaggatgggaccttgacatcctggaattagagaataaaggtgtttatgaaagctatgttgggaatggtagcaggagaagactctttattcaaagagagagaggaagcagcacattggtttggtatctattagtttttgcacttagtgtaaatcacacttaggattcattctgtttaaacaccctatgtattgcagagtcataccacatcacacggcctgagacctttctcctatattattttgggacttatagaagtcttaaaggcaaggcagcagagaataaatggctcaggacttgaaggcagttttatgatatgctacctgaacagggcagcagttgagtttacttttttttttttttttttggagatggattttctctcttgttgcccaggctggagtacaatggcacaatcttggctcaccacaaacctctgccctctgggttcaagcaattctcctgcctcagcctcctgagtagctaaaattacatgtgccaccacgcctgactaattttgaatttttttagtagagacagggcttttccatattgatcagtctggtcttgaactcccaacgtcaggtgatccacctgcctcagcctcccaaagtgataggattacaggcgtgaaccaccacgcgcagccaggtttaccttttatcagagggactcagagaggaaagctttaaagcctgaaatctattccaaagaattgcattccaaattttaatgtgcacgggggatcttacaaaaatacagatgctgactcaacagatctggggcggggcctacaattttttctgcatttgtaacgagattcaagatgatgctgatgctgatgctgccaatcctgggtagcaagactaatttaaagagcctgaaggctttcatcatcgaacagcacacataaaatacttttcactatttgatcccaagttatcatcctgaatcaagaatctatttatcttaacacgtgtgttcctttcccagaacaaactacccagttcccagtccttaacacctgtaagaaacctttagagtaagaaaaagaatatggatattattacagagacatccctgtagtttttatactataaaagaaatgaccacaaagtagtaatggataaaattgttttactaaaattagagcatttgagacacattagcagttagctgtgacagtatagtgtagtgtagagcagtgaaaataacacaggttcagatgtacagacacaaaaacattagaattagcaattcactggctattttagctctatcagtcattggctgtgttggtcaagtttgttggtcagtttttcaactgttaaatgggaataaaagcactttcttcataggatttgtgtgattattaaataagatagtgcatgtaaatctcttagtactgaatctgactagtaagtacttaacaaatacttgcaatttcattaaagaagcagaaagaaaatggaaagaggttaatagggggaagtaatagctaatcaatagtaagtggttttagcttgggaaaatacattattgataagtttttaatacctatattcatttatcctgaaagctagcacgaggttttttttgttttgttttgttttttttgagacggagtctcgctctgtcgcccaggctggagtgcagtggcgccttctcagctcactgcaagctccgcctcccgggttcacaccattctcctgcctcagccccccaagtagctgagactacaggcacccgccaccacacccggctaatttttttgtatttttagtagagacggggtttcactgtttttgccaggatggtctcgatctcctgacctcgtagcacgaggttcttggacgagaactatgatctgcagaaataacagcaggctggctcccccttccccagtctccaaggcgatgcaatgaaggtagatgtcagctgtacctacagggctttctactgcaaaaccgctgaaattatgaatctggacatctgtagaggagctggacagctgccctactccccctctggaaagaaggagagaaacttttgtccctaatgtaaaagagtcttctctgggaaagatccctaagtttttacagtcctttggaatataagaaaaatagctcagggatttagcctcctttgaaatgtaaacacaaagccccaaggagataaatctctgtttctctcctgagctatctattctatcaccatttcacccagttgccaattttctttgctcagaaagcctgaccctgtagcaacatgaaatttacatcatttcctgataattataaccctattataaagttacattaatggagaaaaaaattattaactacctcatataatagaaaaaaagtaaaaccatccctagcaaatcctcccctactcaaccttcatttctgataattataataataagaaaaacccaggctttctataaatttccttcaaatttttcattattagtgtgtgtcattcattccatacctcctaaataattcctaatgtgtgaactattttccttgtcattggatgagtagttataaagatagaaaacaaattttcaggctggctgcagtggctcacgcctgtaatcccaacactttgggaggccgaggtgggcggatcacgaggtcaggaaatcgagaccatcctggctaacacgatgaaaccccatctctactaaaaatacaaaaaattagccgggcgtggtggcgggcgcctgtagtcccagctactcgggaggctgaggcaggagaatggcatgaacctgggagacggagcttgcagtgagcagagatcgcgccactgcactccagccagggcgacagagcaagactctgtctcaaaaaaaaaagaaagaaagaaagaaagaaagaaagaaaacaaattttcaaaaatgtaggaagcagttctctagtttgaccacaaggcagataacacctgaccaaatgatgtggctgtgctctgtatggttcccaccaatgtacaaaccagaatggctttgagtagcaaggctatgaatttgcagtctccctaacatcagcatcaccgagaacacatggtcattgccaagcacagaaatgactgaagactaatacccaagcaattgctaaaggatagttgccaaagggaaattgctaaaggacatgtgtctccatgaacatagtcagatgtaacttgactaagctaagggctactaggaaatagcatttacatagcaatctcgccagccattttattttttaaattttttttttaatttttgtgggtacattgtaggtgtatatatttattgggttagccagccatttttaaataggtggtgctgggtcactcaaagcaaataatctgcaaacatgataggggaaaaagcagagacaaaagcctaacaaatgctttaagattctgagactgtctctgttgctcagatttgtcagccatttgttttttgattgtattttttctaaccaaactcacaaaggaccctgacaccagtggaaacattcaatcctcatgagaattcaaatccacaacattatctgttatctgaaaagcagttatcttggccagtttgaattgttatgacaaattaccctagaatgggtggtttaaacaatgaatgttgatttttcagttctggaggctggaaagtccaaaaatagatgctggcagacccagtgtctggtgagaacccacatgctggtttgcagatggccatcttctccttgtatcctcatgtctttatagggcattaattccattcatgagggcttcaccctcataatataactacctcccaaaggcctcattacttaatatcatcacattggggattcagcttcaatatatgaatttcaaagggacacaatattcaatccatagcagcaatgcattagatgatgcaaaagctagtaagacaaggcccctttctttaggagctgactgctagtacagtggagcaaagagagtgagggtgcagtgattctaataacacacaggatgtaaatgtcccaaggcaagtgcaaaatgccgtaagagtttaaaaacggaggagctcatatgtaatttaggaagaataaagcatggctccagaacaaaggaaagtctgaggtgggtcttcacctatggaaaggatttcagtaatagttaagaatcctagggttgggggctgggggagggatagcactgggagaaatacctaatgctaatgacaagttgatgggtgcagcaaacgaacatggcacatgtatacctatgtaagaaacctgcacattgtgcatatgtaccctagaacttaaagtattttaaaaagaagaagaagaagaattctagaggccactattgacagccagtcacagatttctacagtgaagataatgaaggagttccaaatggagacttgacgtagataggttcagggttcagagaggggggaatatactctccatcccaaaaaagaagaatggatcttgaagtagaaacctgaataaagagaggaaggagagaggaaaaagaggggagggtgaaattatgagaatgctgagccttacaccaccttcccacctcctctatctgtgactcctgaaattttagcaaagtttatacaagtcatgaaattctggctgtgattggattttctgtggaaactgatgacaggattaagttatttgtcctggctgaattaggcataaatagtgagaaatggttactcctagccaaatgtgtggtcctggacctgggtcacaaatattcagtccatagtggccatgtaggtattctcctgggattctaaatctcacatctggcaaattatgtgatttaatatcctgtgatcccaaagacccctttaggcctcaaattcttgaattttaatatttttaactgagattcattttattagtgctgtattcaaatgaaattattactttttaattttaatttttggatacaagtaaaaatgaaattatcttcagcattgatttgattttttagcacaacgcctctctaaataaagctcaaaataacatttgtttatgaaaacatgttcgatttcttgtatcatctcttttctactattttttttcccctcccattaagttttgttgttccaaatctaggcttaactcattttccaaaatgtaccaatttaaggttggacttgtttattgctcattcataattctaaccattcatcacattttgttgttttgcagtttcataaacttctttatttagcacaactctattgctggattaaaatgagcaacctttgtaataattaaatatctgtatagaaagggatcttttctcaacatgtatgctctttgttttggtttcatgcccccagatagttctgacaaactcaacaattgtgaatagcataaaaacaggctttttgcatgcagtaaaacaaagttaaagtttgctcaaaaatgcatgcagagtgaaattcttcaacgtggggaaaaggaaaaagtatggaactgcatatgctggatgctatgcattattatctcatttaataatcttaaaaaccttatgccgtaggttttttacatcttcattttacatgtaaatttcagtgatattctatggcttgcccaaggttgcctacctgtaaaggggtagagtaaggctttaaatccacatttgacttcaaagcctgtcttccttccattaaattttactttctctgggtacatgtcatactatcttgtggccacttatttatcagatgagataatgactgtatcaactctgtataaaccataaagtgctacataactatcacttatgttgctgtagttgataaaagtgaataagccatttaaacttcctaagtaacaaaaataagtaattgataagcccaattatgcacttagtcttactgccgtaattttacttctcatgtgtatatctaaacagtattttgtaatcaatacattactgccactgaagcattgaacatgcccgttccatattgtcaaggtttgaaaattcattgtatgatttagttgtgctggggaattgtgtgtgtctgtgttcttcagtaaaaactaaatacgacttctataatttgcatattttactccttagtaaattatgaactgataaaattacagtggtttttttgatgaaaatcaaaattaagctcggtaaacatattgctaaggaaatggtaaattagaaaaaccaaaagaaaaggttaggatctgcagtgggatgtagtatgaattctttaagagtgaatcatgtccaacaacttttcttaggaatatgaaaatgccatagagaagtatgttgattttagcagatccttttacaaacttatggctgtcatttagaaagaaagagaaatgcacatgagataatactcctagttttgaagagtaataataaggggtcagatgggacagtggtccctagcgctgagccaaagggcctgagtttcgggctgtgtctcatctagaattcattcatatctttgactcatagagaaaagaatgaacacaatgctgagtgagatcaacatatgacaagataagttcactttcaatgatagctgtaaatagaaaaaataatatttatataattgattcaaactttataaaattgactcaaatggaaaagttaatatttaagaaatttaaatatttatttcttttctgtctttgaaaaagtcaagtatacatatacagatttcagaacacttggactagcagcaatttgggtaaaaaagatccagtgagttcatttggaagcttgttctttgggagtgaactgtcaataaagtgacatagcaagccaaaaaaggaaaataaagttaaggaatcaggagcacagagatacatgttaacagtggaacacccgaggagcaaagatcaaccattgtttgtatgggttccataggtaaatctaaagcccgtgggtaaaagttccagaaagatcactatttagcttaatgttaaaaaggactatatgaaaataataaatatatataagggattctagacaactctgtcctagagtgaatctattttattcttttaaaataacatttttcatttttgcacaaaaccatgcttatatctgcaccattccagtttttagaatacacaacgttacaatcaacttgtttgcattttgatacacttctgttttcttttccctctagtacttctgcatttctgccctcaattagcattataaaagaggctaaaagccatggctgttgtattagtctgttttcatgttgctaataaagacatactggagactgggcaatttacaaaggaaagaagtttaatggagaactcagagttccacgtggctggggaagcctcacaatcatggtggaaggcaaggaggagcaagtcacagcttacatggatggtggcaggcaaaaagagagagctcgtgcaggcaaactcctgttttgtgaaaaccatcagatctcgtgagactcattcactatcacgagaacagtgcaggaaaaaccatcccccataattcaatcacctcccaccaagttctttccatgacacagtgggaattgtgggaattacaattcaagatgagatttgggtggggacacagagccaaaccatatcaggtgcacagccagatatatcctgatttaaatccaggcttaccatgtactatgtgatgttggaaaggtcacttaatttctctgaccctcattttctacatcagtaaaaagatattctctatatcactatgttgtttcaggacagtggactatgtgctttttaaattaggatatcctttaaaatatgttaaatatttaacaaataatacccacaagtaacagtttataaaagtatgataattcatgttttaaaacatttagtagtgtgtcagacacatagtaagtggtaaataaataaaagtgaataactattatgttaatgtgaaacaaattcgtataatgttgctccttaaacagtgtttcaaatttgtgaggacctgacacaaatcatttattttcacttcatgtgcctctaccaacaagcataaactcatgctatatgttcttcttagaagcactgtattgtttacattaacctctaccaagagaaatacaatggtgaagaaatgaaagaacgattcatttaaaacattggtgctagcatgtactgcatgtttcaagtagtatcataaaaccatatctaccctgcaaatatttcctcttttagtttgatcccaaaccaaaccttttattcttgcttaccagtacctcgccaaaactgagtttagtaaattggtggctgatacctgagaagcaaggaagcagttccccagggtgtgattagctatggaaacagttgatttcagtgagggttggagaagcagggagaggatttaacactgagtggttaaaaatagttcccaaggggaatctagggaggaagcagagatcttcaaaagtgctagagaagaaacacataaaatgaagtagggataagataccaacattttacccaggcccagtgtttactgtatgtatttggtcctggctacctgtatcattttgtttaatctcaagtatctaacttatgtgtttttcactttcatttagcaaatggacaaaattaaggctcagacatgttaaggagcttgccttgagagcccagttagtaacctagagtaaggacttgagtctagcttctgtacaaaagctgtgctccatgtcactgccttcagtggataaagtgaccctttcttttacaaagagggcacaattatttcacaattttaataggtaggcagattttttcccaagacctttagagataattttttagatgtaggcaaagtgttcagcagctaagtttatacttggagattactatgaatatcaaaatcctaaaatgaatcaagtttacaagaaagcaaaacaaagcaacaagtagcctaaaactagtgtttattaaactggtgttgcacttgactggggaaaacactcccccctacacctagatggatttttgttcatcttcaaagggcaactctaggaaaatttggaggcagagcttcctaaacatgaaattcttattaagaacttaaaaagttcttaagaaaagatgtgttttacttcccaatccatatttccaccaacgtttgttaagaaaattatatatatgcatatatcacatatatgcaatcataaaattattctgtcttagtaaatttccagtacgggttaggcacctatttttttttcttttttaatttccattcccttcagtaaaactgtggtagcattattgcataaaaatagattcagtttaaatgtttcaaatatatcatgctgttagcaataaccacgaagtagtatcgctgcaagaaagtaaatttctcattatttagcttgatgcctagggtcatgagaagaaaaaaaattaatataattatgtgtcagttctggcatctcagaagaatcttactttaatatttttagcaaactctcaccattctctggtttgttctgcttttcataaatagatagtttgtgtcaacgattgcccccaaagagttgagggtatgctatattattttttgcccttaactgatttcaaatttaggttgtaagtccattagcttttgacttaagacacaattctgagctcctatttttatgagtcctattttattttctgtgataaaaggggctgcacctattgtagcttgctctgaatttgtatattggaggagtctacagagcagaattgaggaaggagaaagagacttcctaatgagcactgcactcatcattcacagaattccatgaatgttttattgattaagtactgtgctttgaattaatttaactagtttaatttatgtgtgttcatgtcattgttttttcatcctttttttaattccccacctgagatgcagtgtattcatctttgtttttcttccatgtttatttcatttttgtgggggttagaggttaatgattctgaacactgcattcacatcaaacaaaagataagaccaacaaaaaatcctgtagaaattgtgtcattcttaaccacaactggtatggtatctttaaaattttatgaaaagctactgccttccttccttagagaggagagttgatttcttcagatacaagtaaggtgaatatccccagatgaatattcattgatgagctgatactgtgtgtcagctaaggtttgcttaggaaaactgaaactgctctagatatttgaccaagaaataacttcttaatacagggaattatatgcctacaaagctatggaaagggctgagggtcaagttcagaggaattattgctgatttttagacaaacccagaaatgtcaatatggcaggaagctatagccaggctttcagctgcctgcagtgctaaagtgaataatttgttgagacctaaccaagaagcctttgaaaacctcccattgccatccagccctaagtctaccatgtcacaaatggaggaaaggaatgacttctccatatcatctcctttccaaatcttttatgaataactctccttgatggaatttaaatggagcccttactattaggagaatttggaaaatgtggttttcaagcttctaactctttgggtcattgtgcttaataggtcagggatgacactgcattgacatatatataataaaaagcacactagtcagctcctataagtcttatgcagaattttatttttttcccaaagcactggcctgagtaatgttgaataaattaacactctgaatgtttatgtacccactcttatcctgtctcttaattgtagaaaggataagctttttctttttctttttttttttttttcatttataagatggtgttcttgtcaaggcataaatccaaagggaggcagatgtgcaacacacaggtaataagggagttccttagcaatcaatgagatttgaaatgtccagcttttctttgcctgtatgagcatttttgttagaaagtttgatcacattaaaaggtgaagcatgcagaaacctatttcagtgttttcactttatcttgctttagaagctaaaaggttatacctcatcatggaaatgttctttacagtatatctgatttgttgtctattggaaagcgattatgtctataacatcagtgaaaagagctgtagggaaaagagcaatgctcttcttgtgatgtttcattctttttgactgacatagcactacgaaaaagtattctgttttcctctgcaaataaaaataatggaaaaaaatatataatgctgaatctcgtcatcacaagagacggattttccctgaaagtttgtattaaagattatatggttgtgttggaacaatttgtaaagtttggaacaagacaatagtctcaattagctccaaagtatctcctattatttaattaattttttttgtgactatcctattataagaaccttcacaatggccagcacacttacatagactggaatttcgccatccggatttggattagcttattagagtttattactgcaaaagtgattatccagaaacaatattgcccatcttttaccattgttatttaacatcttctggaagtttgacattagacttttttaaacttggcactaacgtcattttgggccatagaattatttgctgtgaaagcggtcccgtgcactacaggctgtttaacagtatccctggcctatacccactagatgccaacagcactgctcccagttgtggcaaccaaaaatgtccccaggaattgccacatgtaccctgggggcaaagtcacccctggttgaaagctactcttctagacactgccgtataatacaaaacagaagtttgaaacaaaggtactgaaagggagataaaaatgattattttagataatgtgattgattgtctgaaaacaagacattcagctggaacgttatttgatctaatgacttaaataaagtagccaaaacaacataaatgtacaaaaatcaataactatcaataacaagttagcaaaggtaatttagaagtccgttttatactgggtagcaaaaacaaaagaaaaaactataaagaacacaagcaaagtgtgtgtggatattataaaggagaaaggaatgaaaatcatttcactcttccagacacacaagcatactgtaaacctataataattaaaacggtggtacacagatgaagtaactaaccattagaccttcatgaaatcttctttaaagtatatctgactagacaagtagaacagaattgcctcaaaactgactttgatttacataacaaagttagttttgaaaggaagccccacagatcaaaaggtaaaggaaggaaaataggcttataactgtaatcccagcactttgggagactgaggtgagtggatcacttaagcccaagagtttgagattagcctggtgagcatgcaaaacctgtctctattaaaaatacaacaattagccagttgtggtggtgcacagctgtagtccctgctactccggaggctaaggcaggagaattgcttgaacccgggaggcagaggttgcagtgagctgagatcgcaccactgtactccagccttggtgacagagtgagattctgtcaaaaaaaaaaaaaaattgaatgatgcaggtataattggttaatcatttggaataaaaatgttaaacacttcacacattacatttcaacaaaataaatgttgactgtcacgtgtcattcggtagggtctcattctacccgagagtctgtcttgtctttttcaccaggctacaggacattcaccccaaggcgtagctgagtcatttcgtgctttacccaccacagtttttgttagatacctctggcatgtaattccacatggggatatgcttagctttcatcgtgaatgtcccttagctgttgtccctgctaaactgtgctcactttggggagacttctgtcattgcattcccaggatctaacacagtggacttgttatttgttaagtacatttataaaaaggatcattcatttttaaaattgtggtaaacatatatgtaaaccaacatgtgtctgagacaggtctcaatcaatttagaagtttattttgccaaggtaaaggatgtgcctggaagagaggtctgtacttttctccaaagatgattttgagaccttcggtatttaaaggggaaaagcgagctggaaggaaaagaggaagggtatggtcacattactgaatcaaaatgttgcaagaaaaaaggagcagttaggggaacagtcaatgatgtattcccctcatggtcagtaaatcagtgctctacataaggtaaggtgaacatagagaagctacctgtgcagacagttaactttcatctgcagctatttgcttaggcataaaaggaaaagcagttgcttgcgtgactcagctttcaacttaattttctccttttggcatagtgaattggggttccaagtttttattttcctttcacatacataacatgaaatttactattttaacctgtttgtttttattttttagacggagtctcactatgtcgccaggctggagtgcagtgatgcaatctcggctcactgcaacctccgcctttggttttaagcaattctcctgcctcagcctaccaagtagctgggattacaagtgtgcaccaccacgcctagctaatttttgtatttttagtagagaccgggtttcaccatgttggccaggatggtcttgacctcctgacctcatgatccacccgcctcagcctcccaaagtgctgggattacaggcgtgagccaccatacccagcccattttaaccatttttaagtgaacagttcagtggcatgaagtacacatcgccaccattcatctccagaacattttcatcttgcaaaattgaaactttgtgcccattaaactccccattcccgctccctccagacactggcaaccatcattctattttctgtccttgaatttcactattctaggtacctcatagaagtggactcacccagcatttgttcatttgtaactggcttattcagttagtataatatcttcaaggttcatccattttgtacaatgtgttagaatttcctttctttctttctttttttttttttttttttgagacagagtgaaactctgttgcccaggctggaatgcaatggcgcaatctcagctgactgtaacctctgcctcccgagtccaagcgattcttctgcccagcctcccaaacagctgggataacaggtgcacatgaccatgcccagctaatttttgtacatttagtagagacaaggtttcaccatgttggccaggctggtctcgaactactgacctcatcacctgcctcgtggatcacctgccttgtcctcccaaagtgctgggattacggttgtgagccactgcacctggccagatttcctttctttttaggaatgaatattattccatcctgtgtcacattttgcttactccattcatttgtcaatggacacatgggttactttcatcttttggctatgtgactgatactactataaacatggacgtacaaatacctgtttgtgtccctgctttcagttcatttgggtatatacccagaagtggctttcctggatcctatggaaattctatttttaattttttgaggagccaacatattgtttctcatggtgggaattttaattctcaccaccaatgcacaacagtccaatttttcgtatctttgccaatatttcttattttctgtttgttgtatttgtttttaataatagtcatcctaatgagtgggaaatgctatgaatctttcatttttatacctagaatgtatctcagcagttgtctcatttgacttactcattacaccttaagcaaacctagactcagattcatgggatttactctaggttaaacgactacttaacatctttcctgacccctggtccagtgctcctcccaacaagccaaaatgtccctatggtcatacaagtagacacaaagaggaacaggccagaaactttctattttaactttatctttgcctccctcttgctttatagctaaacattttctaatatctcactataaaaaagagagaagaaaattataaggctatagaggcaacaactataaaaatgttataatatataaaaagctcaaaaagaaacatgagcaaatattatttcctccacaaactaataagtaaggatgaattaaagagtagtttacactctcttgctcaacaataaattataagcagccaaagtagttttaatttattagtatactgtatgtttaggaactcgatgaagtagtttggagggaatggctacatataaaggagtgctcagcatattagtgggatgtgtattgactattgctttgtcattttctattaatatgaagagatttggatttgatttttagagttctcaaaatatttgggaattcagaggtaatgtagtctgtgaatattataaaatgtgccatttctggcagcctaaaaccagctgcagaaaaagaattgcttgtctaaacatccaatcacagaatctttccctttcactgaaattgatcacaacacaaaaataacttccgcacatccatgaatatattaaagtggcataaagaagaaattctgttgcctgcaaagattacacctgcctcaaagtcatgatcaccggaaaaaaaaacaaaaccagtgaaataaatctaagatatggctatttcctccagagaattgaaacagcctaaatagaagcaatgctccttgaagcaaaggaaattcttatgtcacaaatcctactgcaaaacccccaggcccccttgtattttcccatcacaaacatatcaaacatttttttttttttttgcagttagctacatccttatctagaccataagctccaggaaggcaggatttatggctacttcgtttattactatctccccagcactttacttgagactagacatataggaaatagtcagtaaacacttgttgaatttgtgaataaatattgaatattagcaaatatgtatgaacacaatttagaaacttctaatttttaaaagctttgaagttttatttctgcacaggacacaaagggttttttcttactaatttcctcatatctatttttaaaatgatcactatcttaatccgttcagactgctataacagaatactatagactggatggcttataaacaacagaaatgtatttttcatggttctagatgctggagagttcaagatcaacgcacctgcagatttgatgtctggtgagggctgcttcctgattcatagatgactgtcttttcacaatgtattcacatatgcaagggatgaggaagctctctggggtccctttataagggtgctaattccattcatcatggctctgctctcaggacctaatcacttctcagtggtgttaccttcatataccatcactttttgtgttaagtgtcaacatatgacttttggacaacacaaacaatcctattttatctcctgctttggagaagagcattgtttagcagaggtcaccttgaataaaaacaactgatacttctcaactcttagtgtctgcctggcattgtgctaataaacatttcctggatatctaatttaatccttatagcaatcctgtgaggcagatgctattgtaattcctatgccacatatgagaaaaacgtggcttgaagagcttaaatatctacccaaagtcattatgccactaagaagtggaattcagtcacctgtggtgttaattttggttcctactggtaatggactcatcagatgttcaccagcagatagtcccagagtgctgtctctgaggattccaatggagaaaaatgttatagccactactctgaaaacacggagtgtacactagacaaagaagagcaagggcagaaatcacagtgtgttcacacaacagcattccatgcaattgactcatagttttgcatggcaggggaggcctcatgaaacttacaatcatggtggaagggggtaagacctccagaagcctcactcatttggatttcacctatggtagaaacaaatcccctgtgatatggtttgactctgagtccccacctgaatctcgtcttgaattgttattgtcataatccccacacgttgagggagggatgaggtgggaggtgattggatcatgggggctttttctcccatgctgttctcatgatagtgagtgagttctcatgagatctgatggttttataaggcagttttccctgctcttgatcattctctctcacctgttgccatgtaagacatgcctcttccccttccaccatgattccatgattgtaagtttcattaggtctcccctgccacatggaactgtgagtcaattaaacttcttttctttataaattacccagtcttgggtatgtctttatagcagtgtgaaaatgaactaatacaccctgtctagaacaattaacagtccaaactaagtgatgaccaagcaatgcagaaaagaactgttaaaatgtttaagtactcaattgtttattctagaatggccctttcttttatccttcagctatctagacctgagagcttattaatgttctaaaacttaatttaaatgctacctgtcctctgaaacgtactcccagtcccaaataaatctttccttcctcagtgcatccattctgttatacctttgtctatttaggcgtttaattggagtaatgtaattcaaagagtttaacatcaagagcagttacattttaaaataagtaggtaaattatctggaaaattcactcattccagaacactatatctattttaggaaatagtcaattaaacatcgtattcaaccaacaaccagccatatagggctcaataattgctgtgattagggaatatttcttgttgaaatgagcaaaatttggttgaaacataatgattaagaaactaaatgagccacagaaaatccacttgaaagttctattcacttaaggtataaatacaaaaatatataaacttttaattagctatttactttagtatatggttcacttttttgcttatataggctaaaataaagtagccttttacttgaatactggcttttggttgtgataacaattcagtttcaaatgctgaaggcaagtcttagtttaatatcttagagaaagaggagagaggatgagagggacttcctggggatgtttctttgtttctctgctaactaaatttttaagaagatttgacttagaaggagtgggtatgtctgggcacaatggctcccacctgtaatcccagcactttcggaggctgaggcgggaggatcacttgagcccatgagtttgaaaccagcctaggcaacaaagtgagaccctgtctccactatacatatatatatatatatatatatatacacacacacacacatatatatatgtgtacatatatgtgtatatatatgtgtgtgtgtgtgtgtgtgtgtgtgtgtgtgtgtgtgtgtatttatatatatatagcggccatggtggtgcgcactgtggtcccagctacatgggaggctgaggcaggaggattgcctgagcccaggaggtcctggctgcagtaagctatgtttgcaacactgcactccaacctgggtgacagagcgagacctggtctcaaaaaataaaagtaaaaataaaaggaaggcagggttcaataaataatcatttgtaccgaatcagctagggtgatcattcatactaggggaatacttgtataaagagaacagggaggatttattcatagtttgagatactaagttttacctctggtaaaagctgccatcaccctttctgcttgcctgtagatcaagtacatggcagaaatccatgttgttggaagacttgcagctgagatgagaaaccagatgatgctttctattatgagtctattctaagtagtcccatttctatgtatcaaatgaataaattttgttcttgccccccacctctatatgaatattctgtgtgggcagctagctatgctttctattcttaggcagaaatatgtggctctcgggcctaaactattataacatttaaaaaccaaatttgaattcagtacattcaagcctcttagatccatagggactttagagacattaaaccttaaggcctcctgatagagattattttgtaaatttagctcttaattggccatatatattgatggaaagccacaaagcaaaagtgcatgatgatttcatttattctctgtgtcttcctgagagaggattcagtaactcttgcatttgcaaaagataaaatagatagcttttctgatggatggaggtggctgaagactatatttatccttagattttcagatatgaaattcatttgaaatgcagttaagttcatttgtatgaatatttcatttctcttaacaatagtgacattggtgggttctcagtttacttaaatccacatgttttctctcagcccaagtgtggtcatagtggtcgatgatttcaacttgtctctccaaataaataatatcatcctggataacaaagactgttttattctccttctcttttattcccctcacactgatcagagtgctgggtgtgcagtaggattttataagtatttgccagcatcttaggaaagaaaatttttctaaaccaaagagagaaaaaaaattgtaggcataaatgctaaatgatgagttaatgggtgcagcacaccagcatggcacatgtatacatatgtaactaacctgcacattgtgcacatgtaccctaaaacttaaagtacagtaataataaaataaaataaaataaaataaatatattcatactgtggaaaaaaataagcctaaagtcttgtactttaaaaatcaaaactcaaagtaaacttttcatgcaattttcttctttttttttttttttccagacagggttttgttctgtcatccaggctggaatgcagtggtgcaatctcagcttactgcagcctcaacttccctggctcaagcaatcctcacacctcagcctcccccataggtgggactacaggtgtgtgccaccacacctggctaaatttttatatgatttctagagaccaggttttgccatgttgcccaggttggtcttgagctcctgagctcaagcgatccacctgcctcggtctccaaaagtgctgagattacgggtgtgagccaccatgtccagctgcaattttattcttatataatttgtattccagtattagattttaaaaatcaccaaaacattatataatactaagagcaaaatgtgtataatctatacatccacctccaccacccctaccataaacttcacttcttgcctccagttttcttaagattcggctcaagtagcatcgcttccaggaggccttcatagtgcctccgcattggatatcttatgctaaaaatactttcttacccattaccttaagctccctgatggccaagtgaatatcccatttatcattgtttccaaaaacctagcaaaatgcctagcatgtagtaaacattcaatttaaaatgttaaacctaaatgccagtcatttatatatgagttttcattatcctggaattttttttctctttttcatcatctctgtaacatccaagtcccaggatttgagttaccatgggttgctggagaccctcaccataacatcctctatgcctgtggttctcaaacttaacattagagtcacctggagaatttgaaaatagatggatgcttgtaataagacatatcaacatcatgtgccccggatgtgatatacagagaggggccacaacgtggcttctgcagtatccttctcaaaagtgcataacccagtttaatcctgagaaaacatcagacagatgtaattcaaggacacttacaaaatagccagcactcctccaaatggttattgtttttttccgcaagggatttttcaagggtgaaatgattcattttatgttatataaatttcacctccattttcaggatctaatgcaggatcctggattggaccctgaactagaaaatggacattactatgaaaactggtaatattcaaataagaccggtagattagttaaaatattctgtcacatgtcctaatttcgataattgcactatggttaggtaacacaattttagaggaatctgggtgaagtgtatatggtgactcttaatgccattattgcaactttactgtaatctacaattatttttaaatagaaacttaagcatttttacaaagtgacttatgtcacccccagatgtgaaacctgggcattgggacctttaaaaatccccacaaattatatgagaaccagtgctctaagccaatgttagttgaccttggttgtccattagaatcagcagggaagattttttaatatcttaatgctcattcttaaccccagattaaagcagaatgtccaagagtaggaccaaggaattgatatttttatttattttaaactttgtgaaaaaatgttattgtatatatttaaagtatacaacaggatatctatatagtaaaatggttattataataaaacaaattaatgtattaatcatctcacagttaccagttttagtccctgtggcattagcagttgtaatgtactcatttagcaaaaatcctgaatacaatacattaactatagtcctcatgttgtacgttagatccttcgatgtctccattctacatatgctattttgtgttatttgatctacatctccccatttctccctctgcccttacccttggaaaccactgttttatattttttaaaagctcttcaggtaattccatgcaagtcatgggtgagaactgctgctgcaagctaaggttcccaaatgtgcatgataataagtatattgtggaatggtccaggatcatgagcattttaatgtagaggctcccactaaaaatctactgaatcaatattcagggaggatagtattttaacattcactcaagatgagttttattatcagaaaagtttgggaagtattatatgctgtctagaaattctaggtgtggtccagcttctgatagtgaagtttaaggccctactaagagatctttcacacagctggtagtagcaggaaaatgaagagtctatagatgagaaatccccaattccaatggaatataagtaattgtggccattatttattcactaatgattttctaagcgctttctgtgctcattactaaagacagagtagtagacaattaagtccctgacctatagaacttgcattccagtggtagagggatagaatgataaataagtataaatgaatatgataaataatttataaatgaatatgatagtttcagataaattactattaaaaaataattttaaaacggcccaaatatccataaacagatgaacagacaaattatagtgtgtgtgtatatgtatatgtgtatgtgtgtgtgtatatatatatgtgtgtgtctgtgtatatgtgtgtaggcatacgtatatatatgtacatatatatatatatatacacaatggaatattaaactataaaaagaaatgaagtactgatagatgctatgatgtaaataaaacttgaaaaaacttagttaaatgaagtaagacagaaacaggtcacatattgtatgaatcaatttatatgaaatattcagaaaagatcaatctgtggagacagaatgcatattgatggttgccagggcctggggtagccaaaatgaggagcaactgcttaatggatatgatacttcctttttggtgatgaaaatattttggaactggatagaggtggtggttgcacaatgttacaaatgcactaaattccactgaagtgtccactttacaataattttatgttatgcacattttgccttactaataataatttttaaaagttccttatgatgtcatcagagagagatgtgggacagtaagtgggtacttgagattgggccatcaaggaaagcatctccaaggaaattgcttttaatttaagacctaaatgataagaagccagtcatgtaaacatcaagaagtagagaatcccaaatgaatcctgcctctgcctttattgtgtgtgtgtgagctgggtggaatacttaatatctctcagcctcatttgcttcatctgggaaacaggattatagaaagatctaattcacaaattgttctaattaaatgagatcatgcacagaaagatgagcttagtaggaagtcatatgtccttaagaatcaaaaggcaaaaaaggaattgaaaactcactccagcaaaagctgatcagaagccccttgttatgcaagatgaccagctaatgccaagtctgttttacataatctttcctcactgattatgtaatgattctgctggtgttgcttcacagtcacttttctgtgtatatgtttcaccactaaatgttctttctaactcactgtgtttcctaacagctagtctgagctttcctcccatagctttgagccgtggcttcttgctctcatcatccaagactgagcaattcccttccctcattaattttgtaaccttgaagatatttacgcagtttgaacaaatactcacctgcagttttcttttttccccaaactcttatatgaatctaattctttctttttcttctcacacataatatacaaactcaaattcctttctccctttgtgtttgctctaattgtggttaataaaacatttcctacattgagcccttccaattaattaagattattttcctgttctaattgaggaaatatacctgaaaagctgatcaacaggatttaaagacatctttccactttattggtacttaaaaccattttcatttcttgctattctttttaaggtaagctgaagcataggaaataattccatacatagctgtaaggtaatgttcaggttaaaatgaaattttaattatgtaaatcatatagtttggggttatgttattcatagagttctagactaaagtttttcctcaataatgttggtgattgacaggcaactcaggtgagtagcatttcctaagcttgtatatctgagctacaaaattctatacccataaattagcagaaagcatggtaaaactactgttttttagaattctacttttttttttttaaattaggaataactttactgcaaggcaactcaatttttttttcctagattccacatgttgaattcatcacataggatactctggcaacaaaaaggaatattgggacttagcatttattcgctctctctgcaggcacctaatgatgaatttagctaaaatgctgcaagaacaagcccttacagttgtacataaaatctgctgtcctatgcagggttaaaggccacacatgttggtaacagaatttttctctcagaagtgggttctttgttgagacttgccttgttccttttgtttttatttttaagaagagacttccatctcaataaagaaggaaaaatcaataagtgataatttaaacataactcagaaactgaattgaaaactgaagatatatgagcaaagcaaagtatattacattttactgtgattgttaatctctatgatttgaagtcagactggctttgaacttccgctttaccactgagtagatttttttaacttggaagaagtcattttatctctctaaacttccatttcaccatgtacagagtgggcgtaacaatcatggcttcacagagttactgtgagaatcacatgagtaatgaactcctaattctaggacatatgcataggaaaagcttccctcttgaagaggctactctggggagtaaaagcacatagccttttcgtattgctatgtaccaaagcagcccaaaagccagcagcttaaaacaacaaccatttatcaaactcagaattctatgagctggcaattccaaagccactgccctggtacagaatcaccaccctggattccccctgccaggtgattgacagtcctctagttcctagataatcaggtggcctggtaggccaaatggaggatccgggacagcaagggagagggccattggaaggctaaggcagcagctatatattagccagtacaaagtattctgatacacaatggttaaatgttggctatgttagccctgtcccattcatattacaatccttttcctgtccaggttgccccaagcatcttgatatcttattaatatacccataaaatagcagaaatcacagtaaaactactgttttgtggaattctactttttttattaggaacaaccttattgcaagacaaccgaaaatcttttccaaaatcataagatgatgaattcaacaagtgagatgaatcacataggatgtgagggcccaattagcattggtattccctatatcttcacaacaagtatactgcttatatccatgtgtctgtccatccctcctaccctaaatgccaataaacccacatcaagaacaagcacacattatatacatacttcttggaaatagggcaacaattcttaggagaaaaggtggtagtgatggtgtcttttcctgagaattttccaaatctttaagttggcttcccttttgattataaatttcacctttaattcatttttattttcttgcatttttctataatcagtgaagagaaaccatgccacgctctcaacactttacttagatatttattctctgaaataccccatttaatcactcagaagttctatcctccacaaaacactgggacacgaacacaattcagccaggttctttgtcactttataacaaggatggactttcctccagcttccagtagcatgttcctcatttccatctgagatttcatcagaatggcatgtactgtccatatttctaacaacattctgatcacagtcacacaggtaatctctaagaagattgaggctttctctacagctctcctcttcttctaagccctcaacaaaatcatccttacaactattttcctggtaatgtacataaaaatctcttccagcctttatccattagtcagttccaaagttgcttccatatttttaggtatttgttacagtatctccccacttcttggtaccaatttctgtcttaatccacttggactgctacaacataatatcatagaaaataaaaaacaatactgtaaaaccatagactataagacaaatttatttcttacagtactagaggctgagaagtccaagatcatagcaccagcagacttgatatctggtgagggttttgacccatagatggtgtgggtcctttttgctgtatcctcacatggcaaaaaggctagctggctccctcacctcttttatgagggtcttaatcccatttatggggcggaacctcatgacctagtcaactcccaaatgttctacctcttagcaccaacacactgcagattcgatttcaacataggaattttgatggggcacagagagatgggtagcttgaaaaaacatattcagcatttcaatgatatagcaattatatttgtcaagtgggacaaaaacctccattttttcagataacagaaaataagctagtggagatttgcacagacatgcagttcttgaagtagcaaaagagacacaccccatttcaaaagacatcatgggttaaaaccgagaaacatgaaactagagataatatggagaaagctagaggaaatatagtaatatgaagaaatctctggggtacagcccaggagcctatattttaaataaatgattcctagtggtactaaagttggaaaaccattggctacaaactattcactgtactgaggaaatgcagttgtaaaagggcactaacctggataataaagagaggtactgcagcttgctaaggcaagttcaagatatccactggttacagatttctgccctgtaagctgggtagggtttttcttctgtgctttttttgcataaatccacccttaagcccatcttgatagcaccaacactccctacttactcattttacttctatgggagttgtgtaaaactggctaggattgctcgaagcagacatccagatgtagttcccatcctgaaccttgacagataactggttcagattcttctgaagcatctgtaagacctggaagtcccatctgctgagcaggggtgctgacctgagtgactttggctccaaatagcactgaagtcacagaacactctccaggggccacaacaagtagatcccactctctgatgaaaccactctacttcagccatctcatttttacacaatatgctacaacaagcttgactttagaatgtgtcgaataggaacacgtctggtctgcagctcccagcaagaccaatgcagaaggtgggtgatttctgcatttccaatggaggtaccgagttcatctcattgagactagttagacaatgggtgcagcccacggaggatgagcaaaagcaggatggggcatcaccttacccgggaagtgcaagtggttggggaactctctcccctagccaagggaagctgtgagggactgtgccgtgaggaacggtgcattccggcccagatactatgcttttcccatggtcttctcaacccacagaccaggagattaccttgggtgtatacaccacaagggccctgggtttcaagcacaaaactgggtggccatttgggcaaacaccaagctagctgcaggagtttttttttcatacctcagaggcgcctagaacacctcaagcaagggagccaagtggtcttgctcagcggatcccacccccgccagagcccagaaagctaagatccactggcttgaaattcttgctgccagcaaaacagtctgaagtcaacctgggatgctggagcttggtggggggaggggcatccaccattactgaagcttgagtaggctgttttcccctcacagtataaacaaagccaccagaaatttcatactgggcagaccccaccacggtgctgcaaaactgctatagccagacttcctctctagattccttctctctgggcaggtcatctctgaaagaaaggcagcagcacagtcaggggcttatagataaaactcccatctccctgggacagagcacctgcaggaaggggcggctgtgggcgcagcttcagctgacttaaacgttcctgtctgctggctctgaagagaacagcagatcccccagcagagcgatcgagctctgctaagggacagactacctcctcaagtaggtccctgacccccgtgcctcctgaatgggagacacctcccagcaatggtcgacagacacctcatccaggagagctctagctggcatttggtgggtgcccctctgggacgaagcttccagaggaaggaacaggcagcaatctttgctgttctgcagcctctgctggtgatacccaggcaaacagggtctggagtggacatccagcaaactccagtagacctgcagcagaggggcctgttagaagggaaactaacaaacaaaaaggaatagcatcaacatcaacaaaaaggacatccacacaaaaacaccatctaaaagttaccaacataaaagaccaaaggtagataaacccacaaagatgaggaaaaaccagtgcaaaaaggctaaaaattccaaatccagaatgcctcttcttctccaaaggatcacaactcctcaccagcaggggaacaaaactggacaagaatgagtttgacaaattgacagaagtaggcttcagaagatgagtaataacaaaaatccaccaggctaaaggagcatgttctaacccatagcaaggaagctaagaaccttgaaaaaaggtgagcggaatggctatctataatacccgtttagagaagaatataaatgacctgatagagctgaaaaacagcacaagaacttcatgaagcatacacagtatcaatagccaaattgatcaagctgaagaaaggatatcagagattgaagatcaacttaatgaaataaagtgtgaagacaagattaaagaaaaaggaatgaaagtgaatgaacaaagcctcctagaaatataggactatgtgaaaagaccaaacctatgttagactgctgtacctgaaagtgacagggagaatggaaccaagttggaaaacagacttcaggatattatccaggagaacttgcccaacctagcaagataggccaatattcaaattcaggaaataaagagaacaccacaaagacactcttcgagacagcaaccccaagacaaataattgtcagattcaccaaggttgaaatgaaggaaaaaatgttaagggcagccagagagaaaggtcgggttacccacaaagagaagcccatcagactaacagcggatctctttgcagaaaccctacaaaccagaagagagtgggggccaatattcaacattcttaaagaaaagaattttcaacccagaatttcatatcccgccaaactaagcttcataagtgaaggagaaataaaatcctttacagacaagcaaatgctgagagattttgccaccaccaggcctgccttacaagagctcctgaaggaagcactaaatatggagaggaaaaaccagttatcagccactgcaaaaagaagccaaaatgtaaagaccattgacacgacaaagaaactgcagcaactaatgggcaaaataaccagctagccacataatgacaggatcaaattctcacataacaatattaaccttaaatgttaacgggccaaatgtctcagttaaaaggcacagactggcaaattggatagaatcaagacccattggtgtgctgtatttaggagacccatctcacgtgcaaaggcacacataggctcaaaataaagggatggaggaagatttaccaagcaaatggaaagcaaaaaaaaaaaaaaaaaagaaaaaaaaagcaggggttgctatcctagtctctggtaaaacagagtttaaaccaacagagatccaagaagacaaagaaggacactacataatgataaaggtatcaatgcaacaagaagtgctaactatcttaaatatatatgcacccaatacaagagcacccagattcataaagcaagttcttagagacgtaaaaagagactaagactcccacacaataatgtgggagactttaacactccactgtcaatattagacagaacaataagacagaaaattagcaaggatgttcaggacttcaactcagctctagaccaagcagacctaataaacatctacagagctctccacttcaaatcaacagaatatacattcttctcagcaccacatagcacttattctaaaattgactacgtaattggaagtgaaacactcctcagcaaatgcaaaagaacagaaatcataacaaacagtctctcagaccacagtgcaatcaaattagaactcagattaggaaactcattcaaaaccacacaactacatggaaactgagcagcctactcctgaatgactactgggtaaataacaaaattaaggaagaaataaataagttctttgaaaccaatgagaacaaagacacaatgtaccagaatctgtgggacacagctaaagcagtgtttagagggaaatttatagtactacatgcccacaggagaaagcaggaaagacattgaatcgacatcctaagatcacaattaaaaaactagagaagcaagagcaaacaaattcaaaagctagcagaaggtaagaaataactaagagcagaactgaaggagataaagacacgaaaagcccttcaaaaaatcaatgaatccaggagccagttttttgaaaagattaacaaaattgatagaccgctagccatactaataaagaagaaaagagagaataatcaaatagacacaataaaaaaatgataaaggggagatcaccactgatcccacagaaatacaaactaccatcagagaatactataaacacctctacgcaaataaactagaaaatctagaagaaattgataaattcctggacacatacacacacacacccccgccccaccacgactaaaatccctgaatagaccaataacaagttctgaaattgaggcagtaattaatagcctaccaaccaaaaaaaacctgggaccagacagattcacaagtgaattctaccagaggtacaaagaggagctggtaccattccttctgaaactattccaaacaatagaaaaagagggactcctccctaactcgttttatgaggtcagcatcattctgataccaaaacctggcagagaaaaaacataaaaagaaaattacaggccaatatccctgatgaacattgatgtgaaaatcctcaataaaatcctggcaaactgaatccagcagccattaaaagtttatccaccacgatcaagttggcttcatccctgggatgcaaggctggttcaacataagcaaatcaataaatgtaatccatcacataaacagaaccaatgacaaaatcacatgatttcctcaatagatgcagaaaaggccttcgataaaattcaacacaccttcatgctaaaaacactcaataaactaggtatcattggaacatatctcaaaataataagagctatttatgacaagcccgcagccaatatcatactgaatgggcagaagctggaagcattccctttgaaaactagcacaagacaagaatgccctccctcaccactcctgtacaacatagtattggaaattctggccagggcaatcaggcaagagaaagaaagggtatacaaataggaacagaggaagtcaaattatctgtgtttgcagatgacatgattgtatatttagaaaaccctattgtctcatccctaaaactccttaagctaataagcaacttcagtgaggtctcgggatataaaatcaaagtgcaaaaatcacaagtgttccaatacaccaataatagacaaacagatggctaaatcatgagcaaactcccattcacaattgctacaaagagaataaaatacctaggaatacaacttaaaagggatgtgaagaacctcttcaaggagaactacaaaccactgctcaaggaaataagagaggacaaaaataaatggaaaaacgttccatgctcatggataggaagaataaatatcatgaaaatggccatactccccaaagtgatttatagattccatgctattcccatcaagctaccattgactttcttcacagaattagaaaaaaactactttaaattctatatggaaccaaaaaagagcctgtatagccaagacaatcctaagcaaaaagaacaaagctgcaggcatcatgctacctgacttaaaactatactacaaggttacagtaaccaaaacagcatggtactgctaccaaaacaggtatgtagaccaatggaacagaacagaggcctcagaaataacacaactacaaccatctgatctttgaaaaacctgacaaaaacaagcaatagggaaaggattccctatgtaataaataatgttgggaaaactgactaaccttatgcagaaaactgaaactggtccccttccttacaccttatacaaaaattaactcaagatggattaaagatttaaatgtcagactcaaaaccataaaaaccctagaagaaatcctaggcaatatcattcaggacataggcatgggcaaagacttcatgactaaaacaccaaaaacaatggcaacaaaagccaaaactgacaaatgggatctaattaaactaaagagcttctgctcagcaaaagaaactatcatcagagtgaacaggcagccttcagaatgggagaaaatttttgccatctatccatctgacaaagggcgaagatccagattctacaaggaacttaaagaaagttacaagaaaaaaacaaccccatcaaaaagtgggtgaaggatatgaacagacacttttcaaaagaaaacatttatgtggccaactaacatgaaaaaaaagctcatcaccactggtcattaaagaaatgcaaatcaaaaccacaatgagataccatctcatgcctgttagaatggtgatcattaaaaagtcaggaaacaagaaatgctggagaaaatgtggagaaataggaatgcttttacactgctcgtgggagtgtaaattagttcgaccattgtggaagacagtgtggtgattcctcaagtatctagaactagaaataccatttgacccagcaatcccattactgggtatatactcaaaggattataaatcattccactataaagacacatgcacacgcatgtttattatagcactattcacaatagcaaacacttggaaccaacccaaatgcccatcaatgttagactggataaagaaaacgtggcacatatacaccataaaatactacgcatccataaaaaacaatgagttcatgtcctttgcagggcttgaaactggaaaccatcattctcagcaaactaacacaggaacagaaaatcaaacagcgcatgttctcactcataagtgtgagttgaacaatgaaaacatatgggcacagggagaggaacattacacattggggcctgtcgggggttggagggcaaggggagggacagcattaggagaagtacctaatgtagatgatggtttaataggtgccgcaaaccaccatgccgcttgtatacctatgtaaaaaacctgcacattctgcacatgtatcccataatttaaagtataataaaaaaagaataataaaagaaagtgttcatgttacctctcatggaattattttgttttcaaacttggtgcatttggtgcagtgaggagagagaagagaagaactttttcttttatacatgcttgctgtgtacatagagatttccaagatattgaatctatttagattcaggaaaggtggaccaaacacttcaggtaaattcctcaggttttaaaatgattactcatcgcttcaccagattctctgaaattttatcagcagtgtgtgctttatacagatgcttcctgaaaagggggagatacttagtttaatgccatggcttttgttttgtgcttacttcagtgaggaatgagttaaaattcattttttagcctcatctgtttacatttttttctatgagcagatggccagataattacctaaataaggagttacttttctggagttggcctgccaagatttactgtaataccaaatacaaatgctattacaatgaggaacatttggaagcttacatttgtgtgtcaaaatagtaaataatttgaaagctgtatcttttatgcatccttttaggacatgaagttttcaggaagagttgataagggtaatgcaaaccaaataaaggtaatgaaaactaaataatttttaaataattttctgcagctctccattccagtttgttaatacagaatatcttcaattaaaatgtaaatggaattcattgcatgaagcgatctatctggatgatatgtcatcattgaataatttactaacagccactgaacaatgtctaaaataaagtagaatcattgcttcatgattcaaattatgacatgttataatcattcctctttagtactagatgaatgtgagcctgaaaaagtttcttagccttccagagtctttgtgttcccatctacaaaatgaggaaatggaaacacatttcctcaggaatacaagattctttcctgatctaaaattctgtgactttgttatatcttgttttcttctgcactactgatcaagtaacagaaggaagactcatttcagactcagatatgaatttaaatcttgctttctcacttcctagctgtatgtacatgaacaagacacctttgcctgagctacttcatttggaaaaaaatggagaacacgtacctcatgggattacgataaataaacaaggaagtatttaaagttccaatactgattcttcacttatcaagtcctcaataagctgtatttcttttcttatattccatcattttagaattctcaaatctgccttttctatgaaaccttccatcctctcctcccaatagaaaagactacaattctggagaatgtactagacggatgataaaatatagatgagaattatagcagataaaacataaaagacaattttcccctcctcctgagttgtcttagtaaaaagaatgatggcagctcttgaagagagttgtccctcctgctgttcccttttccttttgtcactgaggtctcacatccagtttgcttttgtaaatgaaatacatccaaatcacgagaaagtggcatgcttcctgtatgatagaatacctttcctcattgctcctttccaacaatttttaaattatttttgctattgtatatcccaatttttaaaattaataccaacatgattatttgttcattatacaaaatactagaaaataaataaatgtaagacattaagcataaacacaccgtccagggagagctactttatataacttcctatattttctaactacatgtaaacattatgtaaaacgtgtacaaaacaagagttaatactatatatttctaatgtaagcatcagaataagtgttctataaaggctggggtgtgctttgctttgatatctgtttttcagtaacatgctggacacagggtacgtactggatacccttttaaacttagtatattccatatatctttttgtgtcaataaatacaattctgcagcatcacttttaatgatcacatagtattctacaatatagataaaatcaaaacttaatttatttcctactttgacttgtcaggctttctgtgttttgttcccccataacagtgttttaatcaacacccatgcaaacaaacctatgccccccttcttctttcttctcaatgattttgtttggataaattcttaaaaggagagttgccaagttcaagtaatctactcacaatttagggaatcattacatattgccaattgttctctaaaagattatatcaatttacaatccagtcaactgagattgagcatttttctgcaattgcacgtataggtattatgttgaaaaataaaaataaaaaacacatttaaaaagcaaatcatcgcatcctaagtgttgaacggcaagaacatccattcttcatgctatgttaccagcccacgacaactttccaaacccttttccagatatacaagatcctataacccagcgaagatgcagtctcactaaatcggtataaagagagttctgtcttgtcttactaatttgattaatttaggagaaatgacaggaaagttcatataaattgtccattgacattcacatgaattctctcactttgacattttaccattctacgtcagtatcactttcagtaaataatgttttacatgcagatagttttacaatgcccatttaaattaattctaaactgttatgaaatccataaaaacccttgtggaacatttgtagcttgtacagtagtctcccattatggaatcaaatgtgaaatgtctgtgtgggagctgttttcctaaggtaaatagattattatttatatctctaggtgcaaatgcttttaaataaccagaacatacagcatctgaatatgcccttacataattttcacagctgctgcattcttgtcagtgcactgtcatggtgaagctttgatgctttgatctgagtttgacccctggccatgattcttgcttgtgtttttatcatccactcttaatgtgaacaataaatctgataatatccagtagtgcttccttatgttctctgactttgacattcagaaaaatcattaatgctgcttccactgtgtctacatctccatacttgtgattttcttcccctttgaagatattttagaatacatagtcctggaagtccaggaccaatgactttgtattttctgtattgcatagtgctccgctttgtacttgccgtattgcatagagctcaatttgatatgatcaaatgatgattaccaagagctttagatatgatttcactttttatgaagtaaccaacatgaacgattaggaaggagcctgagtgatagggtgaaattggaggggagaaaatggagaatttagaaagattaagtaacagaaactctatctcaaattgatataaataataagagaagttcacaggcacatgtgcctgaagtacagaggtcagctgacttgagactgttctctcttctgaaatggtgcaagaagaacccttttccatcctgtgagaaggaccctttttcatgctgtcttcatttcctgactctgcttccttcatgctgactccattttgtgcaggcttcctacctcattgtccccagatgcctgtcttgttgacattcaggtttcttcctgattaagctgtccaatctaaatagccaacattctactgtgaacagttgggaacttgaatctcatacctgctatcttattcacattcagcaaacaagagcacaggtttttcactctcaaacaaaattactgagttttgacctaaacaaatcaccctagagcacttgcccattctataccagtaatgcagcttggtatggggtcatgccaattagcttagacttgagtcaaagattctaattcagaggtcaagccagctacccttgaagcacacgggacacattgttccaaagagttggaaccagtaaacaaatggaagtgctaccaccaagagcaagaggaatatatgctaggtggccaaaaaggcagatatccaccaaggtagctacaactaaatggaaacattgggttttacattagttagttcgggctgctgtaacaaaatatcatagactggtggtttaaaccagagaaatgtattttctcacaatctgaagtctggaaatcagagatcagggtgccagtgtggttgggttcttgtgaaggctctcttcctggcttgtagacagctgctttttcactgtgttcttacatgagaaagagagacagagagagagaaagctctgtggtacctctctggtgcccatcatgaaggcctgaccctcatgacctcaactaaacctaattatatttcaaagattccttccttaaataccattgccctgggagctagggcttcaacatatgaactgggtggcggccaggggtgtggcataattcactccacagcattcctcccctgaccttccaaaattcatgtccttcttgcatgcaaaatatatttattccatcccaacagcccccaaattattaactcattccaagatcaactctaatgtccaaagtcttatctaactctcatgtaaatcataggggtgagatacgggtgagactagaagtcgaattcatcctgaagcaaaattgctttccagctataaacctgtgacaccagacaagttatgcacttctaaaacacaagagtgggcaggcatagaatagacattcccattccaaaagaggaaaaaaaacaggaaagaaggaaggcatgatgggtcccaagcaagtccaaaatgtagcaaggcaaatatcatcagatcttaaggctcaaaaatagtcctttttggtttgatgctctgccctccaggtagagatggcaatgtcactcccatgacttgatggggtagccctgcccatttggcctgggattgctgcccctgtggctctctgcagggtccccactctttcaaatggaataagaaacaactcttccccctctgcctgtgatgggagtggcagccctggtgatttcggaatcaccttcaatatcatccttctcttttcttgaagaatagtgcattttcacaaccaaataactcaatggttccatcctatagattccaaaaagtctgacagccttccttcattttacctagcttccatcccttcagttcaaactggtaatgacccctatggtataatctgatctatatttctggcttccgctgggatggctgattaaatccattgttttcaccatctctttatcaagttgtttttaggccacatgtttagtgttctcttcagaaaaagctttctcaatttttcacaatataggtagcctgaaaatcttccaaatatccaagctcttgcatctatgcttaaaaattgcttctacaatttatttctctcttcttgcattttactgttagcagtaaggaggacccaagccctacctttgatattttgcttggaaatctcgtctgctgaacactgaatttcatcacatgcaagttctaactttcacaaaaccctagaacaaaattcagccaagattttttttgcttctacatgacaaaaactgctctttctctagtatccaataacgttttcttcatgtctgtctaagacatcactagaatcaccctttacatctacattcctgctatgcatctcaaaattcttccagcctctacccattgctcagttccaaaaccacttccacgtgtttaagtatttgttacagcagccccttcttattagtacagaatctattataaggaattggctaatggaattatgaaggctgagaactcccaagatctgtagtcaagcaagccaatggagacccaggagagctgatgtgtagttccagtctgagatcaaaggcatgggaaccatgatggtgtaagttctagtccacagttattacactggagacttaagaaaactgggtgtttcagtcagagtctgaaagccagaaaagattattatcccagctcaagcagtcaggcaagaggggttcccttttactaaatctttttgttgtattcaagtcctcaaatgataggatgacgtccatccacgttagcaagggcaatatggtttactcagcctatcaatttaaatgtgaaattcatcaagaaccaccccacccctgccccaccacagacatacacagaataatgtttggccaaatgtctgggcaccccatggctcagtcaagttgacacctacaattaaccatcacatacacacacacacacacacacacacacacacacacacggaaagcttgaagtgtgtgttatactttcaggaattaaattcaaggaagagtttattgagtgaaatgccaaaagcagagatgctgtattcagtaatgattctgctaaaaaagctcagaaacactggtcaaatactgactttttgtatacatatttgttttaatttaatgaaagacatgatttgaagaatctagactagattgctaatatatccattagttcttcaaataaagccattgtaaatgcttgagcagtattatattgctgtgacttcatgtttaagttctctaagaagggactgtagtgcagcattttaagataagtaaagcaagatgtctttatgcttaagatgtctgatctgaagtacccagatttctactgtgaagacttgagaatctaatttttatttggacactagaatgggaaaccatgtaacctaaaagtattcacaacattttctcaataaataaattccttgaatgttctccatcagttgattctgggccatgtggcatttaatgggtaatttttaattcaaaaaaaaaaagaaagcattcattcttagaagaaatttagatggcttctgagacatctggtttcaagtagcatggcactctgcactcgcaaactgctatattaattggcctacagaatgggctatttaagattagctatttaaatgttgggaaatggctactaaatatagtgattttagtttgggggtaattaatggtaacttaatattctaagaataataacaaaatccagctgcttctgccagatagaagcagtaacagttaggatactaatttgctcctataaaaaagccccaaaatgtttatttttgtctcacacaacagtctgaagataagtaacctcctgggcagattttttggtatcaagggtagattctcctaattcctctggcttccttaatattcaactcccatctctaggtctaaaaagcctttgctggtaacttctctcccactccaacatctgccagtggaaaaaaaggggggaaatgaaggatggacacagaaccctccttgtagaaacatgacccaaatgttgccacatcacttctgtttatctctcattggccacaaacatggccacacctagcactaagtaagtctaggagataagatcctttactggacagcattgggcacagttaaaccctgtatcttcatagaaaaaggtgagtatagacagtagggagaaagcaagaaggctttggcacagaccctctgaaggacaggggctatgccccatccaccaaagctaagtaaggggcatctgtccagatctcccagtaagtgtgccaggttgtccaaatagaaataaccatggaaagaacataagattcttatacacttatgaaaatagtgcttctaatgcagcttaccatgacttctagattccagcatgtaaaaaattataacatgtactctttacttctgatgtttttgaatgcccatttttaaaaagtttgggaaatactaaaaataaataaagaagatgacaatcaactacaattccgttagccagagataaccattaagttatctttagttggttttttatggcttttctccatgtgacttttcatttacataattggactcagttttgcattatttatcctgatattaataatatacatttttctcacaccattaaaatgtgattctcaatatcattttacatttgcgttaatttaacctgtagaagttccagaattttttcaacatattactgatgttagatgcttagagtttccagtctttattagtattaataatgctactatcatcatctttatgcataaattttatctgattttgtatttattaatatagaatcttaaaggtgaaataagctcaaatggtagggaaattttaaaggctcttaatctatattgctaaatcactttccaaaaagtgttgtgaaaatttcttcttaaactaattctactagtttttttcatatcaccctcactagcattattacaattaaataaatttgactcagttaattaaatgaaaatggacattcacagccccttgatgactgatgagacctcctatggtttcacatgtaccagcaatgttaccatgattaaattctcatattttgatcatgtattcatttcttgttttaatgcaaatatgaacagtcctgcctgtgttaagcatgaaggcaggtacaaagtaaatgaagatatctcatttaatgacccctacatttaatgatatacaattaatttaatgatagcaatcaacttgatccatccaagaaccttgaagaatatattaaaaaaaaaaaaaaagagaaaggggcttgaattactgattactgaaataaatgacacctcacttatgtgccaaagctcatgcagttttctcagaaggaaagactttaaattcttatttcaaagcacattaattcttaacctagataaaatcctaacacatttgattatatgattttcaaatacgtggcagattaaaaacagcaaagtagaaaggagcagcagacacattaacaacaaataatggtcactgagaaaatgacaaagagaagagatagaaatgtttataacacacacacacacacacacacacacacacacacacaaaaccctgaaattatgttttttaaaatggtgatgtttttaataataacagagtttaagtaaattatagctcatctattcaaagattattaagaagtccttatattatttttacaagaacttttaatgtcacagaaaaaaatcacttttatactaagagggaaagctggatataactttgcagatagaatttaattacaaatatggttttaaatagttgaagagatatcctggaagtactgttcttaggaacagtaagattattttctgtatctcgtaaattttctaaaatgtatatgatgtattaccttaataaagaaaattaactttatgttatttttagaataacattctggaaattttaggagtagaaattattcttttgtatattactaacaaatagaattatacagttatttgtgcttataatggtagcacagttattcaaaaaaaaaaaaaaaaaaagaaaacatcaaatagagccacaggctttattgcagaagacctgggaaagttatctgttgttgaagatttttatccaaagtaaaaataaatgtacagtctatgtaacatgtaaaggtaaacaacagaaattcaaaactcatagttaggggtgattttaaaaatcattatttaggcattggtcttttgaggatgtctcttgagtaatatttaaattatttgttttataaaataatgatcatagtgactatgatggcattagaaagaaaattctcaaattcagtaagtcaaacatcatcacatatttagtgtgctcatgctgtgtaaatactgaaaacactatagaaagtaaaattacatttcaagctggtagaatcccaacaattttaatcaaaatatttttaaattttatatacactcatcttgcatatgagagtggcatgtttatgtaaattgtttttgtagtatctcttaattcgaacttttttgtttctattttgtaggagtaactttcaactacctttacttcgaagaatttatagtattttccagaaaattattaaatgtatgagctttaataatagtcatcggcagactttctaaactaacatgaacaattaaactacagtatttgctccatgaaattataaattacaatggatatatatgtcagtttttacattattgtctcacagacccaaagctatccgttttttttgttttgttttgttttttgttttttttttgagatggagtctctgtctgtcgcccagactggaatgcagtggtgcaatcttggttcactgcaacctccacctcccaggttcaagtgattctcctgcctcagcctcccgagtagctgggattacaggcgcccgccactatgcccagctaacttttttttttttttttttttttttttttgagacagagtctctcttctgtcagccaggctggagtgcagtggcatcatctcggctcactgcaaactccgcctcccgggttcacaccattctcctgcctcaacctcccgagtagctgggactacaggtgcccgccaccacgcccggctaattttttgtatttttagtagagacaaggtttaccaggtcggccaggctggtctcgaactcctgacctgaggtgatccaccttcctcggcttcccaaagtgctgggatttcaggcgtgagctactgcgcccggccaaagctacccttttctgttcagcctcaggatgctggggctgagttcctgcaacccaagtttctgctttgccagcagccacctgctaggccctgccagtagggggctccagaaggaagctgcaaggccggaactgggaggaggaattcacttcaggtacgcttgtagttcctgtatctcctctccagctacccttccttgctgtggcaacaagggttcattccagcagcaactactgaattcagtttgcagtttttctaacatttgcagaaccagctccattgtaccctgctcttcagagacgccagcattagttggccggtgcccctttgtagaaatctgggttgtggcttcacagggctaggggtgtcacatttaacataaaattatgggaaacccaatttcaatctcaggtaaacaatgaataaacatttagtataagtatgtttcccgatattgcatatttaactgtgcttactgtattttatcagcagccatgtgcagggttccttctctaagcttctgtattttaataattccaactatttccctttgctgcctagcccctgagtcagtagctgttttctgctattgctttctttgtgataacttagtgtcatcaacttgatacctccattattctttatattctgtcctgtctcctgactacattgattgatacagtagagttttttaaagcagatactgggatttgacaagataattttcctaccagttaatattcctgtgtataagttaacagggatactcatatggtaactccgatagaagctatccaaactttaacttgcgagtaaatgagttcatatacataatatttgtagttctatgtggttcagagacataagtcatagtaaattcttgtgcatagcatatctcctttatcaacattttaaggaattaaggacttactatgtatactgtgtgtgtcattgtaaaattgtgacaggaggacaagaagaaaaacaatttacagatttaatgtggttgtaaaatacaattattaatttgtaaaatagattaatttctagtccacttgcatctgagttctagactctgggcactaaattcattacttggcaaaatagtcagcacacctggttatatattcatcagctcagtggtatttacatggtgtttgcattgctcttatcaagtttatccaggcttcccatttactctttaccctattcccaccctgttcccagcctgttccaaccactgctatagtggcatctttgactttagtgaccacctaggtaacctcactttttctttctttttttttttttttgcctagtatgaaaatatacccaataccaccttctttattgctgactgggaatgtcctctcaaagctcctaaaattcttgactgtctccttttttgcctttctctagctggactattttgattatacccttctgaactgactctgggtttctggcttgccttgggccacatttctggcttacagtttgggtttcattgtaattccctatttatggctgtagttggttgtacagtgttcacttcaaacccgtcacttcctgcctgaaatcctgtaattgctagtgtttgacattcgaaactcctgatccctgatttgcctcaaacttctggctctcctgtgtgtcctttcatcttacctgaggccctggattagctctggccttgctgctttccaggcctgctgaaataaatgagcaagctatttctagctaaataaaatgagctagaaagaataggctgaactgagagaattaggtgactttatgcatgtctgattatctacgagagtgcagggaaggatgttgcaaagccttgggactgagcttgctggctctggagcacttccttgcctcatctcatgcactgctcatgagaaccccatagggtaggcatcaccctttcaccatccagacttaagaaagaaagattaaagcttagaaaggttacataacttgtccaaaagcacatagtagctaaggaggggagccaggaattaaattcaagctgtttctggtcccactttttttttttaatcactatgctatatatgcttgatttcatataattgagccctcacaatctgtctagttcttcaattcagtgagttttggggtagtaatgattggtttcaagtccaaaaagtttcactggtctcatggcagcagagcaaatgcttttatcatcctaggctcacagcagaagcatgtgcattctgattgaccacacacttcccgccagctgcataaaatcactattcatgatttagattggaaagcatactgatggccagcattttcttcctgtgtatgattgactggcagctgtgactctaaatgcacagaactataggcatgagaataatttcaacaagtatcctttaaagcattatgtcttttttaaaccatcttagccatctttaagtgtatggttcagtagtgtgaagaatattcacataatagtaaaagccatctccagaactgttttggttttgtgaatctgaaactctatacccattaaatcacaactctccttttcccctccctcaattcttttgtttctatgaatttgaccactttctatacctaagaaaagtagaatcttacatagttatcttcttgtgactagcttatttcactttgcctaatatcctcaaggttcatccatgttgtagtacatgacagggttttctttctatgactgaataatatttcattgtacatatataccacatttgtatatctattcattcattggtggacaagtagtttgatgccacttcttggcaatagtgaatagtgctgctgtgaacataaatatgcagatatcttatagaaaccttgctttcaattgtttggaattcataccaagaactgagattatcggatcctatggtatttatttatttttttaattttttgaggaaactccatactgtttcctattgtggtagcattattttacatcctaccaatagtacatggcagttccaatttctccacattctcaccaacacttgctattgtctgtaaaacattatatctttttctttttttaatgatgcaatataatttttatttcaagaaatatgtgacttaagctaatattttgtgagcaaaaatgcagggccaatatatttaaatattatccagcctttcaagtgtgttcactttcagaagctaaatattttcctgaacattccttaagtaaatgaatgacttgctcttttgaacctaaaacacatgcttgtttcctcattcttgtggctaccactgtcttacccagcactaaaagcttcttaaaattagtcagaggaagacaagtgggaaggtgtagacttctcacttcaatagtctgctaaagatggaggaaaaatatggtgctattcaaagacagtctagacttaaagatttagaattttggatggaaataatccggtgaaatagcaagaacatttgaaagagaacttgacaaaccactgctgcagaaagctgaattccaaggaaatatgcccaatatccatgaagctgagaagtaagtttctgaaatcatgcctttctatttttttttaatttttcatttgcctaaaaaatgtcaaccacttgttgaggcaagcggagtcttgctactggaatgtataaattaaccaaatagagtattatgcaaataatagtagattcggatatttgtttagtggcccttttatggagtattagaaattgccaacttttgactttgagaaaagaatatgtgtgttgtcagtaatattttgattctgtgttttttttttaaaaaaaaccttttaaacatttgtcttatttctattaatgtcacttgatttttctggtttccaattcctgtttcattcatagaagcttctagaagtaaatgtcttttttcattttaaacatgaacgcagatgaataaaatgaacttctaatacatttaatgtcacacttgagacaaccatattgagattcttaaaaaattgcttgtatggagaaaagaagattatcattttcagggccaggcacaatggctcacacctataatcccaactctttggaaggccaaggcagacagatcatctgaggtcaggagttcaagaccagcctgaccaacatggagaaaccctgtctctattaaaaatacaaaaattagctgagtgtggtggcaggtgcttgtaatcccagctactagggaggctgagacaggagaatcgcttgaacgtgggaggtggaggttgcagtaaactgaggtcgcaccactgcaccacagcctgggcaacagaatgagactctgtctcaaaaaaaaaaaaaaaaaaaaacctaaaaaacaacaacaacaaaaagaaaattatcattttctagccagtgactagtaaattttctaaacctatcagataatttataacaataatggatttaaaaaacaagcaagacagatttttttctattgacatatatatatatatatatatatatatgaaggaacatatatatatatatgaaggtaaatactgatcaaaattcaaaatccagggcagctcacttggagagaaataaaaataacaaagacctattaggtaaaacaagattatttggaactataggagtaagagttaagaataaactaaaaacaaagcacttgttctttgtggcagctgaaaatagcaaacctggggacaacaaggtttttcttcccatattctctatgctggttagctggcatgatgactaaaacagaattgtgcctgccattgtagagcttacaattatttcttcttggtggtagtattccacaatggagagcgttaaataaaagtaggcagtcttttacaacattttaatttagtctttgttaatgttaaagagacaaattccttattgagtttctgagcaaagcttaataataatgaagttagaggaaaaacacccaccacattttataaagtagtgaaaaaagcttattaagccacagaagtgttgtttttcctctttttagaaaataaccactaaagcttatcacttgacaagcaggcttattttacaaagaacttactaatttataaaataataagactttggagaagcatcttccttatcaattgtcttatacgtttcagggacatgatggaccaaaccaatgtcacagtctcttggcaccacttttaggatatgaatatatttggcaccctccccacagtgttcagccttggggttctcagccaaaactaaaacaaagttccatttccattgcttctctacttctatgacataatgtggttatgctattttaaacttattcctattgattaagtttttagttgttaggagggagttttttttgaaaaagactaaaattatttgtgtctaaatatataactttcataaacagagtatgaattagaaagtatagtttttccttaagctttaagggcaattcataaggctaagtatttttcatataaaatatagtcacttgattccactgactcgtgactctaatgggttaagttccccaaaatttactctcatttacaagcctattaaacttctttaaatacttcaagctaaattacaaatttatatgatttttaacaaacactttaaatgcctgataggacaaacttaaagtgtaataagccaatgcttgctaaacacttaacctctgtaaaactaataaatcaaacctataaatgtagtaaattagattctcctaagcatttcaaacatcttaaaatcaggactggaagcaagagttccagtaaaagatggcggattaaatgcaaccattaaggtctgttccatttttatcctcaactaaaatgacagtaaaaggattttctaagaagacatatgccaaaaggaccaaaaccagaagaggaggtaacagtgataaaatttcgtagtttgaaggcaatttagcagacccaagaaagctaatgctaacagtgggaataactgagaagcacccaatttacagtgtggaactcctgaaagtagttggtgatgttgagtattttaaaaagtaggagtaaagataaagctaaagtatcttttcgaaaagcagattgacctaggagagaagacttaacgttactgacattaagaattctcttaggaccagctcaatcagagcatgctacagtcaagaccacagttactgcctcacttccaatctgcttttttagtgtcttgttcttaaatgggaaatttattgaggttcaactcctaatatgagaacactgactaaaccaaggacacagaaaagaaaaattggaaggaaaagaaaatacttgggaagaaagaaaaccatctaaagagattcttagcattctcaaaaggataaaatagattgtatccaggaaaccaaaatagggtgatacaaaaagggatattcaggaaacaaatttctaggaagttaaaggtataattgcataaatgaaaaacccagtaaaagctttgaaggaaatgtttctgaaagtagaaaagagatgaaaataatagagaaaaagtagagaaacctgagggccagtcatggaactccatcatccaaacaggatctccagaaagagataccagacttaaaaaaagagaggggtgttcgggggaggggggagaaaagtcaaagaaataatgtgagaaaatttcccagaactgaaggacatgagtttccaaattgaaagggcccagtagcaagaacaatgaaaaaaaggctcacactcaggcatattatcatgaaacttcagaaaacttgtttcaaagaaaagattcttaaatcatgagggagacatattcattcaatggatcaagaatcagaatgacataggacttctctatagcaatactagaagctacgaagtaagagtatgcctttaaaatttgaatggtaaatggtaaattatttcctatcaatagttttactatcattataaatcaactatgagtagaataaagccattttcatatatgcacattttaaaaatttccctcccattacagtttctcaagtgctccagcaatatgagaaagaaaaaaaatggaatccaagaaataggagatatccataaggaagaagtgaagggaatcctgcacagggtgattctaagacagctataccacataaaaacagtctaggctggtgcaggtctgagaaaataattcagagtggttggttctggagagtaggaaaaagggtgggattggggggattgctttattttacaagtcaattagaactagctatttgcttctttagtttatgtggaactttgataaaaatttaaacttataaagagacaaaacataatttaaatgccatgtcaattagaaaatccactgttcctctataaactcaacttgaataatggttattccttcatcatctctgcacttttatggtatactttcctggggtgaaaagttgcttatttgactaaggagaattttatcatcatctccagtctacaacagcaactatgaccataggtttgtgttgtggatggcaattctagaatagggcttctcagagatatttctaggaaaattctatctaaaaacaagatagcaatccaagtcccttctttcagtgggacttctaaagcccactccttttcttacaccctagtgcatcccaggttattttattcactattttcctgttatctcaggcaactttagtctaaaccaacttgctaggttgtatatccattacccagattagaatttctcttttctacctgattgaattcagtactcttttaaaattttacattatttcattatccaccattctacatgctatagtaatttaattcagttcctcatggaacttatgttacatatcagcagaaggcaaaaactatataaatgaacatgaatgtagggcatgagtaaattgtagagtaagttaggtaacagatgctatggagtaaagaaaatgccaagccaggtaaaggaagtcagaagtgccaaagaggggatgtgtcacaatctttaatggtagtaagagtaagcctcattgagaagatgacttaagtaagtaaaaaattgaaggaggtaagggagttagtaatgtagatacattgggaaatggcattccaagaagcaggaaagtaaggccttgagatgggagcttgctttgcatatttcagaaatatccaggtacatgttactagagtgaacaacaggagaatatatgggagatgcctttggagagataatgggggctaaattatatgacatcttagaagcttttactcccaattagactttttactctaattctgggctagagtttttactcccagtgaaatgataagtgattagtgattttgagcaatgatttggcaaatctgacttacattttgagagacttgttctaactagaacgtggaaaacaaattgttggaacatcaagattggaagcagaccagttaggaagttatagccatgattcaggtgagaaacatggtagttgagaccaagatggtagtgctagaggtggtgagaagtggtcacattctgtatatactttaaagatagagcggacacattttcctggtgaatacgatggggtgagtgtgaaggagtagaaagaaagaaaaaaaaagagagaagaaaaacaaacaaagcagtcatgtattcctcccccaagttttgacctgagaatataatggatttgacctcacatacagtgggaacagtgaaggtggcacaggtttgcagagaattcaggagtttacttctgagcatagtcaagtttcaggtgttagctaaatctctaaattgagaaatggaataaactagctggctatttgaatgtggagtttgggggagaaactgtactagaaatattgatttaggagtcttcaatacatgggtgatagcaaaaaccatggaagagctcagcaaaggagaaagcatagatagatgatctgtgctaaggcctagtatttccagtgttgggtaggaagaagtagacctggaaaagagactgagaaggagcagcagtggaggaggaaaatcaggagattgtgatgtcctgggggcgagtgaggaaagcaggtgggaagaagatagagataaatgtgttgaatgagaactgagatgactgtttatcaaggaggaggtcattggtgacttcagcaagagcagttcagtgcagtggtgggtctctaggcccacttagaatggattttaaaaagagcatggaaagagacgatttagaaatggtaattagggaaaatttctaggatttttgctgtaaagagaagcagtagaaaggagtgttcatccatagtgtaaattgggtcaggagagggttttattaagatgagaaagtaacagagtatttttatgtggattaatccagtagaggtggaaaatttgatgatatagaggagagtaaagagtttcaagattgtctctgaataggtgagagaggatggggatacattagcttaaagtagaagcatctgagaaggttgagtcggtgggcacagatactggtaggtgggtcgatgtggtattgagtctgtggaagttctctaatttttttttttcagtaaagtagggaccaagattatcagtggagattaaggatgttggaagagtttcttgggtttgcagggaaagaacaaatggcgtgaaattatcctctaggagagtaggagagtgaatgaactatgaaaatatactacaaagatcaggcagcactaaagtttcacttgaagctcacactcataaatatcttagcaaagcttgcttatcattatgacagagttatatttgaaaatacaaagacatcttagttatggttgttattttaaggtggactttaaataaagaatgttctcaaatgatgggctgcagcacttctcagagaagtcccagtagataggtttgtaatcatcattggggttctggttgaggcgtgctcacacctgtggccattgctgtgcctgaataaactatgtagcatggtttttccttccctcctcttcatgaaacctccctctcttcttgcatgttttctttttcttaagggtatagactggaacattaatatttgaatcactgagtataatcattatttgagctgtggaagaggaaaagaaaatggtactaggatgcctagtacagagaaggaaaagatagatatttaggtaaagaattacttagaataatagatccgtgaaggtaagaccagttgaaccatcttctaaatataaacaattttttttttttttgagacagagtctcgctctgtcacccaggctggagtgcagtggcacaatctcggctcactgcaagctccgcctgtggggttcacgccattctcctgcctcagcctcccaagtagctgggactacaggcacccgccaccacgcccggctaattatttttgtttttgtatttttaatagagatggggtttcaccatgttagccaggatggtctcgatctcctgacctcgtgatccgcccacctcggcctcccaaagtgctggaattacaggcatgagccaccgcatccggccaacaatttttttttttttaaatagaagaagaaactgcagtgatgggttggaaattcaatatatctcaaaggactcctaacctattttgagttatctttgataggactgccagatattgggttaactgagcactgaagctcttctttaatgatctaatgtgccaagcaaggaggaaaatgttcattggttcttggtcttcatttatgtgcaagaaattcatataatttctcatttactttttttttttttgagacagtcttgctctgtcacccaggctagagtgcagtggcgcgatcttggctcactgcaacctctgcctcccgggttcaagcaattctcctgcctcagcctcccgagtagctgggaacaggcatccactgtgcctggctaatttttgtatttgtagtagacagggtttcaccatcttggccaggctggtctcaaactcctgacttcatgatccgccctcctcggcctcccaaagtgctgggattacaggtatgagccaccgcgcccagcctctcatttaattttaaaccaagcaatttcttttaatatggtataatagttaaaagcttcctatcagggcttgtatatctcagctgcacaatactaggcagattacttaatctttcactgtctgatgttttaatatctaactcataactttgtaaccaaaatgcagattccatcacacactgtgtgcaaagtccaactaacaagagcgatgtctggtataaagaaagtggctttattccaaagcttagcttagggaaagaggtgcaggctccttcctgcctttagtggactgcttcacttttggggcagaaagccgaagctttaaagggggacttggtgtgaacagcatgcaggggagagagcgagcaggtgctgatcattttggtgccttatctactgggtggtgagctggcaccatcacaggcagatgtgggttgtaaaatggccattgtctcaagacaccctccaggtgggagagagttccatcgcagggcacaccttaggttgtaaattggctgttgtctctaggcagcttggtgagacagagttctggccctggagccttttttttttttttttccacagcagagacaagtgaacatttatttttatgcctttcttcctatgtgtatttcaagtctttttcaaaacaaggccccaggactctccagattcaattatgtccttgggcttggttgactgctgcaggagtcttagggagccttgtacaaatgctagagtgactcatttaccaacagtaaaccctaggatagatccaacaaagcaggaatgtgccgatttcagacgacgcagcacccaatgtagaaaacgctggaatttttccttggaactagactgtgatgagaggtgcttgacatgaacataagctactgtcttttctgctttttgagatggagtttcgcttgttgcccaggctggagtgcaatggcatgaactcggctcactgcaactcccgcctcccaggttcaaacgattctcctgcctcagcctcctgagtagctgggattacagacatatgccaccatgcccgactaatttttctatttttagtagagtcggcatttctccatgttggtcaggctggtcttaaactcccaacctcaggtgacccgcccacctcagcctcccaaagtgttgggattacaggtatgaaccaccatgcccggccagctactgtcttttctttgacccttcctttccagtttttgaagataaagcaggaaataatcttctctgaagatacttgataaaaattcccaaaacgacaaaacacatgcttccacttcattgataaaaaatttaatgcagtttggcacctaagagtatgacaacagcaatagaaagtaatttcaaagagttacgatttcttcagcaaaatagatgattcatatcttcaagtcctttttgaaatcagttattaatattattctttccccatttccatctaaatgactgcggcaatacaggtttttggtttttgttgttgttgttgttgttgttgttgtttgagacggagtctcgctctgtcgcccaggctggaatgcactggcacgatcttggctcactgcaatctctgcctcctgggttcaagcgattttcctgccttagcctctcaagtacctgggactacaggcatgcgccaccacacccagctcatttttgtatttttagtagagacagggtttcaccatgttggccaggatggtctcaatctcctgacctcatggtctgcccgccttggcttcccaaagtgctgggattacaggcatgagccaccgtgcccggccagcaatacggtttttagttactcgacatctttaagcctataactcttaggctatgcatagccccatgtcctaatcaggcattcactgatcccagcaggtctccatctatttgtaccagcctcttctttcctcccaatctcaaggttactcttaaatactagtaaatgcaaaaagaacttgtaaagtggcaaggcatggcctatcaaaagtcagcccaagggcagttttcagccctgcctcacctgggtctagctcagctggcgggtgagctgattgatgtgttcaccccgatagccaggtgtgcccatctccttgaggaagcccactctatttttggtagcatgagtggacctggagcttttgagataagtacacattttgagataagtacatagttagataagcttgccctgtggggagcatctggtgaagggaaggtaaagggtatcattgcgtttctaaagaactaagtctggattaagaaaatgtggcacatttacaccacggaatactatgcagccataaaaaaggatgagttcttgtcctttgtagggacatggataaaactggaaaccatcattctcagcaaactatcgcaaggacaaaaaaccaaacaccacatgttctcactcataggtgggaattgaacaatgagaacacatggacacaggaaggggaacatcacacactggggactgttgtggggtggggggaggggggaggggggagggatagcattaggaggtatacctaatgctaaatgacgagttaatgggtgcagcacaccaacatggcacatgtatacatatgtaacaaacgtgcacgttgtgcacatgtaccctaaaacttaaagtataattaaaaaaaaaaagaactaagtaggaggtaggaaacaaggggaaaggaggaaagaaaaattattaaaaaataactcttactcttagaaaaatgggagtacttggttacaagtctagtccataaattaaatgtataattatagataagttaccttttaccacttatttccaacattccaaaggtcacacagctggtaaacataacacagctgggaatcataaatattgctaccaccaccactacccacccaattattgggggagtggggagggtcccatgactgtttcccagttggatgaaataagaaaccaaaaatgagtttttcttgatccttgaattgaaaactccatttttacagaaagaaaagacattttacaatccatttctctgaaaacatccgttctttatctcacaggatgtaataacttgatgggaaatttaaacgcaaggttattcataaaatggtaaatgaggggacacctggcgtgagagctgcagcggcatttccgacacactgctgccccctgctgcctgatacatcgttttccttcttcacgtgtactcaaaattaacactgtctgtcacccagattataaaatcatactgaggagaaaactgaggccctgaaagtgatctggatgacatggatagtagaagatttagattatggaaaagtcacttcttcctgctttaccatattgccttttccctattaaattaaaagtcaacaaactactgtgtgcctacgtagaagtactcaaaatggagaagtgaaaatcaagatctttgcacttacataactcatattcttgtgtgagtaaacagccaataaataagaaaaaatcaataaataatttaagagaataatagatgtattaaatagtaacaatgataaagatttctggagtactaggagaacatggaattcaaggcactgttcccagtgctttccatgatttctttcatttgattctcactgcaacctgcaaatagctacttcactttacagatgaagatattgaggcagggctagaatgatcctaagtgatggaaccaagattcgaaaccaagccacttctgactccagaagtgtctagggtagtctgctctgagaaggcaacagtgaaatgaagagaagaagccaggcttttgaagatctaagggaagagcaagcacaaaggcctggaagtggaagtgagtttggtatagcaaggtatagggaaaaacaaacaagcaaacaaaaaccatcccatatgattgtactaaaggagcatgcagaagactagcagaggccaggtcatggtagggagcttggattttattctaaattgcaagaggaagccattgaaggatttcaatcagagcaccaacctgatttatggtataaggagctcactctggatgttgaaaggaaaacagatggtaggataagagtttcctgtttctaccatttatatagacattgcataaacgctagcaatactgaactccatgttttctaaatgtgacccctacagtctcctgttcctttttcaggtgttttcctctgtttagaatcccttccttgagtcctctcctttccattgcagcctgccttttaagatttcttttgtgaagctttcccggattcttcaattatataatttccatcctttgaactctgtatatttcaagtatagcttttctgtgttaacctctgtcctaggatatctgttatttgactgcctacctcacggactgttagatcccaatcttgagatcaagggctaggactttcaggccatcctgtataagtatgcacgttgactccttcacaagggcacccgacccgccggaactctgctaaccaaactgagctccctgacacaggctgcacccatgaaggggagagtccttttttgtctaatttgtatagagatatcatataaaatagtggatccagaattgatttctttcatctttgcatccgaaacagcacatcacatctagcaatagaagtatacacatagtagatattttatcaaacctttttattaataattgattctgatttggccaggcacgatggctcatgcctgtaatcccagcactttgggaggccaaggcgggcggatcatgaggtcaggagatcgagaccatcctggctaacacggtgaaaccccgtctctgctaaaatacaaaaaattagccgggtgtggtggcaggcgcctgtggtcccagctactcgggaggctgaggcaggagaatggcgtgaaccaggaggcagatcttgcagtgtgcagaaatcgcgccacggcactccagcctgggcgacagagcgagactccatctctaataataataataatagattctgatttaactaagtccagttgtggaaagtaagatgaaaaactcaaggtttatggtatgctttactcatttaccaaggctatatgcagaaaggaatgggattggacatcctgccaagcccccctgcacagccaccatatctcaattgcttgataggctgtggtttgtgtaaaaagagggaaacaaagcgtagatgacagatttaaggtacgtcaaactggaacaggccgttatgttgaagtgttaggacactgcagtgcaccacagtctatgataccatggtttagaaaccttgaggacttttgttaagattgctgatgacatattttcagcaaaggtcacaatatccaggggaagtaaaatataagggtgtattcaattgctgaggctttattttttttttctccagctagcagtgtaaaggacatgtgtctctattttgggagctgatttcttcttagtccccattaaagtgaaactctaataagggtatgtcagcaccaatgtttctatgtaagaggacctccttgtcatctttgaaattaatttgaaattaaatgattaattcatcgtctgtttccactggaagtttgtataagtggtcctaaaaccagcaaagctggggatagtcctctttgttacatgcaagactggaagaatcatgtcagacccccacggaagccttgggaacccacccttaactgctgcttttgttttcagaaccttattagttgagagttgtacctcctgttttcagacctcctagtgttctcatctgcctttctgccttcagtgtgagtacataatctcttctcagagcaagtttagttgaaaataaagttttggcacctaaaaaaataagaggaggcgaccagcaagactgtgaggcatggaatctggagcacagggatactgataagaatgaactgattcatattgctgctaagactcagaactgacctatgaaacatagcagagtgggcacaaatgaaccagagccgggctctcctcccttggaaggtgctcagtatttacacaatgccccttgtctgtaagggcaagtactacatcagagggaaattggcaggggaattgttggaactggaaagtatcagagtgatgaaagaggcagctcttgtttagctctgttaagctgttgctctgcagatgcctgcccattgctgctagatttttcagtggaagttgatgttctgcatttttatgaaacactttctattctttaaatgttgtcaatcaattcaaaaaagcttttgaaacatataggcaaaaccacagtcttctttgtgtggacgaccagtttgcaacccttgccttaaaattataaccaacttctgttctctagactctgagaaagaagcatgcacagaactatcattttgctttgttaaaaagcagtctgatcattaccttctctgtttaaagaagtatcatttctccttaagagtgtagaactggccgggtgcgctggctcacgcctgtaatcccagcattttgggaggccaaggagggaggatcacgaggtcaggagttcgagacaagcctggccaacatagcgaaaccccgtctctactaaaaatacaaaaattagccaggcatggtcgtgggcgcttgtaatcccagctacccatgaggctgaggcaggagaatcactcgaacccgagaggcagaggttgcagtgagctgagactgcaccactgcactccagcctgggcgacaagagtgaaactccgtctcaaaaaaaaaaaaaaaaaaaagaaaagaaaaagaaaacgaaagagtgctagaactgtaactcatggggggaaaataggaagaaaggcagcatttatcttgtttgtttgttttctggtcacttttaccagcatggaataatgctggaaatagcctttcttccttgcttgtaaataatcccacatgcctcatagagatgcagcatatcccataaacatttgtgccaggtaaaactcctagagcagtattcaaattctcaaaacttgctgaaattagaattcagtacacatttgagtatttttggaaatggaatctgtagcatgtctagctacaggtgcaggtcaggggagactggtgaatatgaacccttgaaaaagaaagtgttgaataaggatttagatttttgaaaaatgaattctaaatatttcttccttctcctaattttgtaatttcaagttatcatttatttttaaatataaattttagcaaaactttctactgacgcttcttttcttttattcattccgtttgttcaataaatatttattgagcacctactaataccaaagatcagtctaggcacacaagatcaacaggttatcaaaacagatgaaagggctggatgcagtggctcacatctacaatccccacactttgggaggccaaggtgggcagatcacttgagatcaggagtttgggaccagcctggccaacatggggaaactctgtctctactaaaaaatacaaaattaactgggcatggtggtgtgtgtctgtaatccctgctacttgggaggctgaggcatgagaatcacttgaacccaggaggcatagtttgcagtgagttgagatcacaccactgcactccagcctggggacacagagtctcactctgtctcaaaaaaacaaacaaacttatgaagagccctgccatcaaggagcttacaatccagtactaataaataataaatttatcagcaaattagaagcaaatgagtgcaatggaagaagtaaaattgaagcaggttaagagggatcaaaaatagagggtgtacacattgtatttttagagaggtcagagtgggccttggtgacttttcagcaatgactcatagagaggaggttggtgtttttttaattgactttcccactccatagagtcaatggttctctccatttatccaagtagtatacgttaaatggtaaagaactagtacgtggatggggccgggtgcggtggctcacgcctgtaatcccagcactttgggaggctgagacgggtggatcatgaggtcaggaaatcaagaccattgtggccagcatggtgaaaccccgtctctactaacaatacaaaaattatctgggcatggtggtgtgcacctgtagtcctagatactcaggaggctgaggcaggagtatggcttgaacctgggaggcggaggctgcagtgagctgagatcgcaccactgcactccagcctggggacagagcgagactgcacctcaaaaacaaacaaacaaaaaaaagaactagtacgtggtatgtacacctcatagaacacatctttaaaacaaagagggaaagtgctatggtctgaatgtttatgtctccccaaaattcatatgctgaaaccctaaaccccaagacgatgctgttcaaaggtgagcctttgggggggtgattaagtcatgggggcagaggcctcataaatgggattagtgtctttacaaaataggctcaggagagaccccgtcactcctgtgaagttagagtgagatgatgtctgcctgtgagaaagcaggctccttccagaacctgcaggcaccttgatcttggaattctcagcctccagaatcatgagaaatagatttctgttctttgtaagccacaatcattttatgatatttttgttatagcaggctgaatggactaagaaaggaagacaaatttaacacaaacagttctacaaaataaactgcttaaagaatatctgttttgggtattttatatttgtacaataagggaaaggactatttaaaaaatagttttctctcaagcttttagcttgcaaagttcttctcacacatttttatttgatgttcgttataactcattgagacaggtggaattatttccatattctaggtgaaaagatgaagcttacaggtttgcttaagtcactcccccttaagcgatcccacattgcccctcggattccccattccccagatctctgatcactattcacaaggcccttcacgatctggcttctgcttcatttccacagcatctcttgctaatttcctctttactgcccacactgccccaatatctagctacttcctttcactatttgctaagctctccctttcttgcctttggacttttgcacatactattttttgtcacctcctctggccaccctctaaagattatcccagtctccacttgggcatcatttatttcccagtgctagaacctctcatacaaaatcatctgagtccagggccttccccctgttccacaggcacctcctggccactatagtttctcttaatatttctcctttagagtcctacatgatggtccccacccctcatccaaaccttttaaacttgtggaggagcttgaagcttagatagggtgaaatccgtaatctaggtcagccttttctcccctttttgaatttttttcttgacctttcaagatgagagattagtggcttaacacatggcttctctgaaagtttaatgtcttataaggtatctccttcagactcacttctgctaacttcagtttttcctgccaggtgcttcctgtccttatcacagctctatcactacaggaggaaaggtaactcctgcctctctttctgtgggcctctctaaaactcctccagttttgataataacttaccaatcaatgtctggcaatttcacagttctgcgattgtcctccctgcttcctctgtggaagcaagcccagtgtgctcactgtggtttgattcctgctttcaggaaccgacatgtccaaaattcaaaagacaactgtttttaagctacatattatataagctgtatagtaattctaactaatgccttttaatatttttggaaagtttacaaatatccatagaaaacagaagtcatgagctgaacaattgctaattttgaagtgattaatattcatatttacatagtccagttggaatacattcaggatgaaattttagtgtaaacttcaccattgaacaatatcttcaaaaacttaatctcacaagtgagggatattttgcctcagaaaaaaaataaaataaaacaagaggaggcccctgatattttaagcaaatataattacctgaaatagaagctgaatttgtaaagaattatttctcgtgtccttaattttaaaaagtattaccttcaggtttcatttgataaaacttgggaaattattttaaaaattagcttttattttggagaaaattataaacacatgagaaagaggggacattgtagacaagttcagtggcttcatttagtaggcctcatttcatttaaggagcctagctgaaaggcaaatgtgaggatgacattgcctccttctcatgcacaatgagtagttttctttctccccagttgctatttattactgaaagatgaaaatgtcagtatttcttttaacagaagctaatgcagcacctcagatggtgaaaactggtggcaggacacaaagttactcaaccagagtagtttaaaagtgtgcacttttaaaatcaaatgtaattgtaactcagtggtcaaaaatgaaaaaggatgctgagcctgaattcaatatttcatgattagagagacttcttactatatatattttttccttctaatgtctgacctggatcatatttattcctcaaccaggaacaaaaggagattctttaattttcttttgatccacatgtgtattggattgttgtcaaatttcttactggaaaaggttaggttaatattttgataacagataaaatcttcaaagtaagccagaagcttaagtaatgcaagttagatttcatgtgctagaatgtcaaggataaagcgtagaggaaggatttgcaagtcatccataaaatgattatccttagtgtaaagtttatattcctccatgccaacaactcttttaacgtattaccttgtcctttatattcaggtgccagaagaaaccttagagcagcagtccccaaccttttcggtatcagggaccagagagacaatttttccagggacctggggtaggggtgttgggggttggggagatggtttctggatgaaactgttccaccacagatgatcaggcattagattcttataagaagtgtgcaacctggatccctcacatgtgcagtttatatagggttgatgcttctatgaagatctaatgctgccggtgatctgacaggaggcagagatcaggcagtaatgctcacttgcccactgctcatcttctgctttgcagactggttcctaacaggccaagggccagtaccagtctgtggccctagggttgaggactcctgccttagagagtccaagagtagcaaacccatatacttatttggggccaagcagttacaatggatgagcatatctgtcacttgtaagtaataggagtaatggaaaccatgggaatttgagagcatatgtcctatttaaagatattcaaatcaacttaaaaataaatgttgtgccttccatacaaagtccatccacaaacccaatgtggcctgtggctctccagttttctccccttacagtttagcccggcctagactacagtttcttccaacctctcatccaaggcctaggttctttcttgagcactcctaccagtggccattcagcttctgtttgagcaattccagttgcaagaattttgggggactgtcaagtcctttgccaatcatattagtggtggtagtgatggtagtatcttttgtgctttaggataaaatcagaacagattagtgagttttaacagtagattgctctgaccaacaaggatccaatggacctctttttgttttgtgattgttccttgagactctgtccctgttgaggattataatgctttgtttcatggaagatatagtcagtttcagaactgtacaatgtgatcttactttttcttatattattccaggtttacttctatggctcatgtcatataggctgatctcagaagggcctgcttgccattagcattggttcaccccatcacatgcttactgactgatttcttcatgctaggcactgtctaattactgggatacaggagacaaaaggtcataaagagctatcctttcctggggcttacattttagttagggaaataaatacaatcaagaaaacaaaaacatggtaattaaatgttctaataaattctctgaaggaaatagaggctggaggagggaggcaggaggtagccagatcatgcagcctagtagacttccaggctattaggagtttggagtattgtaagaaaatagtgagaagccactgaaggattttaagcagaataactgatcttagggcactgtttgcaaagtgagaacactaacatatattcagtgtagaaatttgagaaaatacccaaaaaagttaaaaagaatatccattatgcaagagaccattacccagagacaagtctggtgtaggatgggaggtatggtagccagaattctaaaatggctcctgtctttatctgttccggctgctaaaacagaataccacagactgagtagcttaaacaacaaacatttatttctcacagtttggaagctggaaagcccaagactgaggcgcaagcagatctgggtctggtgaagcactccagctggcttgtagaagccatcttttccttgtatcctcacatggagagagcccgggcccttccatctaatatactagaaggacactaattccctcatgggttccacccccatttcctaatataaccatgattttaccttctaaaggctccgtctcctaatattatcctattggatttgggtttgggtttccatatatgaattctggggagtcacaaacaggcagttcatcacagttcccaagattcccatcctctggtgtgcattccctgggtactcttttcctcctgcctatgggaatgtgaacatgaataagatttatcattattttgattaggttacattatgtagcaaaggtgaaaggattttttagaaatgtaattaaagtgtttgatcagttatattaagttttttaaggagattatcctgtgtgggcctgacctagtcaagggagccctttaaaagaggctctagaggtcagagacagaagtcagagagattcagagcagtagatgcgctttactgttggcttaaagaaaattgctgtgtagagaaacccaagtggcaagaagtgatgggtgacccttcattgctgagggcctcactcctacaaccgaaaggaaatgtgttatgacgcccagtgatcttgaagaggctcagatctgagattgcaacccaagccaacacctggatttcagcctagagagaacccaggaaagccatgccaggattcctagcccacaaaaccgtgggtagtaaattgtgagagaataaataattgttttttctaagccactagatttatagtaattgttgcacagcaatagcaaactcatacaaagggaatgacatgattttctctgtaaccaaactgactggagagggacaagagtagaggccattgagaaagtcaccgtcgtggtctaggcaaaagataagcatggcctggagtggcttggaaagaagtagacagactttgaattatgttttggaagtgaaacagggctagctagctgataaatacagtttggagggtgaaagaaatgaaatcgtcaagaatgattcttacaactttggtataagcaaatgagtggatggtggtgctgtctagtaaatattgaaagaatagggaaggaatattttgttctgtggagttaacaagagtggtggaagatggtgttcagttttattaatattctattttaccaaattagaagttaggtgaacttcatatacatatgtatgtgtatatatacatgtatatatgtatgcatgttgtattacatatgattatgtgtttattttataaaaattatgatagtacatttcttcatgttactttttctccacttaacagtaaaaacataaatattaataattataaaatattctaccctgtgcagtcccttattcctctattgtttgttttttgttttattttgttttgtttgttttttgcttttatgttgtcctagtgaatattcttatcctttcaggtttattcaaatgtattagattacccttcagaaagatgatttatatttacattcctcataatggtatataagaaagctagttgaccccattttcaccactgggtattattattttaaaagcatctttgccattttaaaggtaaaaaaactcacttctctattaatgtttcatagcctgtatatcttgaaggtatgcttcagtgttttgtactatttcttcttgcctggcctaacatctctcactgtatttgacatgcgtatgactggagtcaggtcctgttgttagtaagaatgatgccattaagtcacacatcctctgtgataacatgggtattacctctgacatttcttgagattgtatctagaatcagaaagccttgatgctgtccttatatacaaatcagcttttttctaaaaacatacagtgtatagttatttttacaccttgcctatataaaataaaaagcaaaaaaaaagtcagtaacatttttcatctggcttttctgtattttttaaatggtatatggtagataatactaccatctttttcagctaaaactgtcaagtaaaacctccacaacgtatttcaagaatcagttatgagaggtgtattaagtgaatgagagtgtgtattatttaataatagctccctttgggtgatgggtttatgatgggtgattgttattttgtttttgttgcttttctatattgccaaaacttttaatatggaacgtgtaattctcccttaaaaagaaaggtttgaatagagctttaaattttaataaagagtactttaagatgtcttagaaagcaagtctgtaaaattgctttaaaaatcaagaacagggccgggcacagtggctcacacctataatcccagtaatttgggaggctgaggcgggtggatcacttgaggtcagcagttcaagaccagcctagccaacatggtgaaaccccctctctactaaaaatataaaaattagctgggcgtggtggtgcatgcctgtagtcccagctactcgggaggctgaggcaggagactcgcttaaacccaggaggcggttgttgcagtgagccgagatagtgccactgcactccagcctgggcaacagagtgagactccatctcaaaaaacaaacaaacaaacaaacaaaaaacagaagaaacctgaacacttgcagggattaaatgggaaaactttttaaaaagcaggtgtataccgtctattaactgtgtgccatagcacttggccacaaaccaagtatacttttgaaacccctaactaatctttaaatatattttcaaacaccttttaaaaatgtgtcaggggcaaaaatgtcaaaagcattatgactcctatgggtgaagggataagccacgatgcttgaagtcaggggtcttggctttcacagggaaagacaggatttcaccatgttgtccaagctggtctcaaactcctgacctcaagtaatccacccgcctcggcctcccaaagtgctgggattacaagtgtgagccacccgtatacagtattattgatatcctccaaaccagataggatatttagctttttgtaaaattctataggtattaaagcttgcagcattaaaaagcactgcttttgaactctgacagatgcagacaatatatccagtaacaaaactgagtttctttactaacatattttgatagcgtgaccttaaacttgagacaaaaaggagagaggaagagttttattgaataaacgtttctaggaaacagatgcttaacaaatggttgtacagctgtttgcaataacatggaagaagcctatctttcgataattgtgacataagtttttcttgtttgttctcctagagttgtctgcaaaaagtttatgtaatatgcctgaaggttatactaagaaggaagcatttcagaaatgattgaagctgtttatctgtgtgcaaaagcctgtaagtgtgtttgtgtgggcctgggcacgtgtatatgcctgtgattcacacatttcttttcacaaaagatttgaggtcactcaggatgtcattcatcctgggtaaaagccacctcagattacaagcagttaataggtcagatgctacataatgctctcttcaacttagatttcttaaaatcttacaagttgaaggaggtgagagcctgggacttttaatttgcactggggcaaaatcgttcctttgtgctgaaaacatgtggctgacaagatgccactgggaaagccaagcttttttagaagagtttgctgtataattcataaagataaaatctgtaatattttatacttgaaagctaaaattttttaaaaagacattatccaaatcaaaactctagcaattaaaacacacagatagggtatggttgactttctgcaatgctaatctggtttctgtcttaggtctatttgtacaggacagatattctactttattctccaacaagactcagcctggagttgcctggtgacctgctttaattgagccaaccacattctgtaggggaaaagccagaccagaaatagctaggatttaatggtgagaacaaaggcattcctaaaatcctcaaatctgggcctagcatggtggctcacacctgtaattccagcacttttggaggctgaggcaggtggatcacctgaggtcgggagttccagactagcttgaccaatatggtgaaaccccgtctctactaaaaaaaaaaaaaaaaaaaattaggcgggcatggtgggcgcctgtaatcccagctactcaggaggctgaggtgggagaatcacatgaacccgggaggtggaggttgcagtgagccgagatggtgccactgcacttcagcctgggtgacagagggagaccctgtctccaaaaaaagaaaaagaaaaaataaaataaaggaaacacaaaaaacacctcaaatctgatatctcccacttcctacttaggttgaaacaacatatgacttctctaagtctctatttttattttcaataaaatgtggatgataataataaaatgtggatgataatcccacctcactatgggatgcaaagtgtttaccagatgtattatgtttcctattgcagttgtgacaagtcatgcaaaagttagtggcttaaaacaaatttattatattaagtcccagcattctgaagtccaaaatgcatctcactggggctaaagtcgaggtgtcagtaggtctgtgctcctttctagaggccctgtgggagaatccattttcttgccttttctagcttctagaggccccctactttccctggctcttggccacctaccatcgtcaaagccagcaatgtcccagcaagtcttccttagagcatatcactatgatactctttatttatttatttatttatttatttattgagacagagtcccactctgttgcccaggctggagtgcagtggtgtaatctcggatcactgcaaccaccacctcccaagtccaagtgattttccttcctcagcctcattagtagctgagattacaggcatgtgccatcatgcctggctaattttttttttttttttgtatttttactagaaacagggtttcaccattttggtcaggctggtaccaaactcctgatctcaaatgatccgcccgcttcagcctctcaaagtgctaggattataggcatgagccactgcacctggccactatgatactcttgatatcatatgatagctcttgcttccctcttccacttggacctttttgattacaatgggcccacctggataattcagtataatttcccatctcacagtcagctgcaaccttaattccatctgcgtccttaatttctctttgccaagtaaggtagcattcacagattccagggatcaatataagaatattttttagggggtcatcattctgcctaccttgttggagtacctgctactaaataaaaacaccaggaatggtagtttttgctgttcttaacccaaaggaagaaagagcccttctctgaatggtttttgttgtttagttaagaaaatgccaactgaccaatgtcccagaaaccaaatgggtgtagagccctagcatgcttcatttcaacacctttcacaaacagtagttttggcactttgcctaccaagctgaaaaacaaagagcagggttgttatgtctgacctaaatacacatggtctgtaactttcctcttctctctccatacctcttcccttcttgaagatattttactgctggggtatcaacttatttacatgtagctgactcctcagaagcggaacttgaatgccagccattctgtcgagcttaaagcaccacaatccagctgtgagctaggcaactttccccttatattttgtgtgcctctgaaaacatctccagaattcaaatgaccatttttgacataagttatcccttcctcccctctgattgcaagggcagcatcactctttctgccatgcataagtcaacatttggagtcaatagccctcttgtactaacactttcacagtcctctcaagtagccttcctcactgtattatccaagttcaaggattgcttacacttacctggactacaggcaaagcctcagaaccatctcctgccttccttcactgatttgtgtcatcactccctggaggtctcaggtccctccttctcatctcttcttccttaaatcgatccttctgccttaaatcagcccttctgcttagcattaaataagtctttgtcagcatgccaaagggtgcagggaactatttttaagcagccaccatatgccagacattgtgcttagacattttgcatacattatctcatttaatcccaacttaatgacctagcaggtcgatgttatttcctctttctttttctttttctttttcttttttttttttactagtgaggtaactgggacatagagaactttatgtaattcagccaaacctacacagtatgtagcaaagagttcagactcggctgtgtctttctttaaagcctctagttttaccactacattagacccgtcatttgactttattttgaaggtatctattttattagggtgggcactgggcactgtggctcattgctgtaatctcagcactttgggaggccaaggcaggagtatagcttgaggctaggaatttgaggccaacctgaccaatgcagtgagaccctcatctctaaaaaaacattattttttttaaactggtcaggcacggtggtatgtgcctgtaatcccagctattcaggaggctgatgcagaaggatcatttgagcccaggaggtcaaggctgcagtgagctatgattgcatcactagactccagcctgggttacagagcgagaccctgtcctctgtctctaaaaaagcaaaaaacaaacaaacaaaaacgatgaaaaaaaaatccattttatcaaggcttacctgtgctcatgtactttatgggcaaatctttcaatggcctaatgacaaacatattatggttgggtcatcttggtggtggtttctgtgggaggctaaagactgctatgtgtactattttttatcagagatctagtactgtcagacatctgcctttgaagtggcttgtggattaatccaggtacatttctcatattttttgaaaaggatgggttctgagggaaggaaataatttttctatatgcgagaggctttgagtcacagtaagttagagctcttgtggaggtaaataatcttgataaatctgttctttgtcattagagatcaactctcagtacccagtgacaggcccaaacatgcttttattctttgaccaaaacacccacaaaggaaacagaaaccagtttagcaactttgcaagtgggtgcagaagtattcctataaataaagctgctcattgtgcttctctggtcatgttaggtttggaatgctgatgggtttatatcgtcctactctgaattcttagtgacaacattgtgaatttagttctagctgatgcttgctacattgcattttttagtatttgaattctgctactccttaaaggtgactgaaatcataaagcccattttgtagaatgaactttgttccccacttatcactccaccatatgctttcctgattgctttctgtttttactttcttgaagagagaaaaacataacataactcaatcttagttgatcttagtaaaaggaagaatgtgtgggcagtgggacgtggtgggtcatgcctgtaatcccagcactttgagaggctgaggggagaggatcgcttgagcccaggagtttaagaccagcttggacaaaaaagagcccatctcaaaaaagtaataataataataacaacaacaataataataaaaggaagagcacttcctgggccttgagaagtcttcttgctcacaaagaagcatcaaagcaagtgctatatacacaggaggtcagtttgggcaactcttttttaatcacatagtagctttgccctcatggattctaagtagatagataatagaaaagttgtaagaaatggtcttcagtaatataaggaaatactctttcaaacctattacttttttatcggaaggaaaatttaaacagaatcaactattctacataggtcttaggtttttgtgtaattgtgaaaacaacatagcagaagaattaagactttaacctgaaaattaaaagtgctctctggagtcattattgggttaattgtcaaagttagaatgcagatgacagattacagaaaagtattccattcatgtgaaattttccaaagttgaaagttacactatggttatataaaagactacccatatttataggaaatatacatttcctatttagaggtaaagggctatgatgcatgtaatttacactcaaatggttcaataagtatatatgtgtgtgtggtatgtatataacacacacacacacacatttatgagagaaagagaacacaaacagaaagcaaatgggataaagtatgaacaatagttgaatataggtaaagagtatatgtttttcctaaacgatatcagttcacatctgtgggaagatgatgctcaaatttaaatttctagcccagaagattatcataaactctagacccataaatccaattgttcactagtaatatacagtaaaatatttcacaggtgttttaaaatcaaccttttgattttttttttttttttataatttacccctttaagccagttgccttcagtgttctttggcaccaaactagattctttcctctccctcccaagtccccaccaacactgctacaatccaaaaattctgtctattcaaccctgcaaattctcatcagttgatccacttctgtcaatcactgctgctattattcagcttcatatatcacacagtttataatcatcatcttctaagtagtcccctgcattcaggatgtgcctcctccaatccatcttctcatttgcagctaatttcagatgttcaaatctgatcttgttcatgctctgcttaaaagctgaagtatctctctgttaccctcagatcaaaatccaaatcctcaatacaattacaatgcatgtgaagacactggttcttgcttatttttctaacctcatctctctcctctcatcctaccatcgtttatcctatcctgtctcgtaccatgccacagtctcattcgactcctttcagtggaagttcctctggctgccaggcctctgcccatgctagtctctctgacttgagcactttccttttcccctgctcccaactacctgttcaatacataatcctacttgcctgacttactctttcctcctttaaatcccaacttagatgacattattcgaagaaacaatcatgacatcccaagtctgatccaaccaataattagatgcaaatttaaaataaagtaataagattctgcctgtttttaaactagcataaagcatgtacacagtccttccgtcaataaggttttccttaaacatttattaaatatctgttctatgcccagcaacttctgattgggtcattgaacagatatttatttattgatctcctacagtgttccagacactattttgggtgcagtgaacattcttagaacttagattctaatagaggtgactaatcacaaacaatgagatgggtagtatcagttagtgataagtggtacgaagaagaaacttgtacagggtgctgacctagatacagtagtcagagaacacccctctaaagaggaggtatgtaagttgggacctaaatagaatggcagagcaagggctggccaatgtctggggaagagcattctaagaaaagagaaactgcaagtgcaaaggctttaagataggagcatgcttggtgcattcaaggaccagaaaagaggcctgtctgtgttcaactcagtgagcaagatgtgttggtggaaaggagtcctgaaggccagaacctggagtgttgagcagtgaatgtgctttgtcaggttcagtttaactctgtacgcatttcatttgtccaaataactttgtgagtgaatggagaacacaaactgggctgcattttgtatggaggtcaagggtgatcgaaagagagcatccctagtaaaaagttatttccctaagggttaaagattgagaattggatagaccctggagaaccagaagggtgatgtcagaaaggtagaagtaagtagatcaaagtgtttgtcccacgcaaattggcagcgcttgtcagagtgtcttggcatctaatctctcccctctgccctttcccacccccattcattcctaactgttccaaaattaacttagaacatctttattctttgccagcattaggtggggatggagagtcctgttgcctgtaaacagcagtgacttttgtaaggaagtataacatattgtttaaaaaaataaaataatgaattcagtttttacatcagttttcggcacagtggcctaaatagaccaaatgtagcatacttttaatttctatacctttgtatggtaaaaacacataaaaacaaaaaaaaaataggtcattctgtttttcgtgagaactgccttatttccaggattaattctgtatgactgagagagcttgaattatttccaaaaggatagctttgcattttcttttcttgttaatcagtctctactcatttcataattttctccttcagtttttttttgtatttgagctttgctttttcccttttctcatgttcataccttaaagattgtctaccttttgtagaaaaaaatattattctgataggaatactttttaaaatttgtgtgaaagaaatgtaaatacatatataagatagaaaggaaactggagaagaaaataatatggaaatgaaatagtatatataaggcatataggttaagtccagtgaaactgtataaggtaaacatatacactgttaagcagtctccaaagcatgattgatgtaagtacctaaacaataactttatataattttgggggggtataataaccttcatatataacttgttacatatgtatcattcattttcttcagatgactttttatagaagcttgaaattcaagctcaaaactcatttcttattatgatctgagaattttttctttaattcatttcctttctgcatctcttatgacaattttgtattttctaagtcagatagttaagaaaatctttgttttcaggagttcatcataatgcatttctatatgtttaggactgtattaacattgtttattttgacagagcaggcaaaatgtgaagtacctacatacacttttatggctctcacttcttgaaaattttaaagcatttattgagtatttattacattccaagtactattctaagtatcttacatgtattaaatactttaattctcacacagccctacgaatactaagattctagttttacaggtgatgaaactgagaggcaggtgggttaagtaattggccctacacctcaaggctagaaagtgaaggaactgagatttgaaccctggtcaactatcttcagaatcataactgctcatcactctgcaacacgtgctttcaggcaagcgttagtcagtgcagctcagggaaaacaggaggcaagttgactacttatgcagattgctgagaaatataacaggagggaagaacagaatggaaaacatgcttcttacctaatatgagacatttttccctagggaaaacagaactttggctatttcccttcaagcagaagaaaatatgttcacacagagggaaagaggaggaaatgaaaagggctgtttggatcagatggctgaatcgccagtaacccgagtgcttagcgtaggctgctctcaaacgtatagttgctcattaaactttaattttcattgcatgctacctgatctggtttagtgaaggctcttttatgcaacctaaacttatgggaattttgtgatgtatttaatttccacaaaacctaacatacttgatatgtccttctttttgagtcagagtttcgctcttgttgcccagcctggagtgcaatggcacgatctcggctcactggaacctctgcctcccaggctcaagcaagtctcctacctcattctcccaagtagctggaaatacaggcatgtgccacaatacccagctaatttttgtatttttagtagagacagagtttcaccatgttggacaggctggtctcgaactcctgacctcaggtgatctgcccaccttggcctcccaaagttctgggattacaggcgtgagccactgagcccagcctgttatgtcctatacatatcagccaaccataactgtcagtgtaagtagttcaaaatttctcctaagaattactcttaaacacctactctcttcccctgaaaatgagttaactacttagtaagtaacctttctcacagaaaaactagatgttttctctggaattctttcccttgcagccatcccctggaaagccttgttttagaactgacaccatttatatggcttggcatctcgactgcatttgtttccccatctggcacttctcggggtgaaagtgttcattttggtgttctgcagagtgcattttgagaaatgtgtacacactacaagtgaaattcacatctcaggctaagactataccctcagcattgcaatgtgatattagcaaaagtgcttttataatcctacctgccaacaattcacatctataattaggaaaactacatgatttcaaaattacccaagtcttggaaaggcttgtttttaccatatgtttttcttttgtaaaaggtctattattttcaccgtcttaaaaaaggttcagtttgatcaagttctaattatattctcaagcacatttttcaatcccataaaaataaatcaataaacctagacatttaagtcactttatcacaacttggtcaatctacatggtgtgacaacagatataaggaaagtagataagtccgctaggatataaagaaccaacttacagtaaaataaataactaaactagaaaaagaatctagaataaaaactagagatgtagaagcaagagcatttttgactgccgtaaatcagagcttcttagcagcccacatcccaaaagtggtagatagccaatatttgtcagaaatgatgattgtatacctagtggacagctctaagcacaattataagattgatttcgttttacaaaaccttgaaagaagtaaacttaactgaccagtgacttgagtctagctcctatcagattcccaatgagagcaaagaataaagaacaaatggccaaatattgggaaataggtatcttatagatatgacatatagataaatagatatatttacttatatacatactgtcatatgaccaattcataggtgtgtttgatatggcagtgtgtgtgtgtatggttttataactctctcattcatattcagacacaatgcaaatgtagatagtattactataccatctatttgagatgtaaatattgtaaaagccctcctttgcatattccgcagatgctaaaaaccacatgtatttatgttttgtttggggtgctgcttctgtgtgtatgagttttattgttacatgaagtcttgctttaaaaatttggctgggcatgatggcttatgcctgtcatcctagcactttgggaggccaaggctggtggatcacttgagctcaagagtttgagactagcctgggcaacatggagaaaaataggccaggcgcggtggctcgtgcctgtaatcccaacactttgggaggccgaggcaggtagatcacttgaggtcaggactttgaaaccagcctgaccgacatggtgaaaccctgtctctactaaaaatacaaaaaattcagccaggcctggtggcacatgcctgtagtcccagctactcaggaggctgaggcaggagaatcacatgaactcaggaggtagatgttgcagtgagccaagattgcgccactgcactccagcctgggcaacagagtaagactccgtctcaaaaaaaaaaagaaaaaaagatggccgggatggtggcaagcacttaaagccccacagctccagtaagtccggaggctgaggtgggaggatggcttgagcccaggaggcagaagttgcagtaagccgagatcagactgctgcactccactcttggcaacagagacagaatctgtctcaaaaaaaaaaaaaaaaaggaaaaaaatgccaattcattcttgctttctacctgctgctgttgttttccagaagtctgcagctatgctgaatgatttgaacaggaacatcaaggcatcttcaaaacatttctgttctctccttatgctcaccttataaagctgcaaggaaacattgtgtcattaattttctatacatagcgtgcttggcaaatcttggagaataagcaacatctcccagggtggttgtgtgcataacatgagaatattcgttgaagcactttgtaaacgataaaacattacacatagtaagtcattgttatcattggcattactttaatgtagtagaatggaatccaggactggaataagccattcatgtcactaaggaagagaatggaaattaatatccaatgaaacaccttctttttttttttttttttttttttgagacggagtcttgctctgtctcccaggctggagggcagtggcaatggtgcgatctcagctcactgcaagctccgcctcccaggttcacgccattctcctgactcagcctcctgagtagctgggactacaggtgcccgccaccatgcctggctaattttttggaatttttttttttttttttttttttttgtagagacagggtttcatcatcttagccaggatggtctcgatctcctgacctcatgatccgcccacctcagcctcccaaagtgctgggattacaggtgtgagccaccgcgcccagccaaacaccttcttatagcagagtaccaggagcttaactagaagttttacataagttacctcatgtattgaacagcattcataggaaatactggaactcttaaaggaaccaaatagagtttgtattgaatacaaatgtagctccatagagaagattagacatcatgaattttcatttgagaatgaatcatcttgccaatttatatcattttcctgcaaaagcttattggcttggtcatgtactttactagtcaatgaccagttattatggagttgtcagaacttggccaagaccataagctctatattacatgcaaaatcttagtattattactatttatacaacttcagcgttgtgaactggtggcaccatgaactccattttcttcgtgatcattgtcacttcatcaccttgtactaactctgcacgtggtttttgacaatttgtttatcttttaaatttacccctgaagcccacctgtttgggcatccattagttcttagactcatgaagatcttcacccactgacttgacattgtctgttctcaatggttgtgatctctgccctcaaataaaatatgatgttacagtatgtatatatctcagtgagttgctgttgaagggtctcataaaaatgtgatgacagggaagaaggaaaggcagttttccaccacaatcctctccaggattctaaagtttaaggacataaacagtaagtcagaagcagccgggctataggtgctgccctttacttctaccgggataacagggaatgtggattaaaagggggctaagggctcatgcctgtaattccagcattttgggaggccaaggcgagtggaccacctgaggtcgggagttcaagaccagcactgacaacataatgaaaccccatctctactaaaaatacaaaaattagccgggcatgatggcgtgtgcctgtagacccagctcctcaggaggctgaggcaggagaatggcttcaacctgggaggcagaggttgcagtgagctgagatgaagatggcgccactgtactccagcctgggtgacagagcaaggctccatctcaaaaaaaaaggggggtgggtgctaagtacaaagaaggaagttattactacttttatccattcttttaattactaagcagttagtgctgttgtgtggactttcttctttccctcctagggaaaaaagactaaaataaataactataatgcaaagcagtgtgaactatatccattatgatgcaattggaagttctggatgcaaaacatcaaaattatgttctgacaatggctagcagtatttacatatctataaaggtacagaacaccagcctggttcatactcagcttatcaaatctgctacctgttgttgctattaggactataaaatagagatttgttaaaggtggccatgccatttatttactttatgataagaaattgtacagaggctagatattgagtcttgtgatctcactccatgatagactttacagtatcaacttagtaacgtatcatacagagcatgtcgtcgtcaccgtttctaaaatgttcagtgagccaagagcaagtccacagtcacagggcaggtacagtgagtttcctgtgtgcagaaacagaaacctctgaatcttgcacactgccaccaggggtcagggaccgggcgggaggagaaggcactctggcagaaaggaaatgttatattaccctgagaagcacaggaatcaaaattcctgtctcctcttcttgaaagcagctcactgctagctgagcaaggttcgaaggaaggacctcagaaatgttctgccagcgcaaaggtatgtgtaagtgctctcttagtggctttaaataagttattttggaaagtcagatacagcggacattaaagggcacactttatgttgcattttcaaagtccagatgagctgtatggatctgtgacgatgcagttggaggttctatagctactgcctccaaaatgcaaatgtttggctggggaggttaggagggattaaactgtgtcagaacactgaatctaaatagaatatctttctaaaaagactttacatgtgtgtaaattatttctctatgatttgctgtagatactgctgctaattatgattccataagtactcccagaaatagattcagacataatgattttgagtctcttcatgtccagtggccatttgtaacaagtccttagcgatttattttttattcattcataggacaacatttgtcagtaagatttccatgttgccttaccttattcttcactcaaaaattgtccctaactcgggtaatggcagtgatcaagtcacatgctctcacttttgtcaccactgtattctgggtttcaaagacttgtaattcatttcattaagactctccaaaccatccccttaaacatttgtttaaatgtctctgttcttcattagcgttttattacgttacattctctaggctccagaaaaacgaggcaagaaataggaggatttttttttttgccttttttcttttttttggttgaagttttggtcaaacaagccaaaataacattatcattaaacagatcgacctgtacttttaaatggaaggaataaagatataaaaagaactgaggcgtgtaagtaacctctttgatttttaatggcatgcagcagatggaattcattattgactttaaaaaatgaaattgctctgcattattatttatttatagttttgcctttcaaaagaagtaattaccattactaggttagtttttcctcaatcacaagcaactgtgtgacagtatcagaatgtataatatactttaccacttatttagacatgaggcttaatgatgttgcaggacattatccctttttaagttagtaataaatttatgagcataatgcacagctaagaggttgactatcttttctttttatctgggtaatttcaaaagcaattatttcatatcataagacaatttatttatgaaattctcattgctgaaacaaaagtgtttttaattagaaataatctaatttcatttttccagttcagcacacagatactgtgatgataatcataatttatacaaaattatcaagtgaaatgtttaggtgattggttttgagcccaaacaattttttaattttaatcacaaattctaaaacttttaagtcattggggaggttgataaccagtcataacaaaatttaatttttaagcaatgccaaatatttaatcaattatatctagttcaaatttgagaggtactaaaattgcctttgtaataaaaaaatacacaagaaaggataaaaatttttagtattaaacatggagctgtcaacgctataaaaatgtatgaaccccttttcaaagctgatgttttaaggtatcatttcatatacaggacagcatttatatttaataagatcaggagatttggcgtgagcaggattcagaccacttttgaatttcaatgaaactcctggttcaattagatccctcttcccatccttcttacccctccccagcccattctcctttccccttgctgcttctgcctctgtattcctctctctcctcctccctcctatgccttatatcctcttggcacttttacactgagacatctacaagtggatctgctgtcttcagcagtggtcattgttgtgaaactgaaggatagcaatgaatatttcatatatagcacttaaacctcttcatctagattatgcattttgcttcattgtacccatccataggcacttaataagtgcttatcgattgtctagtgagattgtattataactgattttgagacttttcataccctctgcagttactagtactatatttctttgattctaagatgtacatttttttcaaattttaactttttaaaatctaaaatcaccttgtgatcaagctgtattgtgatttaattgacagtttttttttcaatctttctttcttggtcatgcgtctcacaatcagtggtatcttagattgatgaaatgcagcagtgaaaatatatacctaagtttgtgacttgtataatatgttaaaggccatatatttggaacttcataaagtcttcttttttccttacgtggcttatctgtggccaatttttgtctctcctcactacattcttccactctggcttcctggcactgtggttctaactgttcttaggccactgtcttgactgaactccctggaaaatactcagagaattttattagtaattaccaatattcaactgtaatgaaatggacagggaacaagtttttaaaactgaagacccacattcaagttatgtttctgctcattaaaagctatgtgtatttagcaatctgataattattcccagagcttcaaattacacatctaaagaaggaaataatacaaataatttctttatctataaattaagacaattagtaaaaaatattgtaccagtaaaaatagtgaaaatgaaatgtgtatgacagtactttttaagccatgaagtactgttaaattataaaccataaggatcaacattaaatgaaacattattagaaatgtgtgagtagaaagttagggaaaggaaagaaggaaaaattaaataattcattccaaattagaaagttttaaattatcattggaaatgatgatacgacccattaactagctttctgaatttagaggagaaccgtgaaatctatcttcagattatttcttgcatatcagagtcctgtctgttctgaactccagtgctgaatgcatgccaatctctgagagcttgtatcctttattgaattagcaagccacaacccacagtatctctgtggtattaaaaataaaagagattacttagattccccacttcctttcctgccttgattctttccatttaaaagtgagacccctgtctctacaaaaaattcaaaactaactgggcgtggttgtgcatgcctgtagtcctagctacttagaagactgaggtgagaggattgcttgagtccgggagttccaggctgcaatgagctatgacggcaccaattcactccagcctgggcaacagagtgagatgctgtctctaaaaaaaacaaaaacaaaaatgaattgtattggttttcacagtttcaaaaacattcaataagagtaaaaaaaaaaaaaacttgttatttttgcatctttaaaagacaggatacttcaatggcacttgaaatagtactgttgaatagaaattccattgcaatagtaactataaaacacaagattatccattaaaagttaatatatttagtatatgtgttacttttgaggatagggatactttgaaaaggcaagaataaagaaaagaaggaagtgccatattaaaggcatgtgcaggttaaaaggggaattgaaggagagggaattcttagtcattacttgaaaattatatttttctactatactacatctgtcagtggaaagtctaaatcactttatttccaaagaccacaagttgtgactctgacatgaacatttagtcatatactggggtttaaaaaatgttcccatttcaatgtattattaataacaacaaacacatcagacccacttgatgttaactgctatacttagtgcttttaattcaccaattcattaacatgttaacacattttggcatgataatatattattcatatattaaactatattcttatttccattaatggaagcatcatttctctagctattcaggccagaaacattggtgtaattctaggccttctctttcttactgaccctgcatctaatcagcccagagatcctgttggctctcttctcagaataaacccagaatctgtccagtccttaccacttgcactgcttcctcctcggtccaaacaccatcatcttttgactgcactgtgcaagagactcccaaccggcctcctgtctctgcttttgctccccaatccccaccccagtcagttttcagtgaggcaactgggaggaatgtggttcaaacatgaatctcattgtatcgctcctttgtccaaacccaaagtcctaatcatggcccacagggccctaactgatcacccccagcacacacacacacacacacacacacacacacaccccttacttcatataattcccccgccattactccactccgacttcactagtctctttgctattccttgaacacaccatgcctgcttctttctcaaggcctttgcaatttgtgtgccctctaccttgaaggctctcctcctagagatccacatagccaacttcctcactttcttcgggttcttataaaattgtcttttcagtgagaccttccctggccactgtacctaaaatttcaaatcccctgcccatcaacagttcacatacactcttctctgctttttttctttttctccttacactaacacatatttatctaccttattggaatacaaacattataaaaaatgaatttttgtctttttccctccatattctagcccttgtaccaagagcagggcctaatacgtagaatgtcttcaaacattatttgttgaatatatcctcagttaaccctgtaccctcaataggtacaattattacccccattttacagatgaggaagttaaggacagaaaaattaagaaacttattcaaagtcaaacaagctaagcaagcgtcagagctaagattcaaacccaagaccctggctccaaaatatatgttcagatcactgactgagtagattaattagaagaagagagctacctatagattcctctattccctgagattttcttcaatatgggttccatccagttaaatggaaaaattgtgtcatctgctactgacaacatagtcagatatagtaaagctcctttttctcattcctctttaatttctttttgtaaaaaaaagtatgagaccttttaaaaatagaaaatatatgtatattttttaaaagcaaccctaatcccacccctgtggacattaaaatagtaataataatgttaacttacacaatagtaaaaaaaaaacactagggaaaagtatgaaatgaaaacatgcattgaatgcctattatattctgtaataagtcggcactctgaggacatatttgttacatggagtctaatgagagagacagacacatactcagacaaactctaaattggaattcagaagaaaaaacatcaaacagaagtcttgtgacagctgaaagtggggcctggtagagtaagttgtggggcaggtgaatagtagtggtggaaagggattgaagaactggagactgaagaaacagtttctgaaagaggaggtgggagagtaccaaagagaaatgtgacttacctcactattttgctatagaggatgggacttagtatgagagaaggtttttaaataacattttatatgccgtagaatagaaattacaggaaaatcagttattgaaaggctgtgttgaatttaacttgtaaaagggtatcattacttatccaaatgcatcatgtgagaaaattgtccagttcatttccccagactacctcaatctattccttctgacaaaccagaacaagaaattctgttttccaaattgttatttttgctaacacattaagccagcttcagcttcctacagcacacatacacacacactatcctgtgttatcctgtgtctgtttagtgttttcattcacatgtgtgttttctttcctctccacccttgtttctctggaaagtcaggttttcgaccaattatttccctgatttgacaaggtcactctgaacttactttcattgaaaccattggcagtatggtctagcttagtgacagactgctgggtcactcaggtcctttgataaaagggcatagtgcccttgtatggtggccattccaaataaggaagtaaagaaggagtaagatatttagataacaaatgttaagaagaaaataatagagtaatgagactggagtagggtagggcagtggtgcaattagcctggctaacgatgggggcatctctgagaaggtgtcattagaattgaaacccaaattgtgagaagaaagcagaaaaacaaggatcgggaagaatagctaaccaggtagagagaaaagccaggtggtagaaattaatttgctttgttcaaggaacagaacaaataccagtaagatgggacagagtggtaggggtacaaaaatgaggtctcagagatagctgagggctgggtatacactcaaactgaccttcgtttacatctacaagcactggaattgctgtttttcaggtgtgtcccaattgtaaatctaccattatttattgtagaaaataacttcacattgctctgcactgtaaaaaacctttgacatacattcgcattttatttaacatttcataacatcactttgaagtttgcagacctgatgtttgtttttggttttgtttctgagacaggatctcactctgttgccgggctggagtacagtgatgcaatcatggctcactgcagccttgacctccctgagctcaagtgatcctcccacctcaacacactaaggagctgggacttcaggcatgtgccactatgcccggctaatttttctattttttgtagagatggggtttcatcacattgcccaagatggtatcgaattcctgggctcaagcaatcctcccacgttggcctcccaaagcgctagaattacaggcatgagccactgcacctggccaagcctaatgttatttctgttttgtggataaggaaattatgataccaaaaggttacatgaattccataaaaaggtcaactccccttccctccccataccccacatgttttgacatgctatgcttgacacccattttgacttgctaggctaaatcaaaattttcaagctgggagcagtcgtgtgtacctgtaatcccagcttgctgaggcaagagaattacttgagaccagcctggacaacaaagtgagaccaccccctttcagaaagtcaaaactgccttttagcttggatagaaaatggatttgtgactttggtataactaagggctcattattgctcaaaacaggaaaacaaaaagaattgctgcaatgaatgaaaaacaggcaaccttggtttgttctaatagcacatgtgtgtagagcaagaatctacattctctgtttagccacattttttattctgctgggtggctagtttataaatcatgtgttggtcactgtcagatttaagttttaagtaattctctctgaaacatgtatttgaggagagcaggacagcttaggcctggtgagatatgttgacaatctgaactagggtaatgatagtttaggtctcctcgcttagccatcttagtcactaaggtgtgtctgcattgtataatcaataatgtttcccaatcttgttgaaatgacctcacatgtgatagcacttaaaaattcaaagaagtgagctatagttacttttcttctatttttcatatatttactttattgtaaacgtatattagattatatatgtctttttaggaatttcagttatatttaatacatatttttttctctatatgcttaaaattgcttttaattttatatcttttcaaatactaatgtataatttttagaattaaaaaatattttctatcaagaagtactattgtgctctgttctgcgttttgtgtgtgtgtgtgtgtgtgtgtgtcttatagcataagttcttacaagaaaaaagacaattttcttaagttgaaaaaacaatctagatacattaaaaatattccagtgttgaagctatcaagcctactttttagaggcaaaagatagctaatcctgtttttccttgtaaaaaaaatttttaaaaagatattatatagaagtatattatttactgactcaactattaactaaaaagccgtttcaccctatgcagatgataagatgaaggttatctttaaaattcattttctaaaaaaaaaaagtctttcctgtttcttgcttattgtttttataattttagttgtatttctacacatgtcattctctgtatggcatggccttgattgaagtttggtgtcttttcccttttcattcagtccttttcatatttttacattaatgtaattatttttgctttggttttctggtttattaacaccttctctgtctgaattattaaatccatgttgtaaatttttttttaccttaaaagtagctcattttcttaggttttttttttttttaacacttacacatttattaagcttgaggtatgtgtttaataatatctttaaaaaaattatttcacttttctgccaagtctcaaagctgctttcctgatttaacattgtagatccctgtaataattttttacaaatcactattaccagatcttaaacttgaggaaaaaattttgtggttattattcactagcgttgtgataaatatttcaaattaatttttaaatatatattataattatcatattttaaatgcatcatgattttaatgtgctcaataacttttgtaaagcactaggatatattttttcttatattatttaaaatattcgagtcctgaaaaatatgaaatgcttggatacatttcctctattatgtttcgatgcttttctccgtagttaacctctcgtgtctacaacaacctgtatctcaaagtacatgcacatgttatgcaaacaactaaaaccaaggcaaaaaaaagtacattctattaagcaaaattggattggaagcacatccgtaaagggaagaattcaggatagaatagtgatatttcaaaagaaaacttggtttctcacagattcctcatggtatatattcagatgttgttacataagagaacattccttccaaattatttagtttctggtgttttgagagaagagtagccttcgacatgtcttaaacttcccttgcattcattactttttaaatgtatgcattttaatatggagactctcccacaaaaatagtggaaaaggactggtgttttacagtggaaatactaaatgctgttgagataaggaaaatcaactttttgaaagaaaaaaagatgaaatgatagccatctgatggttaaaaagtggtaacgtgagatattctatatttgtgttttacatcaattctattatgtctgatttacccttgaatcaatgtagtggcttaatgatgatgacatcatcaacatatgaagatgacaaaaaaaattaagctaccgaactacccaaatgtttttagggaatctttctacttcttccccgcagccaagaagcaattatactgacatttagttctttcatttccagcaggaagcttacctactcttttttcggagatgattaaaacctcatgccacttagcaataaagagaccaccattactggtgggattcatagtggaaagcattaagcattttggcagtgagtcctaaagcctttaccatagcaggattgatataggaataagtggagattgagggcacaggggatccaccagctatcccttctgcaggtctgtatgattgcacttagcagatttcccatgcttactattacacagagagatttactacatagaattcctaactggactcctacctttcaggtttctccctgcctttccaatccattatccacactgccatcttaacagtatttctaaaacgtaaaattcattggttctctcctttaaaaatctttggagatttcctattgccttcttcatgtggtccaaactccttattatggcacatgtgggtctttcagggtttctaacctatattcctagaacctcctgttttctgtgtccttttcccaaagagctgacattaggaatgcctgtccattggattgttgcaagggttcgatgataaaatatatagaaatatttcataatagctagcatttattgaccctttatcatcttaccaggtgccaaagactgggcagggaatttatacatattctctcatttaatcttcatacaaccccaagagatgtaaatgcttttataaactccattttataaatgaagaaacagattttgagaggtcaggcaactttcccaaggtcacacctatagatagaaatggagttgaattttatctctccaactccaaaattgatgcttttatagattttactgttgcttggcacatttcctagtgtacaattccatttgattaaatattcattttttaaaaaccattactataaaacttacagtatctaaaaaatattttggtttgctttccttgccctccaaggttagctgatacctcacttcttggactctttctagatgtcccatcccctctctgctatcctcttccatcttcacacgcatcatacttcaagtgtaatggttgacctgtatatctaatgcctctgatctgttggcacttcacgtatgcagcactgtgtctccattgtcttcgtaccctcagggattagcatcttgatgttcagcattcaatatctgttgaacaactgaaggaataaaacagactccaaggataattttaaagtatgtgggctctctcttttctcacaactgctgcatttctgcttccatttaatgtttaactgcactaacacttcaactaacactcagctagattatgaaagagcaaagacagacttcagagcgtaacagagtaagagagaatgaagaaaagacaaaatcaccctcttttacttcattcctctcccccaccctccaaacttgagagattgtcttgccagatgaggaagagacaaagttgaaggagagaaaaggtgtgcttagatagtaaaataacatttaaatttttttaaagattagttataccttgtgttaagtctgctattcaagtctgtttttttttttcctcatggtcctttttaacaatattttgcaaacacaggaaaacctacattcatggcatttctgagaggttggcaaatgaggaaacactcccaaattctctcctgagaacttacaggagatcaactgatgagcacatggtcaccaagtgagtcagtgtaagttctatgaatagggcttggatcttctgactactcgtctagggtcctagtcatctagctactgccatgttccctgaagaatttggtaaaaatagcagatggcataactgacaaagtaaatcattgtcattgccactgtccatgttctatttttccatgttcagtagcataatttaaaaactcattaatgcatgtatgctattggttattatgtaataatatgtaaaaaacaccagtacagaaatacttctataatttacattatacctttaaatacagagaacccacataatatcaccacaaaggcatttcataaattatagaataaaacacataaatattcattctgcattattattctgctaaggaagagcgcaaacattatttttaacaaactgctctttaaaaaaacttgtgtggtaggattctccatctgtgagtgagattcaacaactataaggtccaaagcagatttggtactctgggagaaaatagtaataatgtaaaacaaaataatagtcaatgtgatctaaatacagtatatctataaagtacaatctctttcttaagagagagaaactcctgcctctgcctttacatttattagacaaacattaaaatctcaccaatttaccccctttgtctcttctttatatagggagattgtggcttagctttctctgggagattgtggcttagctttctctgtagatataaaaggcaaataaagcctgggtttgggtcctagcgctgctaccagacaaatgtggaacagtagaaaagtcctacaatctcctttagcttccgtttctttatctgcaatgtggggataatgttacttactgtccttcccctcaaggttgttgcagagatgaatgacataggtgtaaatagggctgaactcattcaatctctgaacagagaaggattcttacaacatggactctaacttcgccatttttcagctaagaaaactggggcacaggaatggtaaaggtcatgcgtgtctaagacacttggccagtgagttatacatctattataagactagaaactaagtattttgattccgtactatgttgttgtgttttatttttgtgttttattattgtgtcgctgtaaggtttctttgtcttttcacttactaggcacaacagaactcatatgcacgtgcaagaagtaaaagctatgataaaattatctggaaggggaagcgggttgtttacacaaagtaacatgatagcagatgagcaaagaggaaggtacaaggaagaatatttactagagagtttacagcatgccaaacatagagtaaaaagtgaaaaccttttagccagatttgtatacctgattaaatatctactaagggtattatttttaatgtatagagttatcaaaaacacattccttgctttctgtttctaacacttctagttctagggctcagtggctcttaacaatgagcaccaaaaccctgcttcatgctgtgttgctgcctgtgctagctgagggcagaaggtgcagtgagaaaatgtaagggacttttgggggttggtcggaaagagatgaggaatagttactgggcatgaagataattggaaaagaagaaaatattgactaaacatgtcaaatactcattcaataatgaaaagtaagaaagaccaacaatatgtgagtggttgagagaggagaggcagaaaagggaaccaggagagtggaagtgcttgaagctttttagatgagagtaagagctgacttaaccctgtgtatgtttgatcattactaatcctccttataccctagttccttcctttatttccttaatttccacatctatataaatagaatataaatacaaatgtaaatgtattatctataaatagagataaacgtaagtattacattatcacctgtggttttctcaaagctcacaactattctatggcagttcttgatggcattaagtgaggatgttaacctgttgttttacatgcatatggatggaacacaaaattaaggtggcaatgtaaagcctttagaaatattcacccttcaactgtttaagcaacccactttgcatttatctattagtcttttgtttagctgccataaaagccctattaaaatgtttttgtggtcttaatttttaagttgttgcaaattgaattgttaaaggtaaaatattttatggtgtaagcctatagtgagagcaataagtgaacatgtaatatgttttaattgcattctgttaccgtatttatttcacttcacagatatttattaaatggttactatatgccaataatgagctagatcatgttgtaaaggatcataatcagcctactaagaaagatttgattctaataaggtcatacagatgttcagtgaatttacttggagaacatattgctgagatagggatttaattgccaactgaaaaaatcccttcagtaaagttctgagaaaattgctatgtctgctatttattacagcaccttatatactactatatccctcatcaagatatagtacaaaaaatatactaaatacttagtttggaaactgaaatatgatcagaggccctgggaatattttagttcttatcctagacaaggagaccaaaaagtgtatactcattgagaaaatgtcaatatgctcgctaaacctaaatatagattaggaagacagaaagttttctagatatgaaatgaagaaagatacaacatgatccaaatagagctacccttcagattttaatgaaaggtttagagagaaaaaaatagtgttcttcaagcttaatgtgaaaacaaatattaccttcaagtggtgtcttcaagtacatacctagttttgcagtagcatccattattgaagtgattacataaaacatgttctgtgtcttttatctttatatggacagtttttggaaaactgttatggcctaaaatctgaacatgttttaaaaatgttattgtgtttgtttctggataatcttatttcatctaattcatttttatgttcagcttttaatcaataatttcaggttaaatgcaattaaatgtctgaaaatcaaacaagctgtcaaattaaatgctctactatctaataattgatgggtttttcttgttggctaatgcttcttctgtattgatcttaattttggtccaggcactcaaaagaggggaacactttatatacctctttttttttatttcaattgtttctgccttttgtcaagttagacataattttgtagcctgtcatacaatttttacttatgctttacttgcatcacaatgtaaatagtatgattcaaaatattgcatattccagcatgggcaactggcaaaaccctgtctctaccaaaaatacaacaaaaaattagctggacatagtggtgcatggctgtggtcccagctattcaggaggctgaggtgggaggctcacttgagcccaggaggcagaggttgcagtgaaccaagatcacaccactgcactccagcctgggtgacagagtgagaccctgtttcaaaaaacagccaaccggccgggtgcggtggctcacacctgtaatcccagcactttgggaggctgaggcgggtgtatcacaagctcaggagttcaagacaagcctggccaagatggtgaaaccctgtctctactaaaaatacaaaaattgccaggcatggtggcaggtgcctgtaatcccagctactcgggaggctgaggcagagaattgcttgaacccgggaggcagaggttgcagtgagccgagattgcgccactgcactccagcctgggcgacacagtgagattccatcaaaaaaacaaaacaaaacaaaacaaacaacaacaaaaaaaaagccaaccaaagaaaatattgcataataaaaaacactacaaaattatgttaatagcactactctactctgctgttattatatggccgtcttacaaataactcttcaaaagttattgattttcaaaatattcccttcaattattttactttggtcttagtgctctttgtcaattttaccatcgtatcttactctttgtatcattaaagtaagataatacatctctgaaagccatagtcttctagaaaagacatctgaaaaactcaagcccaaaaggaaaaagaaaagaccaaagtgtagaacaatgttgggcttattatctaatttatttttggccctgatcatctgagccagcagttgcttcttttgaaaggtggctcaaagttactctgtgctgatagaatttattacaaggaaaggaataatttcctcgtcatggtgtcaacttataattgcagacttcaagttcatataagtcatctgctatgttcctaaagtcataagacaattcagaatgtacattgctgttttgggtcatcctaggcttccttctctagcttcttagatttcccaaagtgtcaagtttaatttgaggatttgctccaaactgcaggagcttattaaacaaaagtaaggaaatatcagaggtcccatatgcttaacttcagcaatttccttattaataatgacatacaaaaaggctacataattcatattggatttacctgaatcgacaataatctcccttggttttctaatatccaccttaggatgattttgaaccattttacatagtaccattttgttacaaaatttccatgataaactatcagaactactactctttgaaagacttacttgaatgcgttaacataagattttttgaaagtcttatttgtaggctttatgagccagtataacgtgaaaggcaagttaaaacatgaaaaggaaatcctccaaaaactaacaatatgctccctctgagggtcctgcctagttctgtggcatgcaaagctatagctgatttataggagagcctcaaatgaacaaagggctgaaaagctaattttagaagaaaggtcccagcaactaaaatattttagctcagagtaaaaaggttacaaaatcaagttatagtagcatatatttattgaccacttgtcacatgccctataatgtaggtactattatacccattttacagatgagaaaactgaggtttagggaaattaagtaacttgcacatacaagtagtaagtgatggaggtggaagtggactaatagaaatatgactgtagagccctctttttaatgctacagttattacaaagtataaggatgatattcctacagatcaagtagttaactgaatcacatatctccttaataaattattcccaaaaaagatgagcttgaatctattcaagttttttagacttaacatcatttacttaattagaaattaagggtaataaaggaggaatatgttaaataataccacatggaagcaaacatgcaaatctagaccaggataactgacctatttctgtaacaagctcttggcatgcaaaaaaaaaaaaaaggcctttgctaggatcttgctagtgtggtccactttgagtccagcaacattggcactacctgggagatgttaaaatgcagtagctctagccctccccagaccctactgaatcttaagatccataagtgattcatttgcatattaaagtttgagaggcactggtcttaatgacaaagacttaatcagttataatatgtagaccttgtttaaatgatttaaagaaccagctgcaaaaagatatttttgccaagagaggagatttggtcattgacttgttcatcgattctaccaaagaatgactgttaatttcacgaggtgtgataatggtgcctcctggatatgaatgaatgtccaaatcttttaaaatttaggcatgcatagtgaagtgtatatgtctagaattttctttacagtgttttatcaaagaaaatagcaataagtgatgcaaatatgagaaaatcttgaaaattgttgcatatgtgtgattggccattctactcctctatttttgagtatattatagagcttttcataaatttgtttttattttaaagattaaaagaaatgggtttatgccttaggagaggtgcatttgtttttgtttttgtttttttgacatagtcttgttctgtggtccaggctggagtgcagtggcacaatcttggctcattgcaacctccgcctcctgggttcaaacgattcttgtgcctcagactcccaagtagctgggattacaggcatgcaccaccacacccagctaatttttgtatttttagtagagacagggttttgccatgttcccaaggctggtctcgaactcctgagctcaagcaatctgctgcctgcctcagcctccaaaagtattgggattacaggtgtgagccattgcacccggcctcgaattttagaaataactataagaaagaagtttcttatagtaagagtgattaatcacttaaagggatgccagaaaatctttctccaaaggattttttacaataggacaaattcattggtctggggcagttttagatatagtcttggtaaaagccagaagacttaaaaaactttcaagttctctttcacaagaaatgattccatggtagatgttatacttgtgaatactttgggccatttgcgtcagatttaatgccttagttatgattttcttaaaaagcagttgatgatggctctgttctagccctgtacttactctcatggcattcttcactggcagttcactttaatggttgaccaatggaatgctgagctacctacttgtccacatcaagcatttaatagagtcctgtactaatctcattcttataagtgcgaactaaggccttttgatgttatgtgatcaataggaaacactttaagctggtatgtgtttgtcatatagaaaagcattccttttaacatcatataaaccctttaatgtacttactcactgtaaagcacatcatttttttttttttatttctggacaaggagggcaaacaggaattccacaagctattaccagccaaacccttttgcaacttattaagtggcagtatttgtgctagtatgtcttatattttgtggctccttcctatagaaacccgagaatagttttcaaaaactaaaataaactcagccatcatccccagagatagacactatgctgtatgcagatgaaccactaatgcctgactggtttagtagatgccatgtatttatagagtgagtcagtgggacagcaaaaatttgcttccagaaaccttcctatttaaaatacaaatagtttctcctatatggttctatgttttggtctatttgtttgggcttcatgggataatacaaaggatctaagtttttctttaaacgaatacctattaggaggaataaatgagtagaataggatagtgaagggaattttggtttcaactgtgaagcagagtcactgacactcagacagtgctacttacattcctgtcatttaggtatgcccatggtgacaggctccctatttataggaagccgcattcttagatgtgtatgattttcaattttgtagatatttgtttgcttttcctcttctttattcttctagtcacctagtctctctctgttccatccacaagagcagctcctgcataaaattttctccattgctcattagccctcagtgagtacaaacaaaatctggtagtcaaatcgtaatcattcctttggcatactgcaaacatgccccacacacccctctactcctcagcttgtttgttttgctatggtacaatattatcatccttggctagagaattgtaattaaaataatttgttgtttctcctaaccttgttgctactgttaaagattgttcatgattataaaatataataacatttcaagatacctaaaattcttctactactgtaggagcatgatgctattttaaaattatgttatgtcaaaagaaagaactttaatgtgtgtgtgtatatatatatatccaaaatggattctacagtgaaataaaacaatgagtaccatttaaggatcattttccccagaaaacataagattaagacaaaaagatgaacacgtgttaaatattttatttcattctgtaatgaaggaaccagtaagatgttacagatagttcaaaggggaactcaaaaaccagacatatttataaatcaagacgactgaaatgaaagtatagacggtacattcttccaaccttggggaggaaagtcaattcaaagtctattgggttgaatttgcatagacaagaatgtcattgtttatagacaaaaaccgttttgtcttgctaccagcttttacaatttatagagttgtaaattagctcctatcaaatcagaatcagatagccctaagagtatactctagacactacatagtttcgactttttttttttttttttttagacggagtcttgctgtgtcacccaggctggagtgctgtggcgcgatctcggctcactgcaagctctgcctcccgggttcacgccattctcctgcctcagcctcctgagtagctgggactacaggcacccaccaccatgcccggctacttttttgtatttttttttagtagagacggggtttcaccgagttagccaggatggtcttgatctcctgacctcgtgatccacccgcctcggcctcccaaagtgctgggattacaggcgtgagccaccgtgcctggcccgatttttattttaaccagcagttttgtattcctaagggcaggatatccatagttagtccctcctgccaagaaaaagaagtccagcctccttaggctgacgttcacaatttagcttcagcttctttctaacattttcttttatgaatcccaccatccctatatcctattttattcagtcaaagttaactacatattcccaaattctaattaatctttcaagtcattgataaatcgtcaccttcaccaagaagccatgtcgtattttatctattctaaccgggaattactaccctccttttgatacttacgcattttttagtacttttcttctatattgactatctgctgttctcaaacttgaaggcatcagaatcacctagagtacttgttaaaacacagattgctgagcctcatctatcctctgtatcactggatttgaggtggggcctgtgaatttgcatttcttacaagttctaagataacattgatcctgcttctctgaggacaacactttaagaaccacccacccagggatgtcaaaaagcaaatacccggctgggcgcgatgactcacacctgtaattccagcactttgataggccgaggtgggcagatcacctgagttcaggactagcctggccaacatggtgaaatcccatctctactaaaactacaaaaattagctgggcgtggtggcacgtgtctgtagtcccagctactcaggaggctgaggcaggagaaatgcttgaacctgggaggttgaggttgcaagtgagcagatatcgtgccactgcactccaacctgggcgcaagagtgagactccatttcaaaaaaaaaaaaaaaacctataaaacaacacaacaaaaatcaaaaaaaaattcagtttaaaaatctaattggcttttttctttcagcagctcatgaatgggacagcatcccatctatgaaatagaaaggtgcttgaatgagttggctttataggaagaaaagggctaaagaagtggaaacaaaaagtagagtggtcattttgaagttactttccttatagagttaaaccagaggggactttcctatcataccacttcaggttgactggaccccttctgactggttgctatgaatcttccttttttttgtttttgcttttaaactggttcattttaaatttcagtctgattgtgcggcacctagcacatgtcactctattctgatttgttctggtcttatggggcctactgcaggtgcttccataaatggccttaaacaattgccattaaacaatggccaaccttccataaaacaatggccttctgtaaattttattttatacagagaaaccatgtaaaaaactgcagacaagaagatgaatgagacatatacccagctcttcatgagttcacaatctaacgggagtgttgaaagctggctccccaaaatatcactgatattacctttttggtaagacaaaacaagttcattgaggtatggagaataccacttcaacagagcctttgtagtgcctaaaaagaaggaaaagggtgggacatagttggaatatttgagattttcaagtctaatttaaggcagatctctcaatagggcaacttggctaagattgggtaaggatcatgatatgatagtttaggattgataaaataagatgtggcaagggattcaaagagtcctagtgtataaactattgattaatgctttctattgaagaattgatgtatcattccagatgctcctagaataaactaggagacagtagagtgagtgtaaggtcatgttaatgtagacaagtatattaatggtttccattctcagagacagacacataaacaaaaaattagtatggtaaggtaagtataatcaaggtagtcacagtgccctttgtgagcaagtatatcaaatcttgtaacctccctgccatctgccactgccaggaattccaagatggtgaatgtcttactttggtttatctctggtatatcaaggaaaaggcactgatttttagcaaggcaaagtttgtccttgtttctttctctttctttgtttatactgttaacagcctcagaactgatgtgtatactttcacatattttatcttacaaacaatatcaaatttgtggggaatgaaaatagttcatatttattaaagacctactatatcatacaaccaatgcaaatatatatatatgtttgcatatatacaaatatatacatttgtatatacgtatttgtgtatatatactaatacatatatttgcatatttgtatatagatgtatatatacacaaatatatgcatatgtatatatacatatatattaatgaactatattttatattttcatgttaattatgattttccccttataatgcagataatcatcattgagaccttaaggataagcaggcatctgtatggcgctctttttattttatctaagacatatggtctcttcttttgaggagaaagtagtgagaatggcagaggaatcctctctttaataataatagaataagtacatgtatatttaaagtgtgaataacatgtaatctttactttgggaagtaacttcgatagcataaaaataacatttatttctttgcaaatcaatttttagaaataccctaaactgattatatttaaattacatctgagaaagacaaatttaaaattttgaaattcaaattttgccagtgattcaatgttcaaattcttgcaataatagttacaactttgtttttaacaaatacaccctatgtttgttcacaatacttgaaagaatacatagcatgctttttactagttccaaaatcaaactagaacatatgcatactataaagtaaatttacttcatttatttatgacaagcttatatgcatgttgcagaaattcactgaggtaaaactcacttctatactttttaactaaaattttaagaaagcatctacatagacagtagtataactctacaagttatcaaatacatccaatcatgctaatgacatttacaacatataaatttgctagctaaagaaacatcattctgttagccataaacttttttgcacacagctgtcttcttctttttgccatatgagcttacaatcacatctttcattcccagatttttctgtgccaattgaagctaagtcaaactggtataaagaaggctttagagagtaggatgtcttgaatgggacctcatagcttttgaagctagtgagtgaaaacgtggggctgaaagagcaagcccagaaagatatgtcaggaagtggcaacagcctgccctgcatcttctctgtaaatgagatggagaagcatcaggatcaatagaagcatgttatctccacgcacagcatactaaagtacgagtgttaaagaatattgaatattgtgtctagatacaggatgaaataaggctttttacaaacagactataaaagttgccagaggtgtaaggtggttatgggagcgctgaatctttctcaacatccagtagaatagggtttcttaattgagtattagtagcatacccaaaaaatcaaactctggcaaacaaagtcatgagtaatcttaataagaaagcaaaatggggcgataccagtgtgatttggcaagctgttttctgagcttagttcttagaagaaacaaaagaggaacatattaccagggacaaaaaacaaacaaaaaagactggcataaaactgtgaaagagtatcaggccaaaacatagagtgaggttatataagcaccaaaaaaactagtgaaaaggaaagtcctacaataaaggagaacaagatggatgggtgaggcttgtgttgtttaacaatttattaaaagaaagagtaagtttaatgcctatttaattttttttttaagagatggggtcttgccatattgccctggctaggcttgaactcctgggctcaagagatcctcccagctcagtgtcccaagttgctgtgactacaggtgtgcacaaccacacttggccacagttttgctttatttttctcaattaagaagaatgagctacaaggaagtacaaaacaaatactgtaaaattgaaatttttaggctaaggcacacagggatacagtgaaagaacacctacatctactttacatgaattgaaacctcttggtccagaaaaccagaatattttcctatgtggtcacaaaacctttggtagtaaccttacaggaatcatagtgtatttttgacagttatactccctcctgtaacaaacttcaaaatatataaaatggcttaaatacaagagaagtttattcttgtttgagtctacatttggagttcctgggtggtggtggctctccactaagggtgggttcaaggacctaggtaccttctatctcaaggctctgtcatatttaataaatggcttctcaagtcaccatgttcatctgctacaagtatgtgaaaagaaaagagcatggagatcaccaatagggactctctggccaggcctggaagtagcacacaccatttttgcagtccttccattggctaaaaaataatcacttgagcactgctgcccaaaaaggaatctgggaaatgtaggctcactatgtgcccagaaaaaagaagaatcaggtttggttacagctagccattctgtagctggataatgagacatctgccagaaaactgtagttaggcgaatagcccgaatttttaaaatgctattgaaatggagttgaagggtatagaaacatcatagacttgaaaccatttcagaggggaaagcagtgatcacttggagtctgtaccttatcttctgcgtattagaaagatgtttaactaatatgtggcattgttgataaatgagttctgggtgatggtagcatttagtggattcatacttctttagattaatgtgttcaatgagtggtagtcattgtcatccttgaaggtgtcagttgacctgtgtcttgtgactttcctttctcatgtctcattaaatatttttatgaacaaccttaacagaggcaaatttatggttgactcagtaattagggataccgaatgtcactgtgggtgaaagaatcaaaatgatcccaacagtttagaatacagtccaacagaatttttctgaaaagggccagggagcaaatattttaggctttttgggccataaagtctctgtcacactagtcagctctgctgatatagtcccaaagcagccgcagacaatacataaatgaatgggcatggctgtgttcaaaggaaaccaaatttataaaaacagatggccggccagatttggttcatgggccatagtttgctgttccctggtctagaagaataggctgaaattctgaagggaatcaatagaattttttttttttttaatttacagccaaagaacaatgggcctaatacatacatcatgtcctttctaataatagaagagctccaagttaggcactatttgctcttattttacagatcagaaagctacatctcaatacataaataagtcaatagtttgacctagctttcacagccagaaaacccgctgtgggacatcatgccactttaaccaaatgtttgggtgaactgagagagtaacagttaattgcttgagtaaaagatggagggaaatgtcatgtggcagcatttcccatgggcaaaccctgcgttctggctctgttcttttccaagtgtgtgaccttgagaggtacacttgacctctctcggccttgatgacccaatccataaaaatgaaaggcttgactagataaacaccaaggccccgctcatgtcttatggttaaggttgcgattagtatgttaagggcattgtgtgaaagacaattgagatgtattctttgtagctcttaaagtaattattttcaaccattttctagtgtacttttatgggagaacagtatgtaaaacataaaaatggcattttatgagcctacatgtgttttacaagttcaaatttacattttgattataaagatatttattgagagaataaggctgataggaaaccaaatttttaaactgggaggataaatgatcgacagattctttttagcttcagcaactccgcattctccccattttgcttttgttgtttgttggttttcctctggttgtattaagaaaatacttattcacatacacaaaaggtaaatgaatagtttcgcaatctcagaatacttttcagaatatagacatggcaagagacaattgaaaagcaaaatcattaacaaatcaggtgatctttagcatattaatatatcattaaaaatgtaacttaatcatttgcaaaatctatcagtcaaaataagctaagcttattctgtgatgccaaatgaacccctaaacctaagtgacttgctgaaataggtgtatatttcttgatgtatttcttgttcctcttacatatccaattttgggttgtattgggagcaggggctctgatccatatagttacatagggatccagactgatggaggctccaccatcttgtagctgtaccgtcctgtgcacatcatatccttagctgctgaggcaggggctgaggcacctggagcgtaaaacactggcagttttaaacagcgcctgttctttgcacacgtatgtgaaacacatacatcactgctcggtggttgccagatctagtctcatggacctttttcggaagtcattgtgtgactcatatgaactaaatatgcaaaaaccatttggaagaactaaagtagcaggccgcaaacgtggcttataatttaaaaattgaggttcctgagttccccaccctacagccatggaaccagaatctctgcgtatagttggagaattttaattttttaaaaagttccacagctgattctcattatcaacaggcagctgctgctgtgaacaaggagtgtttttaaagcggagaaaaggcaatacttagattggcggatttaagattaccctggctgcagtgttggagatcgattaaagagggggtaaagtagaagctgggagatttcattttactacataatgtataggctctaatgagcaaacacaaatgcatgtgcttacatatcatgcagtgtgttagcagaactagctcaatctgagggcctaacaatgttgttgatgtctctgtatatttaagaatcttatccccaacccttccttccggactcctagaaaaccagtagggtaggtacaaattggctgccaaccagtccttgttcaatgcatttgataaattctactggtggtggtggctgtatagccagcttggcacccatatgagtctgtggatagtaggtggggctgaggtgcctaggcatgccctgcttctctcttgagaggcaattagaaatgatccaactttccttcaagcctgttagggcagcatagatttgagttttgaatctggttatattgctgtgtctactgttctctaggaagacttgagaatttagagtagatctgcaacagaagaaaatgaccagtgcatgattctgcttgaaaactaaacctgtctagtcagtgctggatcatttaaagattgaccatctaggtttgaatttctcttcctatatgctgactgcctttgggctgattcacctggggatattagcatctttcccagattgtgtttggtatggggaggtggggagttagggaactcccatctactttgggaagaggaataagttctattcctttcaaacattatgtacagcacttaggagtttgctgttcatgcatcatggctgaaacatttggacaattgataaaaatttgtcattgctgcccagcactttctctgagatggatgaacttataggtaggctctctttttattgtacttcatttcatcttgtattgacacagccccagttatagactttcccccaacagaaggaacaacaacaacaaaaaactacctaactactggttacaggttaaagctggaaatgtgctggcaacagatttaggtttttccaatattattttgcctgttcatcttcttttttctctattatcttttttttttctttttttgagacagagtctcactctgttgcccaggctagagtgcagtggcgtgatctcggctcactgcaacctccgccccccaagttcaaacgattctcctgcctcagtttcccaagtagctgggattacaggtgcacaccaccaagcctgactaatttttgtaatttttagtagagattggttttcgctatgttggccaggctggtctcaaactcctgacctcagggtgatctgctcacctcagattcccaaagtgctggaattacaggcatgagccaccgcgcttggccctattatctttaataaaaacaaagatagggaaattatccaaaaaattagctaaaagctatataactttaaaatatgtgaaattaataatttcaataaagtacttaatataccacaaaacaaatgttttcacttatcagcttttcagattaagtatcaaaattctattcaagtaacatgagaaggtacagcaatatgtgaagacccattatagaattaagagaggagaagaggaagaacaagggtaaagaagggcccagaaagataaaaagacagagggtaagacctccttatagctatgcatacagtaccttctgtagacacacactctctactgcaacctcaaagaaagtgcaggcaggaaaagaaatctgcagaagaaagaaaatgagaatgtttgtcttcatgatgtaacattattctttgggtgtcctgatgagctattgttcctcaaggtttttaaagctttattgagttttcagaactttaagcaccattggtaataccaattggcacttgtccaatgagctgagtgaaactgatccaaaagctccagaagctgccacattccaggtatggagtatttgggggctgtaattataccattgtaattactgtctttaataggattaaaaatagaactggaataattctatggtaagttgatgtcacttattgtgacccaagtttcaattataattgttaacgatgctattgctgagtccttgtttggcttgactgccatgcagtgtttttctgatgagtgaaggagttaacaccttttggacaattttcagaattgaaagaaaattacttggtttttagtagggtttgtaattattatatccaaggttggtatcttctagaggggaactttttagaaaattaatattagactctctcccagtctattgaaaggccgtattaaatctctatcatatactcttcaatgctgtgatcatgattatattcaaacgataacccacattcttcctctttgtggtcatttgggacacaggtggcagtctcacatatgataaggaatttgaatgttagcataaaccattttagtggcaaaaaacacacaaatgctttatataaaaaaagagtcaattttaagggtatcaaatttgtctatgaagttaagctttaggtttactggcagatgcagatgtagtgactgtataatagattcatgccttagtttctaaacttacaaaatctgtttgcttagtttagtgtcagattgtcagtctgctttattgattccatcagtggtttggcttatcatatcagaaatttgagtgctgacttctggcctcaagcgatcctctggcctcagcctcccaacgtgcttagattacgggtgtgggctatgatgcccaaccctaacatttctatcttatgaaatagttgacaggtagatataatttgttactggagaagattattttttcattttgttcttttaagatccaattgttattttctgagtttattaacatagctagccttataatgagaacacagctctcacttttaccattttgcttaaagatttgcagatgtgtcgtgctcatatacttcaatgtctctgtgttttctcaggatgttacagttctgcttcttttatttcctaaaattcaataattttatctgtgttaaaaagtattttaaaatgtaatgaacacaatgttgtggctactcataatagttttagtgaatcaggaagtatgccaggggatggttgttagtagaaaaaccatttcatgtcatcttcagtaaaagataaagaagtgagcttgaattcagagagcttggtatataggatgactgacagagataggagctggggcaggaataaaaagattgagaagattgaacattaaacagaacttcagtcattagccaatgtaaacaagcaatcaaagaatagtccccttaaaataggaatcatttaattcatctaacaattaagaaaatataaacattacaaaccaatgtttttgttaatctggttctaattatttttaggttactgatgatattcttttagtataaaaatataaaatcagagccatttgcctagttttcatgtcatttttcttcatattttcagaaatcattgtcttacttgaaagttttctacttaagattccacaattaaaagaacaatgtttcctttaaggaatagtgctgcgggggcaggggcagaatttcttaaagcattttggggagtggtttaactaaataacctacatatagtagtgcacaagtttccaacttattaatagttgctttccagtgagtttttagctcctacattttttttggaagtaaatgtgatgtaattaaattaaatattctagcaactaacaacaaaaggctttttcaacagataataataaattgaactcggaaactgtaaaaagaatgaaggagaactaatagaaattgatatggaaaggtgtctaagacaaagtgaagtaaaaatatttgtataaaactatggacattggccaggcatcttggctcatgcctgtaatcacagcattttgggaagcagaggcatgcagatcgtttgagcccaggagttgaagaacaggctgggcaacatggcaaaaccctgtctctacaaaaactacaataattagttgggtgtgatagcatgtgcctatggtcccagctacttaggaggctgaggcaggaggatggattgatcccaggaggtcgaggatgcagtgagccctgatcacaccactgcatgccagcctggacaacagagtaagaccctatctcaaacaagaaaacaacaacaacaacaacaaaattgtggacacaatatgttcccatttgtgtgggttttttttttaaagaaacacacatgcatatatacacatactaatccctatgtaaatatatgcatacaaaatttacagaaggatatacacaaagctgtggaggttgattcaggaaggatgtaacaaatttactattatatagccttctgtactatagttttgttttcccatatgcatgtacccagttatatattgtccttttaatttaaacatctagtaaaaaataataatttcaatgagaccagaaattactaagcaaaggaaatggcaaggtagttctacttttttggaaaaaaaaaaaaaagaaaagatggtcattgtatttgaaacttaagacaagataataacacgtattatctggttaatgaatgcctgtcctgtcttcacaaggatttttcctgacataaaattctaaatatctgtcaaaaatatatatatatatatacttgagatggagtctcgctctgtcgcccaggctggagtgcagtggcgcggtctcggctcactgcaacctctgcctcccaggttcacgccattctcctgcctcagcctcccaaatagctgggactacaggcacccaccgccacgcccagctaattttttgtatttttagtagagacagggtttcactgtgttagccagaatggtctcgacctcctgacttcatgatccgcccaccttggcctcccaaagtgctgggattacaggtgtgagtcaccgcacctggccaaaaatattttttaattatatacactaaataacaacataatgaataatgtcttcaatatcagttcctcacacaattatttcttgcgttgaacttcaataaaattcagaatataacactaatggtataacttgataaggtattttataggaagcattatagctcacatttaccaaggcttaatgttttacaggcactcttgtaggcatattgcttgcatgatgttattaaatcttcccgacatctctatatgatctctattttacaggtaaggaacctgagggagagagaggctaagtcagttactttcccattacgctgctagtaagtggcaaagccaggatctgaagttagactaagggcccatgttctcaatgatgagacatgccttaggtatactgactgcagatgacctaacttgatatgcctgtaactcttagacaacttaagaaagatcacatttttcttactgatgattgagaaatgcagtctatctcaaatgcctttcataggagctgaatgacagtcagattggcagtggacagtctagcaagctcctacaagatagaatgggcttatgggaaacaggtcctttttaacttaaaaaatcattttcgaataggtgatacatgcatattatacacacagtgaaaattaaggctctctctcatcacaccctaagccacccacttcttttctcagaaagcaaccaccattactaggttcttatatatactaacagaaatgttttatttgtatgtggataactacacatacttcacattgttttcaaaaattgaagcatacgacatgtggtgttctatatcttcctttcccccttaaaaatacttttctcaagattctttcataatcagttataccaggaactgtgtagttatttttaatggctgaataatattccattatatagacatgtcatattgtatttaatcatttccttattagtcaccacttaggttattttcaacattttgctattgcaaatagaaaattgcatcatttcatacatcagtaggataaatatcaagaagtgaggacactgagtcaaaaggagtgtgctttaaaaatgttgatagatcctgcaaaatgaccctctttgatgatcctgcaaaacggtagtaccattattcgctcccctactagtaatatatgaaagtggtagtttccacccactgttagcaaaatggcttgaaactttttgatcttcaccatcctgatagaagaaaatggtatttattggcagatatttgcattcctcttattagtaatgaagcaaatttgttgtttatgcctttggtgtaatctctgagtccactgccaattccaagatcatgaagattcaccttatgttttcttctaggaatttaatagttttaagtcatacacttatgtctttaatctattctgagttcatttctgtccacggtgtgaggtaagggtttaatctcattcttttgtatgtgaatatggagttgttactgcaccatttattgaagccactatttttccccattaaatggcctgggcatcattgttgaaaatcagtctgttttccctaaatgtatgtgtttacttctgaaccctgaattatatttcatcaatctgtacatctattcttacgccagtactacggtttttgattactgtagctttgaagaaagttttgaaattgggaagtatgagtcccccaactctgtttttctttttaaatattgtgttggttctttggggttccttgcaattctatatgaatttgaggatgggattttccatatctgtaaataaaacaggggaattttgatagggagtgtattgcatctgtatattgatttctgaattgccattttaacaatattaagttttctagtccatgtatatgggatgtctttccatttatttagattttctttaacttctttcaattatgttttgtatttttcagtaaatgtcttgctcctccttggatagatttatttctaagtatttttgtctttttgatgctactataaatggaattattttcttaatttcatttttggattagagatgcctttttgtaatgtgtctatttgcaggggtatctctttctaatcgcacaaaaacatcttgtgctggcactggtgatctttgggagtgtaacatcagcttgaaagtgccatagaaatagggactctctatcttagtgctgagtaggcatttactaaagctgaatgaatggatgacaatttgctgagagtgagcttgggtaggagcttaagagaggcagcaaatatggattttcaagaaattcagtgatgaatggaaggccttaaaaatgaaggaaatggaatattatccaggatagactataaactaggccataaaaaaactcaatgattttgaaaggatgggggaattgtaccaagtatgttctctaactacagtaaaattaagttagaagtcaaaaacacaaagaaatttgggaaattcacaaacatgtggaaattaaacaacatactcctaaatagccaatgagtcaaataataagtcataaggaaaattactttgagataaataaaaactaaagtacaatataccaaaatttgtgggacagaactaatgaggtatgtagctgtaaaaacctatattattaaaaaaaaagaagatttcaaatcaatagcctaaccttctgccttatgaaactagggaggttggggggcggcggggggaaatagaagatactaaacacaaaacaaatagaaggaaattataaagattagcatggatattaatggaataggaaatagaaaaacattagagaaacctcattaatgaaacctcaagttggctctctgcaaggagcaacaaaattgacaaagatttagatcgagcaagaaaaaaacagagatgactcaaattactaaaattaggagtaaaagagctgatattaatataaatcagagaaatgaacaggattataaaggaatactatgaacaacaaattagatgacttacattaaatgaacaaattcctagaaagacaaaactaccaaaactgactgacacaaggagaaatagaaaaaaaaaaaaatatatatatatatatggtaaatgattatagtaatttaaaatattaccagaaagaaaagcctagagccagatggcttcaatggtgaattctaccaaacatttaaagaatgattagtaacaatccttcagaaactcttccaaaaaagtgaaaaggatggcatacttctcaattcattgtcaaaggccagtattacccaaataccaaagccagacgaggatatcacaagggaagaaaagtataaaccaatgtaatatctattatgaatatagacaaaaaataatcaacagaataccaacaaaccaaatcaagcatcatattatacattctgaaggttatctaaggaaggcaaggttcatttaatatacaaatattaattaatgcaaacactatattaacaggataaaggacaaaaagcacaatattatatcaacagaagcagaaaaagcatttgacaaaatctaacgtcatttatgacaaaaaaattagaaattaggaatagaatggtgcttcctaaactagagtaagggcatctacaaaaaaacgatgtataatatcatatttaattgtgaaagactcaatgcattttctccaaattcaggaataaaacgatatctgctctcacaacttctatttaatattgtactgaaagttctaaccagggcaattaggcaagaaaaaaaggcacctgaattggaagggaaaaaacaaaaccacctttatttacagaaaacatgtacttatatagagaaaatgttaagaaatccatttaacaatgaatagaatttattaatgagtccagcaaggttgtaagatacaagaacagtattcaaaaatcaattttatttctgtatactagcaatggcaatctaaaaaaaatctattcacaatatcaacaaaaaataaaacacttattaatgtatgtcacaaaaaagtacaagatttatacaatgaaaagcacaaaacattgctgaaagcaactgaagatctacctaaatggaaagacatccttttgtttatagaagatatagcaatacttcccatattgatctactgatttaatgcaatccctatcaaaattacaactgacttttttctttgaagaaattgacaaggtaatcctaaaattcatatggaatgaaaaggattcaaaatagccaaaacaatcttcaaaatgaagaacaaaatgggaagactcacactttccaatttcaaaacttactacaaagctacagtaatcgagatagcatggtattggcatgggtttaggaatagaattgagagtccagaaataaaaccttgtatttaaggtcaattaatttttgataaagatgcaaagacaatgggggaaaaatcatcttttcaataaatggtgctggaacaactggatagccacacataaaagaatgaatttggaccacttcctcacatcaaacctgaaaattaacccaacatagatcaaagacctatataagatcaaagatctatattagacctatattagatcaaagtcctatgttagatcaaagacctaatataagagctaaataaaataaaactcatagaaaaaacataatagttaatcttcgaactttggattagtcagtgatttcttagatacaatgcaaagcacggatgtgataaaaatattgataaatttggacttcatcaaaattaaacctttttgtacattgaaagccaccattttgacccagcagtttcacttctatgtatatatgtgaaatgaaaacaggtcaacaaaaaaacttaattacctagatgttcctacattattcacaatagctgcaaggtatgaacaatccaaatatccatcaatggatgaacggatcaataaaatgtggtatatcttatacaaagtaatgttatttggtggtaagaaggaatgaagtaccaatacatgttacaacatgaagaagcctcagaaacattaagtgaaagaagccagaccccaaagaccaagcattatatgaaatgtctataaaaggcaaatccaccgaggcagaaatagactagtggttgcctagggctgcaagtgtgactggggagtgactacagatggtaaaaagtttctttttgtggtgatggaaatgctcaggttcaaagattacattttgatgatggctttataaccctgaattgttatcaggtgaactatataattttaacacgtgaattttacagtacttaaattacatatgaataaagttttttttttttaatgaggcaaaaggtagcgtgaaaaagcaggcatggcatataagcaagctttttttaaggctgagtgacttatgtggctgatagaggaaggataagaggaaaggaaatatagtgaaaaggaacagagaggaataataaagctggcaagtcacagacaacataattagactatcaaaagaaaatctggaagaaaggcatggacaggaataaagacctccttctaaagcaaggtagggagagcaacttgatgtagattgaagagaaaaaggaaagaaaaatgaatgttcatatttgatggcctatgattttctgggtcatgtagaaggcaaagtaacatgttcaagtgatgaatttggtaactttaggataatgatgacagttcagacaacaaatacagagaataaaagagaacactgactatatgaatagaaggattttagagacattacgactcagccgagtttaaatcaaagattgtaaggcattcagtcatcaaggttatacatttttctccagcagctctagccttctatgaaatagaagcagaaaaaaaacccaaaacagatgggttaactacctgtaaatctggatttgaactggtagaatgaagcttcctgcaaatgttggatgtaaaagtgcagatctaatcaggtaaaatctcaagcattaattggatatgcttataacaaaccggtaaatttttagaagatgtaaaacatatcttagaaaaataatttaaattattaatgagaattagactaagtcattgaaatttgatttttaaaacttaccgagcctctctttcattgaactcagaagtagtgtgaatggtaagtcttccttgtcaaatggaatgctacttagcagctgtcttagctcgttccagatgctataataaagcaccatagactgactgactggtttataaacacacatttatttctcacagttctggaggctagaagtccaagatcagggtgccagcatagttggtttctggtgaggaccttcttctggtttgcaaactgatgtatttttgtatcctcctgtggcagaaagatggagacagctctctgggtcccttttttataagggcactaatcgcattcatgcggcctctatgctatgaattacctcccaaaggccccatctcctaataccatcacattggggttaggattttaacaaatgaatttaagggaaagcacaaacattccgtccactgcaacatctacaaaataggtccttaggaagtgcagaagtctggaacagttctttcccaagccacaaccctgaaaacatggattgctgggtatgcagattctcctgggtccctttcccataaacaccgaattagacactctgaggatgcagcccagacattctgtatttttcaccaggcataatggtgatggctgatattagaatggtgaaatttatcccacctagtaagaatctaaactgaaaatggtgatgatgcaaaaaagatctgtcaaccagttaaaaaaaaaaaaaaaaaaagagggtgtgtgtttgtcaggagggatagtctttagtagtatggccaaaagcttaagcctgattttcagggctctattgttggagtgggtagttcatcaacttcctaagtaattcaaatctttttccccccaatatattaatatattggtgattccaagaaagagggtttaatttatttaatgcctgggaaaactaaaagaactacaaacagatgtgaaaggaagagaataaccacatctcacaggaagcaaaatttctgtcaaaagttactgttctttccctgtctaggttctttgtccctgaaaggtagatccgcaaactaaatccctcaataacgttgcctaaacaggactgggatcatagaatgtccaacactaacatgagttcataatggcacaacgaacttaaaatgttactattcatgttttaattatgattgcagtcttacgttgaaggtatctccgccgtccttaaacataaaaaaaaaaaaaggaaatacaagctgcaaaagttttatgtaatgcactccaccctcttttttccccaagccaacacacacccttcaaactttttgacagttattttcagacccctcctaggctcccgaactccatgcaactccagcagtctcccctgggccatttttagcctctgctctgacctggcgggaggctgggtgtccaccctttcccctgcagtcctgaaagtccggtccgagcgcggacggggcggggaggggctgggcgggccaggccagctccattggcgccaggcgggtgggggaatgcgctgagaggacccgtccagcttgcttaaaagccatcagttttctgaccccgcatcggttccaggaagaatacacctatgtgacaagctaagttctgcctcattttgcatttagaagccacaagaaaaacttttcgaaaacttttgtccgtcttttgctcccccgacgcgtggtttcctgatggtccgtccccgggcagagagagggacgccccctcctcctccccgcctcttgtgaggcgcgcggagccgcctcccctgggtcaggtctgatgggccggtgggcgcgctagtggtggccgccaccgccgaaaccgtcgacctcctgggccccagttccgcgtccagccccgcggcagcatggactacctgacgacgttcaccgagaagagtgggcgccttctgcggggcacggccaaccgcctgttggggttcgggggcggcggcgaagcccggcaggtgcgcttcgaagattacctgagggagccagcccagggggacctcgggtgcgggtccccgccccaccggcccccggcgccgtccagcccggagggacctggtgagcccacctttctttcgcctcccgcgcggccgacctgggctgagggctgtggggaggcggcggtcgtggcgccgggcgggggtcgctgcccggctctggcaggtgtgcctgggccggggcgggcaacgtggccggggtggcggccgccgggggcgaggaaggaaggactcgttcggctctggggagggaagactttcagctgcgtgccagctcttcctgctctgctcttcctgctttcctcacctagacttgattttctttccccgccaagtatttcaaggggacgatccattctctctttccctcccactgggaggtgaagactgaaccagttatgacgtccgtgttttcagtcttggattcttgaagagcgctgtgcctgctttggttttggtttgggtcagtctttccttaatatttctcagttgttaggattcacttcctaaccgaaaaataaaaagccagatacttctttgtaaaataaaacacttcattaacattggaagctagttgacattttgcgtcgtgtactttttgaacggctgcacgttgtcttgtggtggcagaacctagaaactttctcagttcctgtttattttgtgttgtgttggccgatttttttcaccacagtggctttgtaccattctttaaaacagtcatttgtagcgacatgatattgataacttaaagaatttttgaaagtgctgctgaacagttttagcataatgcatagggtaacttccagtgtccttggcttcgtttaacaggtagcagacatcctagccatgtctgatttttatttttgttaattgctttaatatttgagggttatgaaaataaatgagcattagagagtttagaaaatagagataggcacaaagtgtgtaaaatctgtttataactccacatcgtgccagtcattttattttaaattttatcttactttatttttgtagagatggagtctcgctgtgttgcccaggctggtcttaactcttggcctcaagtgatcctcctgcctaggccttcccaagtgctgggattacaggcctgaaccaccatgctgggccctgccagttgttttaaagcagtaaaacagtgaggacatttttgatctatgtgtgtaggtatgtaatttaagctttgaagaaatattaaagtctcattttagcatagccctttaaaataaattttccttactttacataaaatattttttatctttagaaatgctgtttatggaattaggaaatgaaaaggggaggggaatacttttgtttctgctctgaaggacgttaaccaaatgcagaatcctcttaaaggtgggaccaggcataggaaagggactttaaagtgttcaaatcaaggactttttaaaatgagttttcagtagcctaattgaaaacagttgatgtgtgaccagccttgaaatgggtggagaattcagaaatatgtggggtaacttaactaaaaaggaatatggttagtattttaataaatatggccaaacacgtgtatctgattcattcggtggcccgtgtctgtagttccagctactctgctcaggaggctggggcgggaagatcctttgagcccaggaggagaatccagactgggcagcagagagacacttatgtgtttatatatgtggagcacacagctatatctgacaccctccttcaaagtggcgcttctgaagtgatatgtattcctcttctgttgaagctgccttatgtattcattgcatattctttaatagtcatggtgcccccaaatctctgacacattagagaggcgttgtgaggtcaaagtatgaccacagtcatgtgggcaggtacgtcctagcattaacttcctgaaagaatttggacaagttacttagtgtctttgggcctatattttcttctttgtaaatgaggttggatttggtgatttcaaaattctctattctagagcattttcatttggagcagaattagtgaaaactagctgacttttgagaggcaacgtgtatatacacaagtgaaaaataaatgattcttcatatgtttccagctagcctttgtttaaaatgagaattctgtgctttgcagctgcttctcagatggattttggctctagggttgttctttgtgtttgtgtcctttagaatgagtgtctgtcagtctgtttgaaggatttcttctgctctttctactcttatttcagtttcttaatagctgcttaagtttcctgctatcattctttcttcagttctttaagaagccctgtgtattataggagtatttcttgttacagatactttcacacatgtaaattgactgcattccaggaaaccctttgttgttagtgatcttattcctcctttcatccactaagatgaaaaagtagaaccttgtttctgttccttctcacaacccaacatcggaggagttacgcatcaagaaggggtggagggagtcatgttcagcaatgatgttgataagatagtttcaccattgacagattaaggatagaccagataaaattttggtcaaatgtcagccagttgcggtggctcacgtcggtaatcccagcactttgggaggccgagacgggcggatcacctgaggtcaggagttcgagaccagcctagccaacacggtgaaaccctgtctctactaaaaatacaaaaattagctgggcgtggtggtgcgtgcctgtaatcccagctacccgggaggctgaggcaggagaatcgcttaaacccaggaggcaaggttgcagtgagatcgccctactgcactccagcctgggccacagaacgagactccatctcaaaaataaaacaaaaacaaaaattagccaggcatggtggcacactcctggaatcccagctactcaggagactgaggcaggagaattgcttgaacctgggaggtggaagttgccatgagccaagatcacaccactgcactccagcctgggtgacagagtaagattccatctcaaacaaacaaaccaaaaccaaaaaaaactttggtcaatgtttctgagtttaccctttctataaagaaaccacttactgaactgttaatgtctctccttcctttactcctctccaaggtggctgcttttgctcttaccagcttttagtgcttgctggctccatcattatagccctctcaggaaaaccataattgagacttagacatattaaggacattatcacaccattgatctagttaataacaattacaaaggaaacatcttaaaatacaatgcttgttcctgattaacgggtacattatgctttgattttaaaaaattgttttgaactttaaatatagctcttgtttgggggcataactataactcataatgtataatctttaaaagtactcacttcactagattatattgtaataaatatagataaattttactagtgtagactctcaacttactgtcgtataaacatgaaatcgtttttatcataagcgtcctattatatcaacctcattttcccacttggtgacaggattctttgagcacaactcagcccttttacattttcttttcatttatttttagcaattaaaactatctttcagttatttaagacttggtccatttatttaaaaatttcagtctcatattcaatttatatctccatttacctttctacctcagttcccattccaagttaggttggtagcggagaagaggtgtggtctagctctcacaaactcccctccaccccttcttgatgcattaactcctctgatgttgggatgtgggaaggaatagaagcaggggtccactttttcattttagtcctttttggccccttagtgggaggatgacaatggtggatagcagtagtagcagcagtgatggaacagttctgctaaaatggctactcctatgcagaagtgctgacttcagtagccaacagttctttcaactttgaatctgggacattaacatctggtaataccaaccatagaccttagttgcaaattgttgtactaggcacctaaaactgctctgcctcatagcatatatgttactggtatgtgtgtgtatatcaatagagttgatgaaaaatgaagttaagtgggaatgtattacatttttatgacttgaattatttgacatgtcaaggaaaaactatttaataataatatttttttaaatgattatccctgttgctgaagtttcattttaggtttacattaagcaaatcctatgtactgaatgtatgtaactgaaggagaagcgtttagaagcctgagattgatattcttgttactggttcacttttgataatcatggaaaatgtaaaccaagacatggaataataattataatagacaaaacatatagtgcttgctgtgtcttacgcacaagttaaccctcagcaacaaccctatgaggtaattaatagtagcattttcattttactggtgagggtactgaggttcattaatgatcctgtctagttgggaaaatagacattggacaaagaatttataactgtgttggttattgggcatggaatgtaaaatatattatgggagtatataagaagggtttctaacctaatattggggggtgtaaaatatcatgttttgcttggattgggggtaatgtctatttcagtaaatgggatgatgatgatgatgatgatgatgatgatgatgatgatacttgtagtaataacagaagtagtaatacaggttgagcatcccaaatcagaaagtccaaaatctgaaactttttgagggcctacatgatgctcaaaggaaatgctctttggagcattttggatgtttggatttgggatgctcaatcagtaatgcacatattccaaatccatcctatcctttaggaagattcaaaaaaatccaaaacactcctgttcccaagcatttcagataagtggtactcagcctatagcaagaatgatagctgtaatggggcaggctctgagcaaaagttttttatttaatcctaataaaaacctgatgacatagtactattattatcctattttccttttgaaaaatctgagccaaagaaagaagtgagaaattcagaatttatttgggtgttttcttagtatttgcaagagttacagtccttgagataggggaaaaatgtgagaagaattaaaattctatcatgtaaggtattaaagttaaattagttaagattgtaaaggatagaatggattgtcattgaaggttctttagagttagaaagatagtaaaatgacagagctggaaatgcaaaatccaatgagggtgtgagaaaaattaggtatatattaggttggaaattgccacctcagatgatgtgttaagagttagatgatggtttatcttgaacccaggaggaccaagtgcctctaaggcaggggtccccagccctggtccatggcctgttaggaaccaggatgcacagcgggaggtaagcagcaagcgagccagcattactgcctgagctctgcctcctgttagatcagtggggacattagattctcataggagtgtgaactttattgtgaactgcacatgcaaggtctaatccctgatgatctgaggtggaacagtttcattgagaagccatctctctccccatcccccaccccttgcccacatgtccataatccatagtcttccatgaagcctgtctctggtgccgtaaaggttggggaccactgctttaagagacctggagtgtaccagttgttacagtaactttttaaaacaaccaccaccaccacaaaacaaaaaactcacagtgttggtagaagataaccctagctggccccagttttagtctcttttcctaaagccggatgggaggaagagaatactctctacttgatcggcaacctcagtgggctctagtggtaactcccaactagttagcctttcttaatagtgtatcatttagttcagtggttctcaggcatgaggttgatttgcctgttttagaattgctgcttgtctcacaggatagctgataggaagttctgtattatctatgttgtagaacaaaactgcctctaaaataagctgatgattctcaaacttcagcatgcaacagaatcatctcctgaagggcttgttagaaaaatattgttgaatacctctcctagaatttgtgattctgtgtggctgagaatttgcatttctaacaagttcttaagtaatgctgatgctgctggtctggcaaccacacttttcttagtgggtaagtcttttatccatgggaaggttagaagtaaatatagaaatgatgaaatttattaaatgcttatattaatagttttgttttaagtctaggaataatcagtgtatttggtctttaaggtatttgttctgtttcatagaattaggcctataaaagtggccaacaaattagtcttaagagtataatttaaaatgcatacttgcgtaattgttttttgacttgggattttaagttgaaaggtgcaacaatttggctaaacttagaaaccactggaatgtttaagaacttaacatttattatatttaaaacttagtatagggtttttaatatttttctcaggaggtttacttgttagaagcaatgtgtttaaaatagaatatagtaaatttataaatgcagtttagtatagtaagtcctcctttgacatcatcaataggtttgtggaagttgcaccttttaagcaaaatgatgtgtaaagaaaccaattttaccataagctaattgatgtaaacaagagttaggttcctaccatatatttctggtcacaaaaacattagcaaacttgtaagtaaagacctaaaatacttccattattaaacattgaaataaatgtgaactatgcaaacattaaagaaagattaataaagacaagagaattatttactcagttattccagtcagagtcactgttggctggatcctgtcctgctcatggcacaaggtgggaaccagccctagacgggacaccattccacctcagggcacagtcacacacacacacacgcacacaaacacacacattcatactaggacagtttaaacacactaattaagctaatgtgcacatctttggatgtgggagggaactggagtacctggagaaaacctatacagatgtgggtagaatgtgtaaactccacacagacagtggccttgtctgggaattgattttttgttcttatcaaagttataacaaaacaatgataacaaaacgatgttattcaaggacctgtaatatatgtaagagaacttagttacccatgtttataacaggattatttagggatatttaattttccagtttgagttggtcagctatttaaagcaccttagaaagtgttaaaatttgctagattataaatagaatgcactttttatggtagaagacaagggaaagtaggtttttatatttttaacttcaagaaatctaacattaaaagtaaagtgactgcagatagtgtttttctgtgtgtgaaggcttatttcatggccactaggaaacttacattaggagactctttataaatgttgttcaataggtgatactagtacaaaaaggaatgtgttttagggtcaaatacatacattagagaaaggacaaaaattggcttttattttctagcagtaaatggaaagaaggaaatgtaatcagccataaatcacagtgtccctaggataaagataaacctgttgcttaggcagccaggagaaacacagttattccttatagtgagaatataacaaaaaaaaaactcatggaactctgtaataaagcaaaacaaaccaaaaagcttatttttatggtaagtacagacttcagtttcaaaaatctatttttaatttttttaaacccattaaatctttaatgtagttcaatggtgtagctctaaactgcaagttagtaaaagcacttctgtacaaggggaaaacaattaatccaaatatgcagttatctaacagtccatcttaactgagaggtaggttttacattttaaactatagattttagatagttacgactctctgttttggatttttttgagagtactactcaatagaattttttgaggtgatgaaaatggtctgtatctgtgatggccagtatggtagccactaggcaaatatggctattgagtatctgaattgcagctaatgcaaatgaggaactggattgagaaaattggattcaggattctgtatttgctctatctaatatggtagcaactagtgttaaaggaaaaattatttgataatacttcctaaagcacaataagacagactttattcaggaccattgcaatagggatagggactgtggcaatgagattttgtagttgaggagagagattgggctcaactccaaatacaaaatgggcaagtgggaatttctagccaaggagtagagtaaggatagatggatggacaattgctaagaggtaacgtcaggaataaggggtattatggtgaaactgacctaccaggattcttgctgaaggcaggccagagtaatcagacttcacctggacagtggaggatgagaaaactgatcagatacggaaggtaatcagatatccaggatcggggtgggggttcctgctacactgaccttaacatgattcttgctgaaactcggttttataaggaagtgaacagattggcataggagaaggttcagcagcctgactaaaatttggctatgcaaataatctttgtgactaggcacatgtagctattttaatgtaaattaatttaattaagtaaaactttaaattcagttttcagtctcactagagacatttcaagtactcacaagacagatggctagtggctaccatattatacaaggcagatataaaacatttttaccattgcagaaagttttattgggcagcattgatagcaatgagtcccaatgcagggtacacattagaattccctgggtagccatgaaaaaattttgatgccaagatctgattataatcaaagatttgatcttgaaatctctgtttaagatctccacttacagtttcttacggaattctaatatgtaactagggttaaaaaccactgacttaggatgtgaaggactctacatcattctgttttccttaatgatatttctctcaatcaaactcttgctgaatttagcaggttattatttatttatttttctttacaagtacttggggcatgcacctattttatgatgcaagttaataaaagaaatgcatgtttaagttttctgccaacctctggatagtattgagaccttaggaaagttgaggtgacttacaatgaaaagttcctaaaaggaagacatgtttgtatgctgagagaaagatgctgaagataaaatgactgtgtggcaaggtccttgtggaataaataaactactggaattatgatcattcttttttcacatgccacaattaagagccattaatattgtggaatatttgcttccagtcttttatacgaaattaatttttaaaataaacctgatatatactatatataaataagtcatatgttgcaaatactgaactttaaaaatcacctctaatccagtcacccagagatactgttaatatttgggtaggcattactgccaagtaatgtacatcacttctatgtgtatgtacatatagaaggatggatgggtggttagaaggagggagtgacagaatgaaagataatacttattcaccacaagaggttaattcctaaggggtgtgtctaaatttaagcaaattctaaaaaaaaaaaaaagaaaaaaaattacagatactgttattacaatcttgtttcagttttaggtgggatatatttaaccatgctttggtatgacattagcagtttcatttctcatttttctcctcctcacatcctaatatttactcattttactatttttacattgtccatgtttgtaacattcatacttagtttttcaaccacttttttataacttattattgttctatattctctagtaaccttttagaatgtcctccttgattctggagtttttgatacaattggcataatttcagtcttatagcactgagtaatgtttcagtagagaagtctcatgcaagccagccagattcttttccatttcccctagtagatgatttgctttttatgcatgaattgttgaataattttttaagctcccaagcataataatttaactaagagtagaaatgggaatagcctgactcatgtgcccacatgtgtctatgtggaataatcttttaggaattacacctttcttctggaatacatgttgatggagcagccactatatggaagatctctggttttgagatagaaaagagagctaagaagtacaattttggctccaaacacttccacctggaagacatatatggttcattgggcaaagcaagttggccatgtctgacatcaataggatggtgaggtatattttatattcctcaacaggaaggaatacaggcttagtaacaataatatagtctatcaccatgactaatttagaaaccattatattagtttgacagatttgaaaactgctggtgttaactgtcacaaatatgaagttatgtagggaagcccatttcttctgtcacttacgcagtctgcaggtctttgatctcttcagaagctctatttgtatgtctctcaaatgtgttgtgcgtgcaaatcaatagtaaatctgtaggtccggactgagcctcagatcttacattcacagtaagcttctgggtgatgtcaatgcagctggtccctggaacacacttttaaatagcaaggctctatagctctttaatatcatggatcttttcacttagaagagagccaactttaaggtctagatggaggaaaaggggcagtaaaaaggaacattaatgggtatgagaccaagaggagtgtgaaatactttcaaataaagggaaagaggaacatgcagaagaagtctcttggatgtttcacagagatcagataaaaaaaaagtggaaaagcccatcaaatttgccatttaatttattcattttagggtggggattgtgaactggggaagagaagatattacaatacattgtggattctgtaggagataatggagtaaagacagtaaaagtagatttctactttcaaaaattcaactgaaaagaagcagaaagatggagtagtatctagaaaaagatagatactagatttgagggaaaattgaggggttttgttttgtttttgttttgatcgtggataaggagtcaatagtgaaatgttgaaaatacaggtttttttccctagtatctcattattgagagaattattagaaaagctacaatcagcaatctgttttttttttagtttagaagatacttttaaagtgtttgaagttttagtatctatattactgtttttgaaaatactgacttgcagctcaatgttttaaatagtcaaactttttatacatagctattatcaatattgtaatattcagttattataggagtcttttattacattaaacctgatctcatagtacgttcattgatgatttccagactttctacagcatacctttccatttctttaccaaaatgatttttttaaaggttttatactgctctgttaattctctgcttgaaagtccttcaggagttctgagtctagtaatagcaagctaggtaattcagactatcctgctgagaacaatttaaaaagctggacacaaagcaaacattttattaagggtatcagaaagctaagtggtatgggtaggataggatctgaatgaggacaaaggtctaaggagggagaactccaatttgattgctttttaccccaggggtagtgttgattcctgaaacaggaactgagagaccaaaaggtgcatttgacaggctgtgggtataatggaaccgggccagagtgcaaggcctgtcacaggggatgggtggccctagtgatctcttctcactttggaccccaaaatgttgtacattagggagaaagataaactgaagtagctaggcctccctaggaagatacttcaacttcaaattatcaaaatttctgtaacttaattaataagatctggtattactagtgtcctcaggcacttgacagaagcaaacattaattctttctggagaattaccagtttctacatgtaaaaatgttttgtcagacgattttgcaaattttatgttctgcacacaaaataggcacatgacaagatatgtgacacaatagagaatagaaacaggcccacggtaactctagatattctagttatcagatttaaaatagctatgttgagaattttgacctgattaagaattttgtagaaagttacaaactatgagaaagaaaaatggatattctagaagtgaaaaatacaacccctctaattaggacctttgtagatggatttagcagcaaattagacaccgcagaggaaagaattccctaactgaaaggtaagtcaaaagggaatgttcagagtaaacaggaaagaggaaaatataggagaaggtaagttcaatacaagatacagtgagaagttctaatatgtatgtacatatacatatgaatcctgaaagtagatgagagatagaatgggcaaaagcattatttaaagagagaatggctggccaacatggggaaaccctgtctctactaaaaatataaaaatcaggcgtggtggtgcgtgcctgtagtcccagctatttgggaggctgaggcacaagaattgcttgaacctggcaggcagaggttatagtgagccaaaattgcacctctgcactccagcctgggtgacagagtgagactctgtctcaaaaaaaaaaaaaaaaaaagaatggctgaaaacgtccaaactaaagaaaaactttaattcagattcaagcatccctatcaacctctagtggaaaccacaccaaaggcaaaaaaaaaaaaaaggaaaaaatagtgtttctaccttcaatcatacagcattaagatggacattgatttctcaacagacacagtaaaaactaaaaaactgggaacctatagatttaaaatgttaaaagaaagtacctgccacctagaattctgtgacctgtgaaatttcccagagatacaataataatcataaatatgagagcaaaactaaatcaaccttgactatcttaaaaataatgttttttaaatacgcatgtattcagcgtgtaaaactgtttcatatatcttggcagtggcagacagtttttaacatccttgcattgtctgggaagaggataaaagtaccagttaatattaggctgtgagcatatgtttattgcagcactattcacaatagcaaagacttggaaccaacccgaatgtccatcagtgatagactggattaagaaaatgtggcacatatacaccgtggaatattatgcagccataaaaaatgatgagttcatgtcctttgcagggacatggatgaagctggaaaccatcattctcagcaaactatcacaaggacagaaaaccaaacactgcatgttctcactcataggtgggaattgaagaacgagaacacttggacacaggaaggggaacatcacacaccagggcctgtcgtggggtggggggaggggggagggatagcattaggagatatacctaattgtaaatgacgagttaatgagtgcagcacaccaacatggcacatggatacatatgtaacaaacctgcatgttgtgcacatgtaccctagaacttaaagtataataataataataataataataataataataataataataaaaggctgtgaggagtcagtaattcagactttttatctctgggatgaccactaaaagaattgtttaaaaaaatgtgtaactttcagatatgtggggaaaaaccggagttaataaatactgaatccaaggaaggcaacaaaggagagaagtctaaaagaacaggtagacagatagaaaatagaacaaatagtgctgggcacagtggctcatgcctgtaattccaacactttgggaggccaaagtgagtggatcgcttgaggtcaggagtttgagaccagcctgaccaatatagtgaaactctgtctctactaaaaatgaaaaaaaaaaaaaaattagctggggttggtggcgtgtgcctgtagtcccagctactcaggaggcgaaggcaggagaattgcttcaacctgggaggttggggttgcagtgagccaagatcgtgccactgtactccagcctgggcaacaaagtgagactccatcaaagaaagaaagaaagagagagaaagaaagaaagagagagagagagagaaaagaaaaagaaaagaaagagagaaaggaaggaagggaaagaaagaagaaataaacaaaaaggacctgcttagatacacaccagaaacataacgtcatatggttaggctttgtgtccccactcaaatctcatcttggattataatcccgataatccccacatatcaagggagaaaccaggtggagggaattggatcatgggggcagtttcccccatgctgttcttcttgtgatagtgaggtctcatgagttctgatggttttataagtgtttgataattcctcctgcctttattctccctcctgccaccttgtaaagaaggtgccttgcttccccctttgctttctgctatgattgtaaatttcctgaggcctctccacccatgcagaactgtgagttagttaaacctctttcctttctaaattacccagtcttgggcaattctttatagcagtgtgagaacagactaatacagtaaattggaactacaaagtggggtactgctataaagatacccaaaaatgtggaagcgactttggaactgggtaacaggcagaggttggaacagtttggagggctcagaagaagacaggaagatgtgggaaagtttggaacttcctagaaacttgtcgaatggctttgaccaaaatgctgatagtgataatggtaaatgaagtccaggctgaggtggtctcagatggagatgaggaatttgttgggaactggaataaagttggctcttgctatgctttacaaagagactggtagcattttgcccctgccctagagatatatagaacgtgagagagatgaaatagggtatctagcagaagaaatttctaagcagcaaagtgttcaagaggtgacctgggtgaccgtaaaatcagtcagttttatggattcacaaagagatggtttggatttgaagcttatgtttaaatgggaagcagagctaaaaagtttggacaacttgcagcctgacaatgcaatagaaaagaaaaacctgtttctgaggagaaattcaagccagctgcagatacttacttaagtaacgaggagacaaatgttaatcaccaagacaatgggtaaaatgtttccagggcatgtcagagaccttcgtggttgcccttcccatcacaggcctggagacttaggaagaaaaaaatggtttcatgggccagacccagggccttgctgttctgtgcagtttcaggacacagtgccctgaatcccagctgtggctaaaaagggccaacatacagcccaggccatttatttagaggatacaagtcctaagccttggcggtttacgtgcggtggtgtgcctgtgggtgcccagaactcatgaattgaggtttgggaacctctgtctagatttcagaggatgtatgcaaacacctggatgtccagacagaagtttgctgtaggggtggagccctcttggagaacctttgctagggcagtgcagaagtgaaatgtggggtcagagcccccacctagagtctctactggggccctgcccagtggagctgtgagaagaggcctaccttcctccagacctcagaatggtaaatccactgacagcttgcactgtgcacctggaaaagttgtaggcactcaatgccagctagcgaaagcagctgggagaggggctgtaccctgccaagccacaggggtggaactgctcaaggccatgggagctcacctcttgcatcagtgtgacctggatgtgagacatggagtcaaaggagattattttgaaactttaagatttaatgactgccctgccagattttggacttgcgtgggacctgtagtccctttggtttgcctaatttctaccatttggaacagagacatttacccaatgtctgtacccacattgtgtcttggaagtaactaacttgcttttgattttacaggcttataggcagaaggaacttgccttgtctcgggtaagactttggacttggattttagggttaatgctggagtgaattaagactttgggagactgttgggaaggcatgattggctttgaaatgtgaaagggacatgaaatttgggaggggccaggggcagaatgatatggtttggctttgtgtccccacccaaatctcatcttgaaatattatccccatactctccctgagttaagggagaaaccaggtggaggtaattggatcatgggggtggtttccctaatgctgttcttgtgatagtgagttctcatgagatgtgatggttttataagtgtttggtagttcctcctgagttcattcttcctcatgctgccttgtgaaaaaggtgcctggttcccctttgccttccgctatgacttaagctgaggcctccccagccatgtggaactgtcagtcaattaaacctctttcctttctaaattatccagtcttgagcagttctttatagcagtgtgagaacagactaatacataaggatacagaaatgttgagagtagaaagaaaaagcagaaactaatgaaaagagaattggtacattaatattagacaaagaatactttatggaaacagtattctgagaaaaagtttaattttccaggaagatataattttcgatttgtatgagcctaataacatggtcccaatgtataaaaagcaaagtagggagacctactgggaaccaaataacccataatttagagtgagagatattaacaacctccattggtaacagaataatcagacaaaaacaaatcaatacaaatatacagaatttgactaacacagtccacaaacttgacctcatggatatgtaaatacatgtgtgtgcatgtatgcatacacatatataaaacactaaaccctgcagtgcagagtatacattattttcaagcatatatggggcatttacaaaatttatacatcttataagtttccctcttaacactatcttagctgtgtcccagagattctggtatgttatatctttgttcttattagttgcaaagaacttcttgatttctgccttaatttcattatttacccaaaagtcattcaggagcagattattcagtttccatgtaattgtatagttttgagtgaatttcttagtctaatttttctaatttgattttgctgtggtccaagagactgtttgctatgattttagtccttttgcatttgttgaggagtgttttacttctgaatacgtgatcagttttagagtatgtgccatgtgacaatgtatattctgttgtttttgggtggagagttctgtagagattaggtccatttgctccagtgctgagttctggtcttaaatatctttgttaattttctgtctcagtgatctgtctaatattgtcagtggggtgttaaagtctctgagtattatcgtttgggagtataagtctctttgtaggtctctaagaacttgctttatgaatctgagtgctcctgtgttgtgtgcatatatatatctaggatagttagatcttacgaattgaaccctttagcattatgtaatgcccttctttgtcttttttgatctttgttggtttaaagtcttagtttaaaactagatttaaatcctagttttgtcagaaactagaattgcaacctctgcttttttctgttttccatttgattggcggatttttctgcgtacctttattttgagcctatgtctgtcattgcatgtgagatggatctcttgaaggcagcatatcaatgttcttggtgtcttatccagcttgccactccgtcttttcattgggacatttagcccacttacatttaaggttagtattgttatgtgtggattttatcctgtcatgatgttagctggttattttgcaggcttgtgtatgtgatggttttataatgtccctggtctgtgtacttcattgtgtttttgtagtgtctggtaatggtctttcctttccatattttagggttcttttaaggcagttctgatgctaaccagtactcttggcatttgctcttatggaaaggatcttatttctccttcccttatatagcttagtttggccagatgtgaaattctgggttggaattttttttaagaatgatgaatattggccctcaatctcttctggcttgtagggtttcagctgagaggtctgctgttagtctgatggacttccctttgtaggtgacctggcctttttctctagctgctctcaaatgttgtgattatttgattgtactttcatattgatggaagaaaacaaatagtttattttatgtgctttggtatttagatctgtgaataaacattttaatattaattattaaaatttagaactgtttttataatatgtaattattgcataatattttataatttttaattagtaaagagaatattttccatttgtttttcaaactttaaagtgtagaaagttagtacattagttttcttgccctgaactgcattctgtggtgagcttttgaaaattacagagcaattgcaaacttgcaaacatgtttaatgaattattgggatattatgaaacacagatcgaaaagctattaggcaaagtaaatacaaactaacggttactcctaaaatcaattaaggaagggtatattattagttaaaggtaatctgtaattgtatattgcattgcttgagaagtttaaattgcaagtttaatttgctattcaaagaaatcatttaaaaattatttaaaacataaattattcaaaaataaatcgaattttattttaatacattttcagttgtttaaaataaaaataaattctttaaaacttattttatcttaaaatagttttaatgtttgcattttctcattagagaagcaaatttaaatataaactattcagtgtagaagaattagaatactttgataagcaaaaataatattctttataaaaattctaccatattgcattgccaccaggaatgcagaagaatatctcatttcctactgtcaaacagtatgtgaccaaacttcttttgagtttttaccaacccgataggtgtgaaatgatatttcagtatagtttaaatttgcatttatctaattatgagtgagattgaacaacattattacatgtttaaggacatttttacatcctcttgtgaattgtctgattatatcttttgtgcatattttcacctgcattattttttccctagtttttaagagttctttaaatatttaggatacaaaagtagaatatgtgtatgtatgcgcacgcgtgtgtgtgtgtgtgtatctctgcatactatttttcctagagttgtaatggatgaaccataattctttctctacttttctttatggaaaattaatggcagttcataatagttttggtagttcaaagtatagttcaagttgttgcttcagaacattactttattagatgcttgccatgtgtcaggcccctagttaggcactgaggaggctttgtggaagaaaggcaatgttttggaggttacaatttagtggaagggatttaaacccaaatattaacttaacactgtgtcagatgctgtgaaggagacataaagatgctatgtgactaataacagggacttgggttagctgggtgatcaggaaggttttaggatagttttttaaagcattgcagaggtaattgtcctttttggggattttgatattattattattttttagtgcttgtttagaaccattcacccgacagctgagatgattaggtcaacataaactcttgtatggtcaaaatgccatttaagtttagatagagggagaacaatgaaatagatattttctagattatatggtcttaggttgaaccataaattttctttgaaaactatagtttttaattttggtaaattttgagggtaaagtaaatgtagcattttgccatgtttactatcttatttaattttgtgatttatttagttttttagatttcattttaataatttttatgtttaggtaggagtggtgttttattaattcagtgttgttattacatgaagtatagatgaaaaggttaacactaatacaaaatttaaagggaagcagtttcgctaatcttgatgataatgaaacattcaaggaagtcttgataagcaaatgaaaaatattaataattggcattcaatctgaaagtaaatgttcaaatgtatgtttctatatgaaagcacaccttgatttacttcatggcatgttaatatgaaagttcataatttaatcccatagagaagactatttttcattatgacttgtagaaaaattttttcctgtgagaactaatgttacaatttcttatttggaaaataatgatatatatcttgaaagatgtattttaaaaatatataatgtatcttaaaatgtgttggtattataatcaggttaaatctgttgaaataaattgtaatttagtttttaatgacttcctttctgttgacaattatgttttgcgttgacttgcaattattctattggttcatactagttaagttcctaaagcaagcaagtaggaagttcagttccttttttttgacagttgcttgatttttacagcagagcatcccagggagtaagctgtattactagtaaattagacatctgcccaaagagctctattcagtagtccttgacattactctgaaagaaagatgaatttaataggaattttgcctttttttcccagacactggccaaaagaagaccctagacaagaaagatggaagacgaatgtcttttcagaaacctaaagggactattgagtatactgtaagttatttgctttcgaaaaagctatttttctttgtaagagtcttctttaagacattctctgtttatactataaataagacaagcattgttaattgccttatttttaaaaatctgtatttcactttggataattgttttattttttagttgttgtttttttctttaaagagaaattttactgagatataaaggtagttatcctagaaaatttaatttaatatagatgatagtttactgagagagttcccatgggccaataatttttattaggttaggcttttaggaaaatttttagttctttagaaatgtgatcttcattatattcgcagcagtgctagtgatagttataatggcagatgggatacataaaagaaaagttgatattaatcttccagtataaccttccacattaaatcatttgtatttatttatagctaactccctttagctctaaacattgagcttttttttttttttctgtattcttgaaatgaacttcaaatcttcctgcagtcagctggcttttcacatttctggttactctgggaaactgaagtgagaaatcagctttggtatatggtatgctgcatatttgattgaatgtaaagattgtttatttggataatgttaacgtgttgtaaagcacttttaactgagcttaattttgttattctgtgtttttctaacataactgtattaaggagaacagcaattttaaacattaatttagcatttgtatcattatgaaaccgtccagtcttggtttgactcttattttccatgcatctttaaaattgaacaaattatcaaaattctaatttatactctattttgatataccattcatatatagcggacagtgtgagattttaaatatttttaaaaggaatcagataatttaggatgaaataaaatttactaatatcaagataatctcacagcatattttaaactcaaattgcgtgtgtttgtaccttctctgcataattgagaaaataagttcaaataagttttttataggtaacctttaaaatttcttcgtctttacaattctgcagtgccaatatgaaaaatttagatatatacatgtttttatcatgtttattgtgtttcttcagcctaagaaatcatgtcactcataaattctagaaaaattcttggtaattatctttgattgccattttctcctccttcctctattttgtttctccagaactctaattttttattgaaactaattgtactacattttgctatcattatgctttgttgaccttgctattattttgattgtatcttctgtctgctttgctgggtgtttgcctcttcttaattcccaatgtgagtggtcccttgtttctttttgcttttctattgacattctattacttggagtgcttaagaactttataaactacgtggagtgagacccaaactttttttctatccctccctttctagttgcttgcatttcctactatcacttcatactaaacaaattatggaagcctcttaccaattcttcttcctccatccttccacaattcctgattttctcatttccgttccctttcagtttgttattcattcaggttgcagtctttagagtcagcatcagtttgctcattcacatttgcttccctgacctactgctactgctgtcaccacaactccattcaatccatgaatgtcttctcttgagtcttagttgaaatcttgtaccttaatttctttctttacatttttattactttaaaccttatctttgtttttctgcatcctttctctttcttgttccagtaatcctagccctgatgccagtaatatgagatgccacttgggctgttttgttaccttcatcatctcatttaatagaatcactgtgagaataaaatgtgttattattaattatgaaagtacttggtaaacttacagattttactgcaaaatatcatttgtttacagagaccttttatatatattatctcggtaacataggttttatatcagtacattgtgtagatggggaagtttgcatagaaggatgtaggcagaactagattattattgtattaacccaaatatttggcataaatttggttttataaaaccattaaggaaaatatgtatattattgttttacatacacaaacaaatgcacacgcacctgcttttcctgacttttgaaatcttctataacctaattctaaatgcctctttttttattttattttattttgttttctggagacagggtcttgctttgtcgcccaggctggggtgcagtggtgctatcacagctcactgcagcctcaacttcccaggctcaagtgatcctcccacctcagcttcctgagtagctgggactacaggcatgcatcaccacgcccagctaatttttgtattttttgtcaagatgggattttgccatgttgtccaagctggtcttggactcctgggctcaagtgatccacctgcctcagccttccaaaatgctggaattacaggcatgacccaccatgtctgacctctgaatgcctctttatcgtttttagagacttaactccatgtaatcaccttcccaaaaatttgtgcttcatgagtctactctggatggtttaggaggaagaggacagtatcccacaaatatgttatgcttttctgtctcttaactatgtcagttctgttatcttcactttgaaagttcattcctttctctctacttttcaaattcccaacccttcttcaaggcccagctttaaatcatttcttttctgtagtcttttctggaaaatttggattacatggtgcttttattcatactcaaaacttctattgcattcattattccattttaaattgttcatcttttgcataaccttttctatcttagtttccaactagattgtaaattccttgtgcaaaatgacttttagttgcacttatttgtgttttcttcagagctctctctttttttttttttttttttttgagacagagtctcgccctgtcgcccagactggagtgcagtggcgcaatctcggctcactgcaagctcggcctcctgggttcacgccattctcctgcctcagcctcccgagtagctgggactacaggcgccgccaccacactctgctcatttttttttttttttaatagagacggggtttcaccgtgttagccaggatgttctcgatctcctgacctcgtgatccacctgcctcggcctctcaaagtgctgggattacaggtgtgagccaccgtgcccggccttctttagagcgctcttaatgccttgtgtaatggggactttaagtggttatattatattggccaagtgacattttcttttagggtaattgatgaaatctcattatttatgatttctacacatatgatcatggaaacgtacgaatgattcagaactaaataactcaactttagttcaaatatttttctaatttatatgtgcaatgacagaatatatgcataaagatcattttgagtttaatacaggtgtactttgcaaaaatgaaattagtatgttgctagaagtcacatatattttagaaactattcaaaggaatagtgtattattttaaaacctttgtaaaatgaaaataatcagtttttgacttttaaattatgttttgtattttgaaattacttgaagtagagacctacatgtaaatgtattgtgatgaagcctttactctgtattgtaatagattaagagcatttgctaacaaaacacagtgtttcttgacagttattttcaaagatgacaataccagttgttaatcaaatgtaagctggtccctagatatattaatgctcattaaatattatagtttagtttttctgttttaaacattgaaataatttattttttcttttaaacaggttgaatcaagggattctttgaatagcatagccctgaagtttgatacaacacctaacgaacttgttcaattaaataagttattctcccgagcagttgttactggacaggtagtatcttttttttaatgtgctgatgtttagaaacattaaacagaaaggcagaaagtatttattgtactgtagttaataatatagaaaatttgagaataattttatatgtgcttttaacaaatcatattggccatgtaagagaaaattaactgttttatgtctgtattagtttcttttttaatacatattgaaaataattgtagatttttctttttaaatatagttacaaagagctttttaaaatattcagaacaatatatgcatatgataaaaaattactttatcaaagtaaggcatccctccatctcaaactttcagtttcttttccagaagcaaccagttggcagtttgcatttctttcaggaataatctagcctacttttgttgttgttgttgtgttttaatttaactttgattcttggaaagtgttgtatttaatcacagttctagttcagactttttcacgcgtgcatggtattacattgtattgatatatcatacttatttaaagcattagactatttctactcttttgctaaggtcaatagtgctgtagtaaacatgcctgtacacatctgtttttctttaaatgtaagtatttctgtagggtgaattcttagaagtaaagttactatatcagaggatatgtgcactttaaattttgctagctattgccaaattgtcctttaggagtgacacctctatagtgtatgacaattaatgtttcctcaccctattccagccgtatatattatcaaatgtgtctaaactgattttaaaggttcttttttaaaaatgtttttatattcttataatttgaaaatttttatgtttttctgtttaattggtaattgttaatagtgcttgcttatagaacaccatctaattattaacacttcattttaactaaatctttgtgtgaatgttttcttacaggttctgtatgttcctgatcctgaatatgtctccagtgttgagagctctccatctctaagccccgtaagtcctctgtcaccaacatcatctgaggctgaatttgataagaccactgtaagtatctctgctttgcaaagatggcgatgaagaaatctcactttgtctacattgactgtcttgttttttacattccattttgactatggttagaatgaaatatttcctttttattttgttgcttaagtttgtaaatcccagctttaaaaataagacattcttatgaaaccatatagcttaaattgacttacctttgtaggtggtggttgtgggccaaaaatattcatcaactcttattttttaaagaacatatataatttaacttacaaaggaatcttacccaaaaaacatgacattatcacagtagaggaagttcatgtccaatttgatgtttatttcatctataaataaatgagtatatagtacttagaactcttgagtttaattttgacacattgccttttaaaaaataatttatcatcttagtcatccaagaattgacatagtagattaatttatctagcatttctaaggaatgagtgttctaataacttacattttacaaatgaacttcagggaactaaacttcatttaataattttgattaaaatcttctgaaaggaattatatattatatatttctttgcctttcatagaataaattacatgatattattaataactatttttctccttgcctgggaacttttttctgcatgtgtgtgtgtttgtgtgtgtgagaaagagagagagaaatgaggcctttttcatttatttgatggatatcttctttatataattatggcaatactatgctttagaatgcagtcacatgaaaggaatatattacatttgttgtcatcattgataagaataaaagtcaggttttaatggtaggtattacttaccaaatgacacaatacctttttgaacatagccatgccattttcccatgggacttacaaagagatgtactcataaggggcaatgacaaagtaactacgtagccttaggttaatttagcctgtgtttcaaaccctaaagcagaatgatgaaaatctaagctgtagcatcatgcctgactagaaacctgtggggtctcttcctgttcctcggctttaacctaaatctgcctgtctactggctttcttggaaggtataagatcaaagaaaacaaaatgttgaaagttaagggagcaacaaggccaggcctcaacctgtgtgaaaatgtaccccttcttacttttgccatttgactgaaagagatggagaggataaagttatgtgaatgatcttttaatcctcagtgacttagctactgtcaaagatggaccaaaaaacttcctgtaatttggccagtgatatgagtaaattctttgtccctgggatagattaaaaaaaaaaaaaagaggtgagagattccttaaagaactaaaagtacacctaccatttgatccagcaatctcactactaggtatctaccccgaggaaaagaagtcattatataaaaaagatacttgcacatgcgtatatagcagcataatttgcaattgcaaaaatagggaaccaccccaaatgcccatcaatcaacaagtggataaggaaaatgtggtatatatataccgtggaatactactcagtcataaaaaggaatgaaagaatggcatttgcagcaacctggatggaattggagactcttattctaagtgaagtaactcaggaatggaaaactaaacatcgcacgtactcacccataagtgggagctaagctatgaggatgcaaaggcataagaatgatatagtggactttggggactcaggcaaaagggtgggagcagggtgagaagtaaaggattacacattgggtacagtgtacactgcttaggtgatgggtgcaccaaaatctcagaaatcaccactaaagaacttactcctgtaaccagacacacctgctccctgaaaacatattgaaatggaaaataattaaaaaaaaaaaaaaaagaggtaagagaagagtttgtaaacttctctttacatggaatgatactctttacctgccatcaaagagattatgggcaatagttagaaataattcttacaacagttgattgtgtaaattttagttgtattttttttacctaggattatattcattaccaggctccaggataatatttctatgactttctgcatatctcaagtgcctatatttctatatttctaattattgggttttatgtctcccatgctgtataaatcccttagaaataaggatattatgttttattagatatagtttacattttcattacactaattaaaataatgtctattagtattgttattatatgtttttcccagaaattgtcagtttatattaccagcaaccactgataaattttttgaatgtccagcttagtagtggtttactatgaagctaaaaatatgttcctggctttgtcggcataaagactttcattggtaataattcgttttcacttaaaaatattgcattttgagaatttccatggaaaactattttttctttatttttcacttttttttgttcacatatggaggaagaaatatagaaggagatagaaccaaagtaatggtaaaaatcataaaaatagctaaaatgtagtattgcaacaggtataattctaagcactttaaaagtattatttatttcttatctcaaatttatgaggtaggcacttggcctgggtttctgtgtttgtccctccagacttactctgtattctctagtgtcctttgggtggtagactgcatcagtgcactctctcttgcccttttgcttctgttggtggttttctttctggagcagttgcagaagataagggggaaggaaagagagaataagatggggacatatttattctcctagctccttccctgtaaggttactccagagtgaccacattcttcagcatctcatcttatcttttgtcagccctttccacagagccatctctaaatttaggtatctgtttctcccccttacctctttagggatagaggagtcttctgttattgttcaccctgggtttttgtacaccatatgtacctttgtaaatagttccataattaaatcctcttaaaattattcagtttctaccgggcatagtggctcacgctggtaatcccagcactttgggaggccgaggcaggcagatcacttgaggtcaggagttcaagattagagcggccaacatggtgaaacccatctttactaaaaatacaaaaattagccgggtgtggtggcgggcacttgtaattccagccactcaggaggctgaggtgggagaatcacgtgaacccaggagtcgggggttgcagtgagccacgccactgcccttcagcctgggttacagagtgagactctgtctcaaaaaaaaaaaaaagctcagtttgatgtgccatctgttttttctagtacctgaccaataagtattgtatccattttatagaggaggaaacagaggaagagaagttaattattttgtgtttaaggtcactcagctagtagctaagctaagattctaacccagatgggcttggttcggagcccatattttttattactactttatagctggaaaatgataactcagaaacactactcttgcccaataaataattggacccaaagagttaagtaatatttaatcattataaaagtcgatatagtaatagctaccatttcgcactatcatcttcctaagattctttaaatctctcattttttgaataaatatagaaacctgcttttgttttgtacacctttggtttttctcctttgtactgtaagttcacccattatgctaatgccattttagggtaaaactgttaatgtgttatattcaggatgaagttcagtggaaaaatgtttaaaataagtaatatgaaaaaacgaaataattttaaagtacttatgtttatattaatatactctattgaagggtgggatatgcagatagtcatattctctttaagataaaacatggtataatactctaatcaatctaaaatatgataaaaatagaatattaataacacttgaattggatacacatgatgataagacaatataattttgaaaaaaaaatacttttaagagattctgaggaaggcctaggaagtcctaaaggaggaaagaggaaaaagtataaaatagcaatagaatgtaggcatattaaatcttcctttttaaggataggctgtgattatactgctacagtagctattgtttttttacttaaagagtgcttactatgtatttactgtgttcatttcagaattttaatctttaacactttaataacattttaattactttagacttttaattaatctttaaccccatgaggtaggtacaataatcatgatctgtatttttaaaaatgaggaaagtaaggcatagagagaagaatgatggttagtaagtggtagaactgagactgaaaacctggcagtcaaggtctagattctgtgttgtgttcttaactactttttgtactgcctaagtaatgaaatgatgactactagcaagtgcaggtactctataactgagacatatgatctaaattaaatatatgtgtcacaatttataggaactaggaagtttgtagtaaagaactgtgtggaagtaatgcatgaaatttttgcttggccaaagcaaaaataaaaatgtagaagatttagaaatgttctttaattacctatattagtttcctagtattatcataacaaagggtgacaaattgggtgggttacaacaaaagaaatttattaccatacagttttggaggctggaagtctgaattcagactattggtacgaccatgctccttttgaaacttgtagaggagaatcatttcttgcctcttctaactggtgtttgccaagtatcattggcattccttatcttgtaaatatatcaccactttctgccttccttgtgacaagtggccatctacttcctgtatgtatgtcttcacatggtggtctcttctttatataaggaaaacagtcagattaagggcccaccctactcatgtatgaccttaccttaaattaataattacatctgaaaaatcctattttcaaataaggtcacattctgagatactggaggttagggctttaacattatcattttgggggagacagtcaaaccataacattgcctcataaaattataattatagagaatttatattatggagctttatttatattctagaattttatattttttgtctttgaaggaaaggggaaatttagaaaactttctaattctagtcaagtaagattttctaagagatgtttagttaattttcttcatttaagatatgttgaagggttaagttaatttctcatagggttttgggaagcttgtgaatatttgtaaaatattgtgaaaacttttttaaaaacgtctcttttttaatcatgatagtcacataattaattggcatcttgaagtggtatgcctgtatacctgaaaatagacattaattacaagtaatagcagacatgcaagaaattaaaacaattttagttaggaatatcaaagtagtttgaaaaggttaaatatcgcctgtgcttcaggaattgctttcacatatgacatcctttaacaattcacaaacataacctctcttttctctctgtgcatatatagaatatatattttttaacttaaaattaaagacactaatatctatcatatacaatattatatgttatatataaaacatgttttatctcttttatagaatatataaatcgtaattttttctaaattatgattttaacttcaatgcttttagacttcaatgttaatataaatatatacaacttatgtgatatataacttatatattaaatgtaagcttatgtattataataaaactataaatatcaataccactcaaatgtgtaaataacacataaatcatatatactacattcatattattacatataatttagctttgatgcttttaaacctattttaaataacaacttagtaaggaattgttttttaatatgtactttttaatagattatactgtaattatacctcggtcttatattcttagaacaaaattttatggttagtatctgaaaaattaaactttataataggacttagtgtttgcgaagattttaggaaacaaatattttatatagaagaaatccctgtatttttaacatcacaagaaatgggtaaattactagatgagagtttttttttttttcctagattccagatggaaacattatttccataattagaattaaaaattgatcccgatattttaattttattattttattctgtatttgattttaaacattcttaagttcttggtcccaggaagtagagattattgaacataatttatagacagtaaatggcaatcatcgtatatattggattgaaagaaaaatacagcatacactgcttcaaaagtaaatgttttctttaaaggatatatagtatatacgttgcatgaagtaaatacaaatgttggtatttctgtgcctgtatggattttcctcctcaatcttcctttgccctacctatgtgttactagagaacatttctacaaattttcaatcgcaaaagaggaaaaatacaataaagccaaggcaagaagggaagtggacagtttggagttgctaattcatttatggtaatggtttataataacatacaaatcatattgtataatatattctacaaaaaaagataactctaggtgattattaaactttttgtaaatcatttgccctagcaatgctttgcttttttacatttgaatatttggggcaataatgaggctagatagatagatatagatgtttatatttctatatttttaaggaccttctctggtggctaaaacaaaattatgcagggaagcatcagcaagccatcaaatgagctgcaaaaccacctcattaataatcacagtttaaaaatagcattcaaaaccatctacatagagatactaatactttgaatagtgtacatttatgtaagttacggtgaggtctggtaattcctctgaacaactttgatcttttttgaaagtaatctccttttttgtgctttgctttgagcatttgctaatctcatattctttttaaaagaattacattgacaaattggtattgctatagatactgagttcagactttcaggtaacctcagagatcatatattgttcaaaaaggcatatcttcatttaaggaaagcatatgacaatgtgcacatatatatacatatatatatatatatatatatacacacacatatatttatatttgtgtgtgactaatgcggttaactcagttttgggggaattgaggaatcacaaaatttgttgatagctttttgccagtttgcaggggaccctcttatagctctgcatcagctatttttttcttagcatatttttgagttgtttggtagaagatttgaaagggaagcgatacaatattacagttaagctcactggtttgtgtgttgataacataggtttgcatcttagctccttactcatttgtcaagttattgaacttggctaagcttaagttcaacaaaaaaaaaccaagaagcgtatatatgtgtgtgtgtgtctatatatatacacacacacacacacacatatatatatacacatatatatataactatacctctagtttgtttttaaaaaatgttttaataccatgttgtttccatttgtttttccttataattctctattttattttgaccattccaaaacattctgagaagctggttcataggcttcactgtaagaatggtcagtagcaccaaaaaagttaagaaacttgtgatctagtggaatgggatttatcaactgtagctcgagatttaaaaggctattccagtgaatgggttctgctgtatgcttaggtactaaggtaagctttccacctttttactgctcccagcacctgatggatattatattatatggtcttatcagagtcagtggtttaattcaggagcatctgagtgtgtgtgcacgtgtgtgtatgtgttgggtgtgggtacaagagatgtagtgttcactgttctccagattattttattttttaaatttatagatatgtgtatctccctattaaaaatcactataaatgtaagtttaacctgtgtttgtgatctttattgaatatgaaaatagtgccacttttgtcctataatttgtacgtaaaaatatttcgggctgacttccagaatgcggtgaaatgaaacaacacttattggggaaagctattcatttgactttttaatagtgtgctcatttttattttgttttctgcttttttttttctttcctttaaaaaaaaaaaaaagaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaaggtaaagaatgacactttagagaagacctttaatcatgctttagttattactaatgtatgatagtttggcatttacattttaagtcatcaatgtcagaaaatgcttgaatattatagaaaggtactagtgatactattattttgggttagtatggatgttgcttataacttagagtctggtgatctgttgtaattgttaaaagtaatggaatataaataaattcactaaggcacagctaagttgctgttggtaggatatttcaaaagtgtgaataaaatgactgctgccaggtactgtgtggagtgtgaacttctgtataactagtatagcacacaaataggaagatatctagtatttattgagtaccttctatatgccagagagtatttgaggtatcttaattattttatcaattcaaaacaatcttgtgaaataggcagtcatatttcttttccacagggaaaaacaaaacaggaagggttcataggaaaggttaataggtccaagatctctctataatggccagaattcaaacctagtcagaatcttttttttttttttttttttttgagatgaagtttcgctcttatcagccaggctggagtgcaatggcgtgatctcggctcactgcaacctctgcctcctgggttcaagcaattctcctgcctgagcctcctgagtagctgggattataggcactcgccaccacatctggctaactttttgtatttttagtagagacagggtttcaccatgttggtcaggctggtcttaaactcctaacctcaggtgatccacttgcctcggcctcccaaagtgctgggattacaggtgtgagccaccgcacccagcccagaatctattttgtctgcttcactttgttgcttttctaagcaaaaacttctaatctgaaaagagaatatagtaaagtaatagagttggaaaataaactccagattttgctcaaaaaatgtctataacatgatactgcctttagaattcacacatgagaactatttctttgaagtataattcataaatttatgagtatttgaaacacataataagcatttagtggtatgcattttgccctaaatattgttttaaatgttgtgttttcattttcatttactttaaaatattttctcttgatttcttctttgacccatttgagagtgttttatttttctagataactgtcttttactaatttctaattcgattctgtgtgatcagagaacacactactatttgaaggctttatttagacctgttttatggtctagaatatcgtatgttttaataaatgtaatgtgtgcactgtaagagacacattatatttgtgttgggtggaatattccacaagtgtcaatcaaatcaaattgagtgatagtgtcctgtatttctgattttctgtctgtcagttgttgatagaagaattttgaactatctcactgttattgtggatttatctgtttttgcctttcagttttatttatctgtttttgccatacattatatatttatatatatatttatatatatatttaatatatataaatatatttttatatatatttgatatataaatatatttatatatatatttgatatataaatatgtttttatatatatttgatatataaatatgtttatatatatttgatatataaatatgtttatatatatttgatatataaatgtttatatatatttgatatataaatatatgtttatatatatttgatatataaatatatgtttatatatatttgatatataaatatatgtttatatatttaatatataaatatatgtttatatatttaatatataaatatatttttatatatttatatatatatttatatattaatatatatatttaatagataaatacatatatatttaatagataaatacatatatatttaatagataaatacatttatatatataatatatatatttaatatataaatacatttatatataatatatatatttaatagataaatatatttatctatttacatatttatatatatttatatatatataaatataaaatatttatatatatttacatgtatattataatatatatctttaatatgtcacattctcactttaagtagcattatatatgccactttacatatagtacacacaccttacaacagtatacttttatttcccccttccagcctttgtgttcttatcgtaacacctcttatttctacatgttataaacacaattcattgttattatttttgctttaaaaagttaatttaaaataatttttaaaataagggtaaagtctattatatttatccacttacttattccctacacttgtcattccttttttatagttgcagatttccatttgtatcatttttccttttatataaggacttctaaatttcttacagtgtaggtcagctagtgataaattctttcagtgtttatttgccttgaaaaagtctgtttttccttattttattaaatgttactatcatgtttatgtatattttcttttttttttttttctccgagacagagtctcactctgttgcccaggctggagtgcggtggcctgatctcagctcactgcaacttccgcctcccaggttcaagcaattctcctgcctcagcctcctgagtagctgggactacaggcacatgccaccacgtctggctaatttttgtatttttttagtagagagggggttttaccatgttggccaggctggtctcgaactgctgacctcgtgatccgcctgcttcagcctcccaaagtgctggggttacaggcgtgagctaccgcacccggcacgtttatgtacattttcaaaattatatgtgtgtttataaaaaaggatccctaacttttaaattttatgccactttatctttttttggtccattgaattttttttaattaatatactttcatttttagagcagttttaaatggacggaagaattgagcagaaattagaattcatatttatactctccccctttccccagtttcccttattaacatcttgcttttgtgtgctatatttgtttcaatcaatgaagcagtattcaggcaccaaggaaagcccataagattctctcttgtacattctgtgggctataacaaatgtatagtgacatttatctatcattacagtattaccagattagtttcattgggctgaaaatcctctatgcaccacctgttcatccctccttccctttctttccctgaactcctgataattaatggtcgtcttactctctctgtagttttgcctttttttagagtgtcatatagttggaatcatagagtatgattgaatgaattcatattggcttctttcacttagcaatgtgtgtttaagattcctccatgtcttttgcggattgacaccttaattctttttactaatattactgaatattccactgagtggatgtactgtagtttatccattccactattaaatgacatcttgatcactcttaagttttggcacttgtaaatgaagctactttaaacattcatgtgcaggttttgtgtggtaagttttcatctcaggtaaaatatcaagaatcatgattactggatggtatggtaagaccattgttagcttagtaagaaactgaagaactctcctccaaaggacctgtgctattttgtatccaataagcaatgggaatccctattccacagcctcaccagcatttgatgttttcagtgttttagacttcagccgttctaatagatccgtagtggtaatatctcactgtgttaattagaaattctctaatggcatattatattaagcgtcttttttttttcctattcagaaatgacaaattctttaaatcgacaaactcatcttcctcaagccccagaccatggtaggcagccctccctctccgtcccctcaccccaccccttagccacagtgaagggaatggaaaatgagaagccatgagggcctctgccagggaaggctgccccagatgtgtggtgagcacagtcagtgcagctgtggctggggcagcagctgccacaggctcctccctataaattaagttcctgcagccacagctgtgggagaagcatacttgtagaagcaaggccagtccagcatcagaaggcagaggcagcatcactgactcccagccatggaatgaacggagggcacagagctcagagacagaacaggccagggggaaaaaggagagacagaacaggccagggcatggcggtgagggactgaggcccctaaattttgatcccaggggaaaagaagaggccagttggtccagttttgatgggtatggggaagggaatgtattagtaagcacgggggagaggctgccaacaggcacctcagaggtgataggacaggctgaacccctcaccctgacagaagggagcttaagagctctggggctctctgggaatgtcactgctaaaatatatatctacatgtatattaaccactcgtgggagggcaggggcaaggcctggggtgggatcaaaggatctggtgtggcatccagtagccagtcatgcctgcctgagatgccccccatctgtagcccgatcacgttcttgccctcttgcagctggttatccgagaagttccgaggattctccttggatttcttagggaaccagttgggatccccagagaagagcccatcatcccaggctactgccaacccacccagattcctcagcgtccgctgcacacaggccatgttctttccttcccagaggtccacagtttggaagatgtcagtggtgttaatgccatagcgctcagctgcttgcaggaactgagagatcttctccatctgcttgaaggccatggtggaggcctggatcttctttactgggacctgccccttggggtacagtgcattattgagctcacataacaccgtgccatccttgagccagttctggaagttctcgcgtccaggctgggaccggcccacatcctttcggcactgggtggtgatccactggatcaggatctgctccagatctgcatcatactgtttctcaatcttctgctgcacctcctggctcaggccataatgcaggtcccctgttggccattccaatgggtggcggtggctgcggggagcgttcaaacgggctggagagcggcacactcactcaaggcaatggctgcagctgccgagcttcttcttacatgcttattttctacccagatatcctcttcattttcaaaggatattttcactagacagaattttcagttgatgaggttttatttcttttcagaactttaaaaatttactccattgttttctggcttgtgtttttctaaagtgaagtcttgcattatttttatgtttggtgttctgttaaaaaatgtgtctatctttggttgcacttaagatgttctatttatcactgattttgagcaattttattaggatgtgccctggtatatttttttctatttgttttgctgggggttcctttagcttggttctgtaggtttatagttcatgccaaatttggaaaatatttgaccagatttcttccaatattttttgcctcccatcctctctttcctcttctttgggaactccaattctgcatattttaggctacttaacattgggtctcacagctccctcatactccattcacttttttccttctcttttcattttggataattttaattgcttgtttttaaattcaccaattttttttctgccatggctaatctactcttaatcctatccagcatatttcatctcacacattgcaatttttctccctgtaagttcatactgggtcccttatattttccatatccatactgtgtataatcttctatattgttgaatatggttataataattgttttaacgtctttttttttgtactctgttacttctgggtctgtttgcgtttattgatttttctctttaatgtggttcatttttttctgtttatttacatgcctggtaatttttgattggctaccagacatcatgaattttatgtaattggatactgaatatttttgtattcctacatatattcttgcactttttatctgggacacagttatttcttgatcctattgtggcttttatttctttgatgatcacttggtaatggcttgttcataagttttgttaggaccagaatagcctttagtgtgtagctaatttttctccttactaagacaataatacacttgtaagtattctgaggctttgtaaatacaagatttttttttgctttaatgtttagtgagaacacgaactattcttactgtgtgggcgctgactattgattcttctgctcctttcaagtactctcttcttatcgttggatagctgcgatacatgtaggtggtaatcagtactcagttcaaagctggaagggaaccctttgtagacctctaaagctttctcactggacagtgctcatttctgggttgtttgtttgttttgcttgttttttctctgcctgtggactggaaactttctccactcagtatgcttcggtaatcaaagagctgatcttatgtgtttctccttattcaggtatcattgcctagcattccggtgtctgaaaatattatgtcacatattttgttcgtgtaagtttggtgtgtgtatgcatgtgtgtgtttattgtagttttaggcagcattagttcttgactagaagcagaagttcatttgatatctgaataaaaattttatttaaagatcaaagcaaagataaggtcattggcaggattaggaatgatctgcagcctagtgtttttggaacgtaatcccttgttataggctggctctgtgcattctgctgcacaaaaggagataagcaggaagtggtgctttctcatggaagtcgttttttcttttttcatcttcctacaagttgattatacaaaagattatttatgtaacaattatggaaacttattaacaataactataatggctaagttattgtggatgtaagactgaaaaaatatcagtacaagcttttctctttgctaggatggattcccaattataatgattttatctcttagtatttgcagaaatattgtaatgtaagtggtaatttttcttttgcagatagactttattttttttactttattttctaatagaaataatttctctttagaagattagtcaggtaattgcacgtaaggaaatggaagttgttaatacaaaagaataatctgtgcttaaagtttctgaagttcatgtggattaagtagatactttaattgaaaacgtcttgctcataatagtcttaatataatcctgataatatgtaggagttatgaaatattttaaaaataatgagatgggagtgctttggtataagcttatgattttcaacttgatcaaatgaatttgagaatttactttttcaagacattttcatgaattttatgttgaagaaatgtttctcttggcaaactcttgatttatggagaatgatgtctaacagattaccgcagaaagccccagctgtatgggaactttgagtgtgtagcagagggaaagaaacttaaagaatatatcagtgtgtctttttagtaatagcacataagggagattcctggaaagtaacattagcagattgatcagtctagtgggtaggacttcaaactctttctaatccaaaaagtagactcatggttttgagatgcttttcaaatgatttgtatagttacagtactaggattaaggtattaaggtatatagagaattaaaagcattatcagtatactgaggcttttctgtcatacatagctagttatcactgtctttgtgaaaatcttcctaaaagataaaatgtagtattatgctagtgaaccaaataattggttaaaactaatgcaaaagtgaaatttatgaaatggagagtaacctgaagtgtttcagagaatttagagcttgattttttttttatttctagttgattgcttggtttcctttctcaaataagtttacagaagatgggagagagaaagttatgaaagatcagaaacctttaaagttgtttttttttaatatcaaatatactctatccttgattatctacatcttggattatcctagacaatgtaaatgttctctacaatgtactttaccatctctcattgacttgagttggtatgtgacccaggaatacaaactgatgtgtatggatctcattaaaatattaattgaaagagaaataggctgtagtttatataaagttactccttatttaggtggtccacgtcctcaactaaaagaggtgctattcagagtttcatatggattccctctccctcaccaaactgcacacacacatatactcttctctccaatattgtgtgcattaactgtatgtgatcttgaacatccgcagtaactttttttcacttgtgattggatgaccattttctgtagatttactttttattttatcatttttaaaagcaatatctgccataacttaatttttatattcttaaagttgaaccaggtgaattcacagagctgaatatggacttgggaggaggatgtgatgccaaatcaatcaggatttgagtttttctttttctttggataagaagctatttagtttatttttaaaattctttctggctcttcatttttacagttacaggatatatagtggactgaaaatttgaaaatgaaattaaggaatgttgcacccttggagtgattatggattgtgacttggatacagaggaattatatatagcataaagcatgaactagctggacttcaaatcctagctgtttaggacaagtttccaggtgtttctcaccattagtttctctatcagtaaaatggaaatggttttacccatctcagagctatgattgtgaagatcaaataagcaatatgcatataaagcatggtacatataaagtattcaataaatattcatgttagtatgatcagctgcctgtggaccctagtttgctcatttataaagtaagaaggttaaacttttaagatttgtatcactatttatttatttatttgttttatttttttgagatggagtctcactctgttgcccaggctggagtgcagtggtgtgatttcagctcactgcaacctctgcctcatgggttcaagcgatttgcatgcctaagcctcccaagtagctgggattacaggcacatgccaccaggcccagctagtttgtgtttttcagtagagatggggtttcaccatgttggccaggaactcctggcctcaagtgatccacccactttggcctcccaaagtgctgggattacaggcgtaagccaccgtgcctgccctgtatcactatttatataaatatatttaaaattttatagcttttcatggtgagttaaaagtatatatacactatatactttagatgtcatataatctacttaattttacagatgaagaaataagcccagagactccttgcccaaggtcacaaatctaggtagtagtagagtcaagtggaaacagattttttaaagagatgttttaaagatattatactcttttccttttataatattatcaacattatttattgagtctgcactgtatacatgacactgtatttggtacttgtagtgagggaataacacaggaagcagtatgcaaattaacataaaaggtggcgcttcttaccttactgaagttacctttctgatatgaggtaactcagtattttactcagtttgcacattttatttccttacttgattgtctttggggaaatatgatattctacctctcctaaagaggagaatttactgggaaaacttgggttttaataaaaatggtttcatgagaatgccacagttcctgagtgtactatttttatatatggcctaacatcagaagaaaattagtaaaaatagctagataatttttgaagtatcaaccttgaggattaaatgttactttcttttttcaccttagggcacagtcagtggtgtgctgctagttacaccaaataatataatgtttgatccacataaaaatgaccctttggttcaagagaatggctgtgaggaatatggcatcatgtgtccaatggaagaggtgatgtcagctgcaatgtacaaagaaattttggatagcaaaataaaggaatctttacccatgtaagagtgatatttatattcctttgcaactttattgtatctagatagttgacccttgtctaataccttaactatttttactagttttcttatagctgccttttattttgtcaataatgaaacgaaaatatatgcattattgagaagattattcttaatttgcacctgggatagttatgaattatcttagatttgtatttgtgtatgtggtcagagaaccagatatttgaaaagtaacctatagtgcccatttaattcagtgtttaccagcctttttattcagacacagcttccagtcttctaaattacccctgtgagcaatcactgttgggataattttcaaatttcccttggaagtgactgaagagctgtgatttgagagaggccacatgagcaaagagctgacattgctgtgggcaagacagcttttttttttttaattgattgatttatatgtttgcaatcttctctcccagtataaaatacagtgtaaagtacagggaagaaaacccacaacttgctcaaatataaagagttaactttggaatatactggtcagaggatttgtgtgatatgttaagatagctgtgagactacagtttggacacagcttttgaaagtaatatgcttgtccaaagtaatggccagaaagaaaaggaggaatgggaaataaaaggagaaaaagataaaagataggtataaaaagaaaggaaggagaagtagcaaggaaggaaattgatatgtactaggaaataacctcctcattccttcatacatgactaccaacattttaaaattgtcttcactttaactgatactgatatttatatccctgtattagcccacaggaatgatagctgttttaaaattaacccttgtggggcagagcaacttacaaaggaaaaaagggacaaattatttttgtttctgaggaagactaaatgaattggtagaatatctgtgacagaataaaatcctttgctcaaaagtctccactgtaccttccacccaacagatattattttgacttggtagactaatctttagagctgcagataattcctagaaggtgttagtatcctctgtattagttatatttgtagatcatcatccaaggccagtttcagcaaataaggattattgggaggtggataatgggatgagacaaaggtaaaagagtgaaggattacattcaaagaagaggaaggatatatacatatatggagagagagagagagagagtcattggtgagattctgttgtcctccttttctttctttttctttttctttctttcttcttctttttttttttttttttttttttttttttttgagatggagtctcgctctatcacccaggctggaatgcaatagcacgatctgcaacatccacctcctgggttcaagcggttctcctgccttagccttccgagtagctgagaatacagacacctgccaccacatctggctaatttttgtatttttagtagagacggggtttcatcatgttggccaggttggtctcgaacccctgacctcaagtgatacactggcgtaggcctgccaaagtgctgagattataggtgtgagccacgatgcctggctttgtccttttccatttgcaatatggtactttggggttctcttattctgaacaatccatcactgttctacaaggatgctgtatagctcttccctttcaaatcactgttttgtcattcattgtcagctggaaagtgtcacctggatttaaatatttaaagatatttcttcagaaagaaatatctttaaattctgccttatggattgattaaaaacaatatttggcacaaaattagataaataaaacaaatgtatgccaaaaatgaggtataagatttgattgcttttcttctgtcttatgctccttgggaggttgatttcaaaggtattattatggtattacattcaacagtagtaacatcattgacataaatgtttagcctttcagcatattaaatctgaagagtatagcacttttctaaatatatatcctgtcacgtttgttatgtttatctcttacctaagggtcttctaattctttaaatgtacagataaaatttctcaaaacttttgcccggttccaacaccctatagatgcagtatgagtgcatcaccagtagatgacactattgtatatttaataacaaactagattcttgtttttttaagatgaatcagatacaaaggcagcagagatattgacttcaactaattaatacttcaaaaatttatccatcctagttatagaaattatgcatacttgttgcagaaaaattggaaaatactgaaaagcggaacaagacaaagagttacccagcttcaccattcagagatagccaattatttttgtgttgacttactttacaatctttccttttcagcatattttacatggttctcaaactatgtatgtataaatgttaatgcttttttcattaagaactcatataattttcatttatcacagacttcttgtaaccatcattttaaattagcaacttacatttcatggtatagaggtttacactccctctttccagaacttaacttttgaacattagtgtttacatatacaaatgtcattaaatctgaaagtctagacccagttatgaaccattcatttgtctagtatctaaacttttcacctgaacaagttctcttagaggtattaaagagtatagttgttagcctgaagattttctctatatacttttgcttgagttttattcagattggttttaagccttacatttgagccatatattttaatttaagctctatttgaatgtaaataagcactgtgtgtgtgtgtatatctatggaaatcagtttatttttactttattgggagatttaaaattttaattaaacatttctctgtgtttattttccatattccatcagtgagtaaattttagtttagaattacagctttacccagggtttatgtcatcaagttcccttcaagtggattacttgcaaggaaatcttactttgatatttcctaaatattaagcaattgatataaaagtttgacttaattacttgatttatagaattacttggtctataaggttaattatttggtcatattgaataaatcagattttttatattctttggagatacgtgctacatccttttgttaaaaagtctttttagtgatactaattctgtgttcagtgtgtgaaaagtaaaataccacaattttaaaagtctaattatttttaattttgtttaatgacagagatatagatcagctatcaggaagggacttctgccattcaaagaaaatgacaggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagtaagtgttatagagtaaatgaagttagttcatccaattgtatggtgtctccgtctttcctcactgactcaaaagccgctgtaccttagggcaacctgaaggataagtgagtgacccttgaccggtgattctctggggacaagtatatacagtctccagtgtctactgtcttttcttatcccacaggtggattgtacacataatgagcatcattgctacccaccatgtttaaacattcttggctcactacatcgtatcattaaacaatttatttcttgagaaattgcacaaaagctgtataatacctttgatcactccattttctcttaaaaagtttttggtgtgttaccattaaaaatgtcttttttcatatataacattttaattgccaaagttgtaatcccatcttttataaaatgtacagttaaacctaaaagtgtacttacagaattcttccacgtatcgagaagtttcatcatcatcatctaattattttcttttaaaaacctgccctcaggacaaataaaaacactattttatctgtcagttttctggtactgtttacttctgaaaattacactattttcagtcttttatttctaatatactgtgcttctgttaataaattatgggttaaatggggtataacaactaacttagctaacatttctgatattctattagaatgtttatcccagactagtccattcacatgtgaacttttctttcattttttaaattcaaagatttttgttttgctgtaatacataaaataaaatttaccatttaactttttaaaattatggtaaaatgtaacgtaaatatattatttgaagcatttttatatctacaatgcagtggcattagtacattcacattgttatgcagatcatcactactgtccatttccagagcttttttcatcttctaaaactgaaactctgtaccccttaaacaataagttggccaggcatggtggctcactcctgtaatcctatcactttgggaggctgaggcaggcagattgcttgaacctaggagttggagaacagcttgggcaccatggcaaaaccctgtttctacaaaaaaaaattacaaaaattcgtcagacatggtgatggtgcacacctgtaggcccaactactcgggagactaagatgggagaattgattgaacccaggaggtcgaggctgctatgagccatgatcatgccactgcactccagcctgagcaacagagcaagatgctgtctcaaacaaaaaaataaaaaacaaaaaccagtaacttgcttttctcccttcctcatagcttttggcaaccaacattctactttgtttctgaatttaactactctagatacttcatgtgagtggagtcatacaatatttatccattgatgtttggcttatttcacttgacataatgccttcaaagttcatttattctgtaatatgtgtcagaatttcctatctttttaaggctgaataatattccattgtatgtgtgtacattttgtctgttcatttgttgctggacattttggttgtttcaaccttttggctattgtgaataatgctgctttgaacattagtgtacaaatatctgtttgaatccctcctttgagttttttttgggtatattcccagagtggaattctggatcatgtggtaactctatgtttaatttcttgaggaacctccgtactgttttccatagtggctgcaccattttaccttccctgcggcagtacacaagatttgggtcagtttttaaaataccgaattttcttttcatcatgcagttgagatatcctgaagacctaagggctgtgttcagtagatattaaaataattcatatattaatacttgaaccaagttctataaaagatttaatatttttcttctgtaatatttttttaattcaaaactaatgcatgttcagtaaagaacatttggcaaacataggaagattctagaaaatttataaaaatcttctggaattcatcacccagagatgatcattgttaacattcaatatatctgtctttcttatagaacaaaatcatatgtgttaatttgttatttacatcaaatcaagattatactatactgttgtatcctgcttttttatgtcatgaaccttttcctatgtgattacagttctttgaaaacatggctttaaaggccctaaaatttatttaaccatttgcttattaagacatccagttgttattaacgatctgtattgttaagacattttaaagaatgctgcccagcattcttcaaaacatcaaagacagaaaatgcatctgatagttatcttatattttgaagatctttgactgcatctttgactacatctgatagttaccttatattataaaacctttgaaaaagataaaataatctgtttaagctgatgatgtggtggaccaattttgttgtgggggttgggggtttaatggggttaggggaggttattataaccaaatattaaaaggacaaaaattgatagatgtttttaaacagtcatctctaaactgttaccatttggtttcttctttttttggaataattagttttaagtaattttaagttacttaatattctgtaatagagaaatattcaaactttctgatctttatgactttataataaaattatgtaataaatataaaagtgtctagtccaattatgagaagaatggtgaaagctcatcgttttaaccacatgaaaatagtggggttcccatagattatctaccttgtgtaatactgcacagaaaaagccatgatgagtacccaggtctcctgactataagtgctatttcctccagtgtgctgccttggtaagctaatcaatgtctgggttcctaaattcacctatatattcagaccctcagtatactctatcagcacctctggttgaaagagttagaactaattcgttcttaattaactgtccaaacaggtggcagaatctaacatattattgactgttttattacaattttgtatacatgtaaaagcattagaaacttcattaaatttttgtctgaaacaaccatgttaagtatacctttaaaacttctacagttatttagatgtcattcaaaaagactgatagagaatatgtagaaaattatatatatattatgtgtgtgtatatatatatgattgctttagtatgggtgttgaaaatgtaacaatgtttctgaaacttttactttttttcttaatgtccttagacataatttttattcattaacttggctcttttgttaagtttagtcatgttgtatctgtgactttacctttgaaggaaaaaaaatataaattaagaaaatgtactttagcaccactaaagtgaggttttattctgtaactatttgtcagaattttgaaggtaaagttaactaaactacctaaacttggtgtgtgagaattgaataaacactgtttgcatctcaattctaggttctgcacttttaaaagaaaagcaaaggcatcgattacataagttcttgtgtctcagagttggaaaaccaatgaggaaaacgtttgtatctcaagcaagtgctacaatgcaacagtatgcacagagagataagaaacatgaatattggtttgctgtgccacaagaaaggtaaaaaacccatacgacaccttgagagcattattgagattctttgaactaaaattattttgtgtgtcaaaataccaatgataaactattgaaacatagtttatgattaaaagcagacaataagtctatttgaaaccattttgcccctactttataatttgccccatttttaattgcattcccttttgtagtttattatttaaaaatgtgaacaaatatccaatttgggtagtaaagagacttaagataccttggagcaagaagattcatcaaaatattatttgatatagctccttcctgaaggcagctaatggtgtataattcctttatattaaaaattcttcaaatattcattaaatatcttctatatacgtgacactaaattagctactaaaaggatgtagtggtcttcacaatatttgtgtgtaccctttgcacaattagatttttcatcataagttttaagcggttgtaaaagatgtctattgtactatcttgtcaatttttacattttaagtaaatagtgttacttatacccagtagaactgaaacattataacaactttccctgtactattattcacttaaaattactttaacagttagacattgcatcattactttttctctttaaacttctatttccataataccacctcacacaaactcattacaacgtactatatttttatccccattatagttctttgcaacaaactacatatacttaacacatttacatatctgtgtgtgtatattgaaattgcatttattttaacattttctgtgacttttgtaaaaacagtaaagggtttaaggttttaggctacctgcaagccaacaacttagtctgcctccatttggtgcatgctgggagaaagcacaaacatctgtacaacagcagtaatcagaacatcagcaattgtgtgatttctctgtacctcctttcctacaaaggatgtgaaaaaggccaagtgacagctgcacatacctggggttattttacagaagaggaaccataagtttagggaacctgaatttttataacagacagtaagcatggttaccctttgctagacagtaagatactatctctacttctaagataatgctacactaacatacttgaaaagatactgctgagcaaaggtattacacataaaaagtaaaatatcataggaaatgcctgtcttaaggagatagatagacctttcctatatccattgatagattaatatgtttcattgaaaggatgagataggactcagcatcagttctgcctctcccttttatttttctttataagtactgagaagctttgttcatagaaaagtcagtgagactgaagagagtttcattttaataatgtcattcaattatttaaacttgtttctatataattccaaaaattaatcatttttgtcacaatatttttagtgatcatcagtggacaactccattgaaaactccttcagttttgcggaaatcaattaatgagaaacaacctgacatacagaaggacttattacccagtctttataatcatttcctgtctcaacaccaatcttgggcagcctaaaagtttttatactgtagggcatatcccattgtaaattctgagtaggtgaagatatgcccttcttttataaattagaaaaagtgctttagtgaaagcagataacaggaaatctgtaaaatatcttgaccatactgtttttaggcagattattatgagcaaagagtaacatatggaaattggagatacgcgaattgattcccttagcaccatcttacacgtttgtgtacctcttggaaaatctttatatgttgctttggaagactacagcttttaggcataaaatgataatgctcttttcccttttcccactccaccatatatagagtaagtacaatgtgtgtcttccacaacattggcttaatcttaaaatatgatttgcataattgatgaatacctgaaagggacagagcctgatattcaaacgttccagtgatgttgaaatcactacaatgagaaatgtaactatatttagttaaaatggacataaaaatttagtttttctcattattcttggttttaatgtttacatggaattccctattttaatattcattcttttatcttggttaatattcattacaaattagtattattaggattctgatctttattgtagacataaaacttaggaaaactgctgcatagatagtgagaaattgataaaaaggtaagatgttacattgaaagataaaatgtagcaccttttaaatatgttagctgccacgtaaagaatggcaattttaaaaatcattatattgaaaatataatttctagaaccatggttattaactggtatatgttagctgaaagttatataatcaattttcaaaaacatgttaattaaaaccaataaaacgtagatatttgaaatgtgtgtgtgactctcaaatacatttatcagggaatgtaacaactggctttagtgtagtaaacaaaacattgaaaaggggaacctgagatttctaagattagatcatctgtctctcaacactgtatgttcctagtatcatttaaaatttaaggacattacatttctattaacttggaaaattgtatataatgtctcaaaataggccattaataaattgtttacttgtattttagatcattagattattgtaggaatgaggtcaaagttgtgtatctaatttccttttccatcactagtgtctttaaagaagaaaagctttataatatacaacatctgaactagtcaaacacatgccaaggaaaatcttaatttggttttctaaagaacaacctgacagaatatagccaaataaaatgtttaagttaatgccttcctgatagtagaccttttatattaatataaaacaatatattttgtgtatattttaagtcttcaagatttatcaagatattttacaaatataattttttaattctggcagcacagaatactaggtatattaatagtcacttctcctaacaggacagatcacttgtatgccttcttcattcagtggagtccagaaatatatgcagaagatactggcgaatataccagagaacctggatttatagtagtaaaaaagattgaggagtctgaaacaattgaggattctagtaatcaagcagcagccagagaatgggaggtaaggagaaaaatatgaagattttagtcatctttttagtttgtatgaatttatagctttatggtagtacaaagtataagtgatgtttccacaaaagaggaatttttttaaaggtcaggttcactatccgtgtttatttgtggttattgaatgaatctgaatagtgactttaatactatatttgtcattctgcttttgctttaaaatactagaaaacccactagcaataaaatgacttttattgagtgtcttatagaatatttagtttaggaaagattaacattatggcaaagaaggaaataattttaattttgctgttatattaattttcataaaacatcgatttcacatctgatttgttttaatttcatctcctccatggaggaggtacggcagtcatttaacacatctgtgcatagtatttgcatagcatctatacaaattactactcctttctatgtttcagacctaagcattatcttgacttaaatttttcaataataattttaaggaaataagcaggtgctaattttataaagtagtagaaattttatatgctcagatttactgaacttgtttaaatggtcaaagttatactaacaaactttttgtaactcctcttagatatatcttaagattacatattaccttttacatgctttgtcttataaggttggtagggtggcaatatctgttggtgttgcctagattagtctcttcttgatgcattagaaaatgtagagcagatgctaaaatgttataataaatgtaatcaaatttttttattcattgggtgttaatgtttgtggctgttaatgtgatatgaatgtatcttgcatgcacttaacatgtatagtaattgaaggtatacatggcttgtcttttgtttaaaatgcaaactgatttggaatgtgtctaatgtcattctgtgtagtatatacagcatcagtttctactgtgactccaatataagggagggaaagaagaacatatcgaccatgtattttgggttattttaatacttaaaccaacattatcaatcttcataccagctttattcataatggccccaaattggaaagtctcattagcaggagaatggatgaatacatttttgaatacttacagaattccaaataacaataaaaaagatctactggtacaggcaatgacatggatgaattttacaaataatatgttgagtaaaagaagcctgacacaaatgaacatatactatgtaatttcatttacacgaagttcaaaagggcaaaactagtcagaaatccatcacactacttgatactgggctgtgacagggtggctcagggacaggagggaactttattgcgttctggggatgttctatatgttactctcagtggtggttacttgggtgattacatatgtaaaatatatataatatatataatacgtatataatatatatatgtatcttatatatatatatattatatacatctatgtccctgagctgtgtttttaagattagctttagaaggtacttaaaatagcccaggtgatcaaagatacgtacctaactaaggcagcaacagttgaaggtagagtggaaggtgatgaaataaagctagaagaaaaggtattagctagctaattacacaggattcagtgacaacctggtaaccataaagttatctccagcttgggtggcacggtggatggcagaattgtcagtcatgaacgggaattgagagctttctctccattggggttggagtacttaactttggaaataagagactattgactattttgattcaaaggaactgtctcagtttctgtgcaagactctgcagggtataatttctaaaggaaaaataaatctcctcaccagtcctttgaccggaattggtgcagttcaaaagaaaatggaagagaaaaaaataattttggaaactccttgctacattgtctgaaaatattaccgcagtatccagtatagcagcactagccatatgtggctattgagtacttgaaattcatgtaatgccactaagggactgcatttttagttttaattattaattaaaaaccgatacttggttccattattggacaatttttaaatatattaggaataacttagatatatgatctactttttcaactgtaaatttcatgaaatctaaatatgatctaaatcagtctaaatctaattaaggtcaagtatttcctatgaaaatttagtgcctgaattgagatgtgctgtagtgtaaaatattctacttcctatagccactagccacatgtaaccattgagcatttaaaatgtggccaatctcaattgaaatgagctgtagtataaaatacacactggaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggtgggtgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaatacacactggattttaatgacttagaatggaaagaaaaaagaatgtaaacatcttgtttgtttatactgattaatattgaagtgataatattttgaatacattaggttaaataaactatattaatacaattaatttcacttttttaatgtggtgtctagaaaatttacaattgtaatgtatcttacattatattgctcttgtgcagtgcaggtctatgcctcatggatactaagtgcctaaaaaaatgtttgttaaactagggaggccgagggtaacaaataaaaaatgttaaactagggtggatcacgaggtcaggagtttgagaccagcctggccaatatggtaaaaccctgtctctactaaaaatacaaaaattagctggacgtggtagcacacgcctgtagtcccagttgctcgggaggctgaggcaggagaatcacttgaacctgggaggcggagattgcagtgagccaagatcacaccactgcactccagcctgggcaacagagtgagactccatctcaaaaaaaataaataaataaaataaaaatgtttgttaaactaatgagtactcatttaagtgaaagagtaattttaaatgttaacatgatttattttaaaacaggaagaatttggctaaagcccttatataaaacagtagtacttcagaatgtgccgtgatgttttttatttttttgttctacaaaggaatggagaataggtgtcctagaatttaggatgaacttgttatggctaccaacttgggcatcagttagatttaaactaacacctctactcactgttattctgctttagtgatacttaaaaaagatctttattatccctgactgttactcaagcagaaatatattgctagccagaaatgtatacattgactggggaagtttgtatatgataaatttggtaaacttattgtttgcttttttctccctttccctatgtaagtgtcataaggcagggatttgtcaatttcatacactattatatcttcagaactaagaattgtataggcatatagttcattctcaatatttattaatggataaacttgggcgtagattaaaattaaggtataaagcttctaatctttcaagattgctctatttcctgaaataagttcttacatcagttgtagtaaatattttcataaagccatagattctggacattttaactaatagtccacagtctgtcatttacatttttttttgttctgtttaaacatattcagtgaaagggaatttgttacctcaaagggcaatactttacattttaggacagctctgttagaaagttatttgttacaataagcttaaggaaacatatctttgtaaattggattcatttatctttattctgtcttccaatgcaagtcaataacaacaagaaacattttctatttactgcgatagtgtgaaaatgtttgtcttcccttttaatcttgtttcagaattattttttccagtacttcaactgtttaactttatgaactctattcagatcttattcatatcagtaccctaaaatatgttaaaagagttcataaactatggcaccccaaattactaaaatgtacacttgggatagcaggaaaaattccgtaatatttttaaaaattttaatttccaaatatgaacattgaagaccagtcctattgaagacagacagaaacatatatttactaagaaaaagaaaatttagccaaattttaaggtggtcaggagtaaaagttcctaatgataaatcagttcctaagtatttggataaaggatctgagaaatactattcttactgctcacgatgtgtaaaggactgaatttcctctttttgtagtgttactttgtatgccacatgataaagagtactttggtgtgggtcgggcgtggtggctcacgcctgtaatcccagcactttgggaggccgagacaggtggatcacgaggtcaggagatcgagaccatcctggctaacatggtgaaaccccgtctctactaaaaatacaaaaaattagccgggcgtggtggcgggcgcttcttgttgtagctactcgggaggctgaggcaggagaatggcgtgaacctgggaggtggagcgtgcagtgagccaagatcatgccactgcactgcagcctgggcgacagagcgagactccacctcaaaaaaaaaaaaaaggagctatgcctgaattaattgcgtcaacatggctgctattgataagaaagcatgtttttaaacaatcaaggcacaaaatgattaaggaaacctttcttcatagtgaaccaaacttatgtttttggtgtgatacccaaataaaagaaatatgcattatgagtcttgcttttggggatctgataaccttatttgataactgagaaggaactacttattacagtctttcccctgatttctgccggtattcaacacaggaagtcaataagtatatccagtgttgtgaggatactgtttgatgtggggctttgcagttctgtgataaatattactttctgttttttgatacagattttttatgccttttcactgaaaagggaagtgctctaatggcattttaacaaattgtcaggcaagtcctgaggtgaagatgaggcagaatgcctattgacatctgctatttcgtgatgatcgcacttttgttcaataaatatacaaaaataaaagattaatagtaaaacaaattcacatgtgccattcagcttcatcagcttatttcttctgtgtccctccttttctccaattgttcatagttattcaaatgtcataaaaatatttagaatacatgtaatatgtacagtatgtatttttacaatttgttttttgagtcatgatccaactaagttctcaaatgctgcagttagttaaaatatctcttaagtctctctaaatgtaggttcctcctccattgctttgctttgcttttttatttcagtttttaagaaatcagattttttttctgtagaatgtcacacagtctggaatatgctgtttgcatccccatagtgtctgttaacatgttattctaccacttgaatgattgatagatctagagcaatacacttaagtatagattatcatctttattttacagataatttctttgtatttttttatttattttattttttttgagatggagtctccgtctgtcgctcaggctggagtgcagtggcgtcatcttggctcactgcaagctccgcctcctggattcacgccattctcctgcctcagcttcccgagcagctgggactacaggcgcccgccaccacgcccggctaatttttttgtatttttagtagagacggagtttcatcgtgttagctaggatggtctcaatctcctgccctcatgatccgcctgccttggcctcccaaagtgctgggattacaggcgtgagccaccgtgtctggcccagataatttctttaagctggttttttatttggctaaaattctcttagtggttaatctctaattcagagcctataccttttccaccataccaagtactcaactttggcggaacctttgcatcatgatggggagctttcaaacatatcattgccaaggtcacaaatcagaccaattaaatcagaataattggggctaggacctagttatcagtgttgtttaaagctacctaggtagttacattgtgcagtcaaggtgcgaaaactagtataccaccatgccacaacttcaggtgttgtgttaaacatatacaatattaagactgtggaagactctttagactatattgattataatatagatcagcttttgagttcctgtcatgcaagttatatgaaatacttttcatattcctttcatctgggctgctgcatcaaaaacataaatttggttcactatggaaaaaggtttgtttaatcattttgtgccttgatttttaagaaaacatattttctcctcagtaacagccatgcagatacaattgatgttgtcatagctcccttacataccacaggacttccatcatgttgtgtactcagagatactacaaggagaggaagatcaaaaaacataccaggctgtaagtcaatgatctttgaactttgtcttcttcaactttgtccatcaaataccctttaaaatttaatatatttggcaagtgcctgaggatccagtagtatagcttaaaggagtgaccaccacaataagctcagattcatgtaaaacttttcattcagctttataatttatttgttgtaatataaagatgaatttggaatttcttatcatgaagtcaaaatggtaatactgtaagttgaatcgcttttatcctgccatcatttatcatgagacattacatgctggacaatatcagcatccaccccaagtaccaacttcaagaggctgtatactagaattttctgaaagtcaaggattcattgtgtcacatgttcagtatgccagtcttgctgcttgaccacacaggcctcaaaggtggagctttttatgctaacattgctttttggttcctttcctttggattgacttttccagtccttttgggataaaagctggcagagaaagctttccaaaatttttcatctctaattttataccacatgtacttcagtatctttcatactacaaacctaattaaagtatccagttctcctaggatgataaataaaaacagctaagaaactggttttattaaatcaactttacttgatttatttagtctcccacacatttacttgattaaattttaagaacgaatttactaagattatgtgttgatagggtgtgtaacagtatttttcattcttaaaatgattcgtatttgaataaaattgctctggcttccctcttgcttctcacctttgccaaaatactgataaaaagacattctgtacagttttggggttttgaaacaacctgtatctttttaggtacatgacattagtcacattttctcaataattgaagtttagattatttaagtataaatgtaaatatgttaactacttactatataaacctctatactattattcaaaatatgttagaatctgcctttcagcttagtttttaaaataatttatagtctttccattttgactttagtatttagtgctgtcccttttagttatataagtgtaaaatatgtaacccgttcttagcattgtaggccataacatttatcacattatgtcattgttggatttggtttttcactactatgtggtgattgccttgtggagccagttctgttttcacagctatcattaagtagagttatggtcaggatcattcattaggtttcccagaaaacttctacaaccgtggttattgctgcaacttttaagaaacaccttatcaggagacttcccttgtttggttaatatcttatttcctaagctgacaggcagtgagtattctggtgatcattttattaaacatatgttttctattattattaaggtacaagtaacaccaaaattaaaactgagttaatatgttaaacgcacaaaaccctcatgatctcttctcagtctagccagcaaaatccacatagaattaattttgtccaaaagtgaaggaattctttgtgtataaagtcactacattgagaaatcacatttctcagataaagggaatttttttaagtattctttttttttaatactgatcgaataatcaaataatattacaaattataactccagaagaaatttaataaatctaaaaaagaaatcagaaggattaaacacttaattagaatttattagttgataggtactgactttcataatacggtcatgcagcacataatgacattttggttggtcccctgagattataatggagctgtctcttagtgatgtcataacatcatagtacaatgcattaccctctctatgtttagatatattttgatacacaaatccttatcactgtgttacagtcacctatagtattcagtacagtaacgtgctatatggtatgacctagaagtaataggccataccgtataacctggttatatggtaggctattccatttaggtttgtgtaagtacacactgtgatgttcacaaaacgaaattgcttaaagatgcatttctcagaacatatccctgtcattatgtgatatatgactatatttctatgttgagaacctgtatagttacaaatgaaacttttagactgtttatgttttcttttattagcatttggcacccaggttttatgcctaatatggtctgttttgactactgattatgttatcttaaagttgttatcgaccttaggagagttttgaactagtgttttgctttccctgttaaaaatattcttcaattgctagcccaaagttatgagctataacatttccattaaaaatctttatctaggccaggcgtggtggctcacacctgtaatcccagcattttgggaggtcaaggcaagcagattacctgaggtcaggagttcgagaccagcctggccaatatggtgaaatcccatctctattaaaaatacaaaaattaggccaggtgcggtggctcatgcgtgtaatcccagcactttgggaggccgaggcaggtggatcatgaggtcaggagatcgagaccatcctcgctaacacggtgaaaccccgtctctactaaaaatataaaataaaatacaatagccaggtgtggtggtggatgcctgtagtcccagctactcaggaggctgaggcaggagaatggcatgaacccaggaggcgaaccttgcagtgagccgagatcgtgccactgcactccagcctgggcgacagagcaagcctctgtctcaaaaaaaaaaaaaaaaatacaaaaattagccgggcgtggtggcgcacacctgtgatcccagctactcaggactctgaggcaggataatcacttgaacccaggaggcggaggttacagtgagcagagatcatgtcattgtactccagcctgggcaacagagcaatactccatctcaaaacaaaaaacaaacaaacaaaaaacctctaatatagactgtcagaagaggatttatgggtgacagactagtttatgattttaaatattaaaattctaaaatattactttatttttaaatttattattattttttgagaaagggtcttgctgtgttgcccaggctggaatgcaatggcacactcacagctcactgcatcctcgaactcctgggctcaagaggtcctcctgcctcatcctcctcagtagatgggactacaggtatgtgccacctcatccagctaattttttttttttagagatagagtcttgctgtgttgcccacgctggtctcaatcttctaggctcaagtaatcctcctgcctcagcctcccaaagcactgggattacagccacctcacctggcataaaataataaatagtgagtagggtaaattatatattatagcttctatcataccattcccaactcaaataggaagagatataaggtaatttaataacttcagttcgaataaagtaaaggaaaaggattattaaattgaatatctgaattatgagaacagattatgttcaacttgtaaactggtagtgttttcaaaagtgctttgttttatatcccatcatgttataataataacaattgacatctgcttcaaattcttggatatctaggcaaatttaaatgacttagcaatatgtattataaatactacaaaaacagaaagggcaagaaggagacttactgagctcattttatgtttgcctgacactgtatttataaatttggatgacttcgagaaacagaaaaccacactcagaatagcttaaacctgttgtttctcgaagtgtagttcccagaccatcagcagcagcagcacctgggaatttgttagaaatgcaaattctcagaccccatttgagtctgattaattagaaaccatttttggagcccagcattctggtataacaaatactccaggtgatattgatgccggctaaaacttgaaagccactgatttaggtctctaatgactagttctgtccagagatgagagccagcctcctcagaaacacatggctggaaggatacctgagcaaaatcaaggccacttcaggaaggagttgtaagggtggatattgaataggcaaccaacagaatagactatgccatgcttggtggtttttggttttgtttttaatatctcatttaaacctcattttggaacacacgtcatatttgttattttagaaaatgtagctggaagttatgacaagctttcaaaatgctgcttccaccaccaccaccaccaaattatataatattgctgatggttgttaggagagtctgtgatggaggggtggagtgtgaccacaatgcactgtatgtagaagagaactttcctggtgtgaagataatgatggtgttcctatgagggactgtgggagagattttagggtaaatgtagtggggctgaatgagaggaataggggaaatggttggtatgtgggggaggtagggtgttactgtggggtgtgctgtgccctgtgtgagtgcatgctggaatgtggaggaaggagatgggagtgggggtttggttgggatgcagtattgcgtgttagaaaggtagtgtgtgtgtgaaaaggtggcatcatgtgtgcatacaacaaagtgaagtggaaggagctgctttaccttaaaatggaagaaattttcaaatgtatcatcatgatattgatattctgattaaaactgaattctagatagttttagtttatatgtatttgtagtttatatttaatctttaaaaaattcacttctttgcttatattcaaaatatcactggttagtgaagtatatgtaggcatagtgaatataactaccttttcaagaaattagatgttagaaaatgcaatttaaaaacagactgtgtaacaggcagagggattttcaggtcactttgaatatttgtgtaggatttatttgtagcatattggcttggtttttacacagtcattctgtaaaattttagggtggaagagtccacaaaaggcatcttattgcttaaaaaatgttcacataaaagatacaatcttatagtactgttagctgtaagtaaggaacataattttatgactatatgaacaaataacaaaatgttcattcaaatcattcatgtgctttaagagactctggaaattatatttactacttttttgttactgggttacttttagtatattcatgtactgatgtttggaaatataggctctgtgtctttaaacttttgagccctttctttgcacatttgggtacagtgcaaccaaacttaagcatgggaaattctctcttccctccccagctttacagcctccactcaggactatcattgctatggatactacttagtgattagctctctctcttgtcaatcaaatctttgtctctagcaaactgttttgtcactgtagtaaggctctagtgctggaaatttatctttgacagaggaagaatgcttttgaaaacagttcttacgtgattttatgtaacttaatttgccctggaaaggaaatgtctcgtctctggtatgggaaaaaagggagaagacatcaaccaattaatcataaatacactctggtaaatcttagtcaattattttaatttgtatatatactagtcttttcatggtgacattatgaaaaattatacaatttctgaaagtttaagcatagaggatatttatagaatacaaaattttatgattgtacaaagtaccttgaagttgtttctgttaattctgagtatcttcaaaaagggaaattaataagggactgtaattttgtttcatattaagtgttttgtatgttctacaccaacaggaagatatcaaatcttaattgttgccttaatgttttttattttagcttaactttttagaaaaatattcagaattttctcttgcttgaaaataaattgaatagaacagagtaaattaattattattgactggatctcaaaccagattcttttatgatattgtttacttaagggtataattttaagaatctgactaaaaggttttttaagctgttcaaaaagttttcaggcaatgctacctaatacaaatcttcaaacgatatcctagtaaggaaattcagtcaaccatactattgtaagaattttatttatttttctgtacgtgtacattgttataaaatgtattgtccattgctctttctgtggtaatttgggattatattttgcttatgaatgtttattttattttcacttaattgtagatgatttaaaatccaataaggactttggaagatgcccccaaagcagcttgccgcccttaaatgttaagtgtgtcaaaatattaaaattttaataggtgttatttttaattgtaatttcaaaattcatttatatgttacatcagcacagagggatttaggcacctgaaatgattgaatttttaaaatttgtgattagatttaccagataaatcagttaacaccgttgttttttttttaaaccaagaacaatgaagctattcatacattttttttatttgaagtttgaataatcatttattcttagtttgcaaagacttcaatacagtttattacaaatacaagcaaaataaattgtggttattctgaaatttataggtcaatctaattaatgtgcatcaaacacttacatttattacagtcaccacgtccaaggcctgttcattctttatttttatttttatttttgagacagggtctcactttgtcacccaggttggaatgcagtggcgggattttggctcacttcaacctgggctcctgggctcaagtgatcttcctgcctcagcccggcaagtagctgggactgcaagcatgcaccaccacagcccgctaatttttttgtattttttatagagactaggtttcgccttgttgcccaggctggacttgaactcctgagctcagctcaggagatctacctgccttggcctcccatagtgttaggattccaggccactgcgcccagccaagttctgttcattcttatgggaggctatataattttgtcagatactttatttcatgcctgagcaagaatgcttcctactcattggtcattagctctgcccatacatatatgttatttaattgaaccctcacagtaaccctgaaagtttagtagaattatttcccattttgaagactagttgaagcatggagtggtcactgaactaagttgtcatgtagtacagagacagcttgaccctagcacatattgtagttcaccaggatgactttgaagtttttctgaaatagaacaatatgatgtgttttgttgtgtagacaagctgaagtcccagttttctagttgttttctttgttttaaagcagagattctaggagctgtagggcaggcagctcttaagaaaattgggatgaaaaggattagcagttcttttacctgctttgtagattgagagccctgtaagattttgcctgacaaggggctcttatgcttctaaactggaaaaaaaaaaaaaaaaaaaaaaaattctaagagaataaccagtatttcagaacaaatgaaatttgactttttggagtttataatgtgtagctttttagaattcttcgtctttacccaacaaataatatggccatattattactacctctgtaagagagattatcactgaggtatctatagataccttgacagttttccaaatgcctatgtatgtagtatcacatgaccttacagtaaccctgtgtgttaaccagattgttttgttttataagtgagttaatttacatctcaaatacattaataactaataagcagcatacactcctaacaaaatgcatggcatgaaattaaccttttgccagttagcttcgatgagaaccatattgatcaagcatgcttaagttttgttatcttttattttttaaaggccgttttatagtttattctgataacttaaactttaatcattcatttatttgaagctattcatgtatttgatatattcatgtgccatactctaccttgttagtgtctgtcaataagtcgtaatttacttgaaattataagcccattttataataaggatttagtcttaatcaaagtcacaagtcattaaatagcatcagtgtttcattgcctttatcagtagtcactaatttcatcaccattttcttagtttaggccgtcatatatgaacagactttttttaaatttaggctttcatatatgaaaacacaggagaaaagtttgtatgtcgaattgtttacatctgttcaagaattagctgacaggtggatttttaggaagagctaatttaaatgtaaaaatctttccagtgacttcagcctgagataataactataatgataaaaataattacttgtactgacagtgtataccaaatattgttctaaacacttaatatgagttaccttatttaattctcacaaccctgtggaatattactttatcatctccattttacaagtgaaaaaacagggacatagcaatcatactacaactagtgcaagtcagagctgattttttaatctaggcattctggctctagctgatgcccttaaactctttgccatacttgccctcaaaaatcttcagaatataacaagaggaagagaattatttatttcatatatttaatgtatcagaacctattttatatatactttatacatattatttatttctcataaaatgtaaagtatttccatttgaagaatcagaaatggggaaactaaatgaggctccctaagttcacaaaactaataaaaatcagaatcaaaattaaggtagcagtctaaaaccaaagccagtattcttcaatattatgccgcctatctatagtagatagtcataagacatttattaaccagtatttatgtatgtcttatggtaagtgaaacatcttctgctctccagtcacaacctagttgaaaaaagtatacacatatattcaatgtagaatattttttcttaatttatttgactcaattgttttttatttttcatttaaagaaatttaatagcatagggggctttccagtgaaatttaatagcatagtggtcttccagtgaagaccagaaaacctgctagataaattctaagagagctgtaacactgactcagtagttgaaaagcatatatcttatgtatgcaagttatgaggcataatagtaaaatgaacatctgtgatgtaccactacccaatattagaactagaatatcactaatgtagctgcatctgtctgtgtgttttttctcatcttgtgtcaccctcatattggtaaccacctctctggattttttgttttattatccccctaactttttttaattataatagatttcattttttagatcagtattaggtttacagaaaaattgaatggaaggcatagagagtttccatatactctcttttccccaaaacacagttttccctgttattcacaaatgacattagtgtgatatatgttacagtgtatgaactaatattgatatattgtcatgcagagtctatagtttacattaaggttcattctttgagttgtatattctgtgggttttgacaagtgtataatgacatgtatctagttgtagaatcacatgctataatttttctgccctaaaaattccctgtgccacagctatttatcactcattcccttccagtgaacacctggcacccaccggtctttccactgttttgcgttttgcagagtgtcatatagttggaatcatatagtacgtagccttttcagattggcttctttcacttagcaatttttatttaagactccttcatgtctttttggcttgacagctcatttctttttattgctgaataatattctattttatggttttatccacttctttacccattcacctggtaaaggacattttgctttcttccaccttttggcacttatgaaaagaaactgttacaaacttttagatgtagattttgtgtggacataagttttcaactcataaataccaagtaacatgattactgtatcctatgttaagggtgtgtttgctaggccagtgtggtgactcacgcctgtaatatcaacactttaggaggctgaagtgggaggagtttgcgatcagccagggcaacatagttagaccttgtctttaaaaaaaaaaagaaagaaagaaaaaataagaaacaaagaaagaaagtaaaaagaaactgccaaactgtctttcatctggctgtacccattttgcatggcatccacaacaaatgagaattcctgttctccacatccctgctgacatttgctgttgtcagctctttggattttagcttttatttaaatagatgtgtagtgatatctcaatcattttaatttgcatttccctggtgacatatcatagtgagcatcctttcatagtcttattttccatttgtatatcttctttaatgagatgtttattcatatcttttgtccatattttaatcaggttgtttgatatcttactgttatgttttacataaacatagagatagaacagaccattgtctccttccttcctatctgtattccttcatatattttggataacagtcctttatcatttatatatgttgcagagattttctagtctgtagcttgtctttttcattctcttgacagtgtctttcacacagtagaagtttttaattttaatgaaattcaacttaataattttctttttcatggattgtacttgtggtattttatctaaaagtgcaccttcagacttagggtcaccaagatttttttcctgtgctattttctaggagatccatagttttgtgttttcctctgtagtccatttggtataaagactttgtctcaattgactgttctgcaggtggatatccagttgttccaatactattggggtaaagaccattatttctcctctgaattgtctttactcctttgttaaaagtcagttgactgtatttatgtgggatatttctgagtgttttattgtgtatcattgatgtatttgtcagttcttttgccaaaaccatgatgtattgattactgtagctttatagtatagtaagtcttgaagttgagtagtgtcagtcttccaactttgttctttttcttcattgctatcttggctattctgtgtctttgcatataaactatttctataaattttagaatcaatttgcctgtatctacaaaatagcctggtagaattttgattgaaattgtattgaatccatacatcaagttgagaagaactgacagcttgacaatattgagtcttcctatctatgaatgtgggatatgtatttaaatcttttgttaatcacagttttctactttttttcacgtagatctctatgtattttgttagaattatatgtatttcatttacattatgctaatataaatggtattctttttaactttcaaattccaagttttcattgctgatataaagaccattgacttttgcatattaatcttgcactctgaaagcctgccatgatcacttattccagtagagttttggttgattctttgggattttttataccaacaatcatgtcatctgctaacaaagacagttttatctctttcttccctatttatataactttaattttctttgaatttaatttatataactttgtcttattgcattagctaggacttcctgcataatgtcaggtaagagtactggcaagggatatcctttccttgctcccagtcttagtgtgaaaggatcttgtttctcactattatgtgttgtattaactgaatttttttaatacatgttctttatccagttgagggagttcttctttattcctaacttcctgagcatttttattagtgttggattttgactagtgcattttttgtatctgttgataagatcacatgatttttcttctttaccatgttgatgtaatagattacatcaattgattttcaaggctgtaccagtcttgcgtaggtgggataagttctacttcgtcgttgtatataattctgtacatttgtacattgctcaattcagtttgctagtgttttgttgagaatttttgcatatatgttaatgagagataattgcctgtagtttttctttcttgtaaagtttttatttctattagagtaatgctgtcctcacagaattagttaagaagtattccctccgcttctgttttctggaagagattgtggagagtttgtataatttcttcgtaaatgtttggtagtattcatcagtgagtctatctgggccttgtgctttctgttttaggaggttattaattattgattaattatttaaatacatatctttctttctttttttgagttggagttttgctatgttccctgggctggtcttgaactcataggctcaagtgatcctctcacctcagcctcctgagtagctgagataataggcatgcattatctgtttcttcttgtgtgacttttggtggtttgtgtctttcaaggaattggtttgctttatctagattatcaaattagtgagtgtacagtttatagtatttcttcattattcttttaatatccatgggatcagtaatgatggcccctcttcatttctgatatttattctctcactctcatctatcctggctagaggtagaggtttatcaattttattgaccttctgaaagattacaaaattggcttctggttccattgctgtttttctattgattttgtttttaatctattgatttctgctctaattttattttcctgtgcttcagatttaatttgattccatattctttcatctcttagcatctcagttatacttttttaaaaaacttttttaaatggttcctctagaatttgtaatacacattttttttagtatagtttacatggtgaaaccccgtctctacaaaaaatacaaaaattagccgtgcgtggtggcacacacctgtagtcccagcacacatctgtagtcccagctacttgggagactgaggcagaagaatcacttgaacccaggaggcagagattgcagtgagccgagattgtgccactgcactccagcctgagtgacagagggagactccgtctcaaaaaaaaaaaaaaaagaaaagaaaaaaaaaaggatatggggatatggctccctcccctcttccttcccttttttttccttttcccagtattgatgaaagacaggaagtgattttaaatgcagattttttcaaatcaaacttcactaatagaattaattctggatttttttttttttttttttaagacaggattttgctctgttgcccaggatggagtgcagtggcttgatcttggctcactgcagcctcaacctgctgggctcaggtgatccttccacgccaccaggcccggctaattttttgtatttttttgtagagacgagatttctccatgttgccccggctgttctcaaactggaatgttattttgaaagcagtagttttaatttgggcaaaatggggcaaagtttaacataattcaggtcttattttgtaataaagactgttaatatatgatgagatatagtagaacaacggcttatgtgacttcaaggatgctgttgtatgctctttttgtttgatacagaagctcagaattatatttccttctttaacatattttttgagaccaaagtaagtgtaagtggcattgattagatagtatttctttttctcttgcatttccatttactgagaaagtagtaaaaatggcacattgacatataactagcagatttttgttagtgtgcaagacattgaagaaagggagatttggggtttgttttggagtaatcttggggaaacactggaacgtccataaggtattgttctttatatctaagagatgaacgtgttcttaatcatgggattggcagcaactgtgaattttctctagtctctgtttttgttagtccatttgtaatagtgatgggtggatttacccctgcctttccattggtaattctgtagaagtaaaggcttaggaaaatactttctctttgtgagggtcctttgtcaaagactgaaaagactagagagtggcatttaattctgcagagtataggtcatggtacttagttcctatagataggagttagcagtatatccaaatactttattccttaagaaacgattttttagccagtgaatgcacttttaattggaaggtcttggttttctcaactgtttactcctaataattcagagcgtgataagggatattttggagaaatgtattcattttttatttaggtttaatcttttgggtaaagtaataaattgtatacatggagtatggtttaccaagggtttaaaattaatgtaagagtaattccagtttcctcatatatactgggaatatatagctcttttatccctttattttgagagaaggaagtatatttctgtactcaaattcaaatctcttttttctattaactcacagacttttttttttttcttacagttttctgtatcctcacccatcagggcatgagtaaatgtttaaggttaaggaagcagaaagtttttaagtcctagaaaaaaatataattgaaaaaaataaatttgaaagagtagatttgtgacatgaaagaaactatgactttatcaagtgttattaagataagcttagccttatggcgatttattgttctcttattagtaactcctactctcagcaatgctgatacaattaggttatgactgatctcttttgtaagcataatttaatttcacttccacccaggaagtgtttttcttatagtaaatgaaggagttttagaatatagatataagataattgttaactggagggatagaaggaaagcagagaattagataagttatttttgacaatccttgtctaggagactattggattgaaggccatgaaaaaagaaagaaaaatataattggccattaaatatttctagagacctgttttgctgggcatagaaaagcaagcccatgatgttttttatttttagtacctaatttttcttttatctttattgaaatcctattgttcttaattgaaagtccttcattatttttatctaatactgaaatataaaaattaaattcagaataatcaaaatgttaaaaatagttgagatgtcaaacctgaaatattctcattcaaaaataaaaaccaaaaattaataaggaggctctttggccattatcatttagtctccagggtaattggtgaaaagtaatcaagtaaaagtcatatgaataatagtagttctcattaatatgttctgggcactatactcagtccttaatatgcatttcctcagtaattcacataaaaccagatttgatatgcacttttactattttcattgttttataacaaaattgataggcaatggggaacccaggtttatctgacacccccccccatccgcccccagagctagagagaataacagcttctggtttctaagtacagagtcagctaacatattgtatgctttgttgcttcacaaaattcaatataataataatggccagaatggaaatctgtccagcctcttttccttttttctattctcatgtctttcagaactttcaacaagtttacatagcttttcatagttaccttaatgtttactggtagccagttccttttagttggctaaataaaaagcctttaaaacctaggttcaaaatctaaactctttatgagccagttggattaactcattttgtggtcagagcctctgtgcatttttgattgattacaagaggaactagtcatagctcaagagaatcgtcacatatttatcacaccattagcgttcactgtagtatggtaactgtttttagaattatgtcatgatctgaaaaagctgtaactattatgtcaacctgaggaaacttacctgtttttgtgggctttctgtaatagtgtttatctgtcatttatggctttcaaatttaatactgtgcaagagcctggtctaggcaattatagaagatagaaagttttcctttgaaagttaaaatgtaggaaagttgttaaattttagtcacaaataaatgatacagtaaaaaccataaagaaataaaacaggagagaggcaaaaagtggaaaaaaaaagtcatttaaagggctgaagcagacatacttagaaggtacttttgattagacatacttttgaaaatctaattttctactttctagagcttatttttcttattgccataggttttaaaatgtacttctatattgttttcttgctcttctctcctctgttgtttctgttatagatgggtatgtttgtcacctgtgcctagaagaaattcttccagcatggccattaggatataatgtttgagctcacctgatttggagggggtagttgaaactaccacttcctttgtaactgcaagaccgtttagttttcagacgttatctttaatgttagcaaagtatgtgttttatatagtgttttctgtataaaaaactataatttctatttactaagttgaatctatatggaatagtccataaaataaaccttacataccaactagttggatgtagtagtgaaaatcattcatggatatttcactctagtttgatatataaatctcttggattttcaacatagagtggggaagaaatcctaattacagttctcttcccattttaatttctcctcttttttttttttttttttttttttttgctgtttttctcaactgtcagtggaattattgtcttcctgtctccatatttaggtagtgtcagtggctgagtatcaccgcaggatcgatgctctaaatactgaagaactgcgcacactctgcagacgcctccaggtgcccccttcagtagtttaaacccctccagagactaaatactccctgtttttagtgttctttgtcatggcaaatctcatttgaagaatttgctttgactgcagcactaaaattaaattcctttttgtattaaaggttatagtattgccgtgaagagctgtggattatcttttctgtcatcttttcatttgaaaaatattctgaagaatgttctgtcacttcagaattattctcagtattgtgtgtttctttcagcgatgaggagttttcattcatttaacgttggaagaatggtgttggttttgagattgaatcttttctaaacaaaatctgaaagatatggtactataggaaaactaataaaaaatttaatagcaaggcttaaatattttatttaaggctatttcatttatatcagcgtcacatcaaatatctcaataggataaactgttcttgaggcattcttggttggtattaggagtacattggaatagtacagtttagacacagaactggataaattacttaaaattctgtgaaataatctttgtgattttttttttagaaacaagaaagcaatgtaattgaaaactcatttttaagttgtgtctattatactgtgtttctttcttcttaataagatatgctttcatggctctgctagacctgaattttttcttttaatgcttctaatgctgccttgggtttctttttctttttctttttacctttcacatcatcaaaataagggtgaaacatgatgatatgaaagaatgagtatttagcttcttgtcaaaaaacaatacacttatagaacatgtattggttgcaaatatatgctgctcaggtttgttaagaaacctgttaaaggaacaaaataatttagcaagaatttcattcccatatagaatcacagttgctgagcgttgctgcattttagttatctgctccaatagaattctgcatattttccaatttaaaagtttcataatgtttcatttcttttattttctaatattattatgttttatatattaaaataaaattaatattaaaaagtaagcaccaatagaatatattgtgcagtagtaagctttatttttacttagttaacattcttatcgttttaagaataccagtgaaatcatttccaccaagcaaaaaagcatgtattctttgtaatgcaacacattaatctaatttaaaaaataaatttatgaacaaattaacagtaaaatttattgtttggtccaagtagatgaaaaaaattaaatgtttagaaagttataaaaagaaagcatttaaaaaaatggtaacgtttgtcagtgaaacaaatacatgcacaactcacagaaaatagttatttttttttattctactattctttacattaaaattttggcacccaggaagttttgttcattatttttgacaaattttgtgttagcatgaaagaattctattttaaatagcatacacacacacacacacacacacacacacacacacacacacacacagcgcaagccagctagctgacttttgcccttcaagggcttaattaaagatgcatgcaactatcttctttacacagaaatatggggatttatcattcctaccagtcgttcctcatgtagtggatgagaaaacgtctgcttatattgttataaaatcttttcctacattggctacatcatagatattagatatgggccatcttttgccctataaaatcttaaggttaaagatttagccacattttctacgatataaagctttatttatctgaaaagtctgacaattttgaaagcatgtcacaagtttacattaatgcactacctctatttactgttttagattactacaagggaagacataaattcaaagcaggttgctacagtgaaagcagacctggagtctgaatcttttcgaccaaacctaagtgatcccagtgaacttttactgccagatcaaattgaaaaggtatgacatgctcacatatgtgcatttctgagtgtgagtgtgtacccatgagagtaaaacagcctctttttagttgtttctgaagcaacagcgttaatgctattactattccactccagtgaaaagaaagagtaagcaaaacatagcaactagtgttaattaagatgttaggagatttaggtaagcagacactaaaagccaatatttgttttattgttgtgtgcttgttacttgctttatgtggattatttcatgtagttgttacaacagctgtagaaattggatgctcttattatgcacattttttattaagttaaaaaatcgggagcacagagcgattaacttgttcaaggtcacacagggagaagtattaaagcttgattcctaacttggatagtctgtctccctagcctattatttaagagatattttaataatcaagctaatagtctatcaagtatttttgttaattcaatatggaaggcaaaagcattaagtaatctatgtttcttatctctgttctaatctgtgtctggttcagggtgattctttattttcctaatagacaattaatattttattctgagaaatgtgtaatacttttcaatcatcttagtatctttgagaataataatttctactgttaatttatttttatagcctatattatataggcaccattacattccagctggcattagtattctacataatgaacaacaagctatcaagtaaatactaacactttgttttctaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtatgaaacaccaactgcatagattgcttatcctttaagagcagtaacagtaacttttagcatatttatttgataaacattactttattagtgcattttattgtttaactgataattactgggtacttttaatatgcaaggcaatgttgagtattacagaggatagatatgagcatgatgattaagaattactgccttcaaagggattatagagtggtagaaaagaacatttgcacataccaacatctctaatggtggggaaaatggtaggtttcttagaacctagaaaaagtgaggaaataagaatgaggttcatgggaaaggtagaaattgacagaatcttgaataatgggtgaagttttgattaaagataattgtttgaaggtgatagccagaacaaaagcacaaataagagtaatattggtttgttcttcaaacagcaagttcaagtcagttgtaattggaaactaatgagaaggtaaaatagcaatattagaacaaaacactggtattactaacacttttagtgttttatgtgtcaggaacttgactaatcacttatgcattatgttatttaatcatgaaagccctatgagattgatactgttatctttatattaaagaatgagtcaactatgacataagctcatcaacttgcccaaggttacatacccaagaaaaagtatttgcaccaatgaaaatgaatgaactgctgctacatgccatggcataaatgaatgtcacaaacataatattgaattagaaatcaaacaccagagagtaactttcttatgatttcatttatagaaagttttatcagtgggccaaatgaatctatagtggtattaggctagtaactccttcaggtagttgagactattgatgagaggaagcacaaagagagcttctagaactagtagtgttctgtttcttggtctgaatgaatgttgcatgggactttgccatgtgatagttctaaactgagctatgtgtttatgttttgtgtacttttctataatgtatatgtaaaataacctttcaataaggaaatattttcaaaattaagactataaagatagaatgtcaggatagacagtgactgtacagattatctgtcagactctctgcactcccatttctgatgtggaaacttcagcccataacactgaaattacttggtcaatctcttattcatcaattttctcattagggtactgtgtgtcttgtataagatcatgcacagggttaaaggacaaaacaattcacacataacacctgccctcatggaatttactgtataatgataaagaaaaaatatcatattttaaaagtgatagaatgtttccctatactgaaggacttattttattaagcaccgcaatcccatagcatcatgttatccatatcatacatacattgtacatataagtcgtcctgaaatgtgttaaccactttttaagattgtctgcttaattactttaaataaaatcccaaaatttaaaaactaggaaaaaatctgtatttccattgaaaaaccaatatacttcatatttgacaataatgtaaattatatagcagctaaccatttttccctttttaagtatgattagattaaactataccagatttctattttttgcattttatttaaacatatatgatgaaataatgcttactggaataaatttgttagtcgtgtcattgaatatgccttttttatccttaggtttttggtgcgttagcatctgagccactgaaagtgagtgatggcttttatggtactggagagacctttgtttttacattctgtccggagtttgaggtaagaaccactatttcaatattttatttataaagagttgacataacatactgcccaaagcaatttatagattcagtgctattcccattaaactaccactgatattcttcacagaattaggaaaaactattttaaagttcatgtggaacccaaaaagagcccaaatagccaagagaatgctaagcataaagaacaaagctggaggcatcacgttacgtgacttcaaagtatactacaaggctacagtaaccaaaatagcatggtactggtataagaacagacacatagaccaatggaacagaatagagaactcagaaataagacctcacacctgtaaccatctgatctttgacaaacctgacaaaaataagcaatagggaaaggattccctatttaataaattgtgctgggagaactggctagctatgtgcagaaaattgaaactgaaccccttccgtaaaccatatacaaacattaactcaagatgggatagagacttaaatgtacaacccaaaattataaaaaccctagaagaaaatctaggcaataccatttaggacatagatacgggcaaagatttcatgacaacaatgccaaaagcagttgcaacagaagcaaaaattggcaaatgggatctaattaaagagcttctgtacagcaaaataaactatcatcagagtgaacagacagcctacagaataggagaaaatttttgcaatctatccatctgacaaaggtctaatatccagaatctacaaggaacttaagcaaatttgcaagaaaaaaaacaccattgaaaagtgggcaaagacacttttcaaaagaagacatacatgtggccaaaaaaacctgtgaaataaagctcaacatcactgatcattagagaaatgcatatcaaaaccacaatgaggtaccatctcactccagtcagaatggctattattaaaaagtcaaataacagatgctggcaaggttgcagagaaaaaggaatgttttattttgttgttgttgttgttgtttttgaggcagagtcttgctgtgtcgcccaggctggagtgcagtggcatgatctcagctcagtgcagcctttgccttccaggttcaagcaattctcctgcctcagcctcccaagtagctgggattacaggtgtacacaccatgcctggctaatttttgtatttttagtagagacggggttttgccatgttggccaggctggtctcgaactcctgacctcaggtgatccaccctcctcggcctcccagagtgctgggattacaggcgtgagccaccacgcccaactgaaaaaggaatgtttttaccctgttggtgggagtgtaaattagttcaactgttgtagaagacagtgtggcaattcctcaaagacctagaggcagaaataccacttgacccagcaaatcccattactgggtatttacccaaaggaatgtaagtcctcctaatataaagatacatgcacacaaatgttcattgtagcactattcacaatagcaaagacatggaatcaacctaaatgcccatcgatgatagactggataaagaaaatgtggtacatatacaccatggaatacaccatatacaccatgcaaactaatgcaggaacaggaaactaaacaccacatgttctcacttataagaaagagctgaatgatgagaacacatggacacatttcaggggaacaacacagaccttgtgtctgtcgcagggtgagggtgtggggagggagaggagagcatcagaaataatagctaatggatgctgggcttaatacctagttgatcggatgatctgtgcagcaaaccactgtggcacacgtttacctgtgtaacaaacctgtgcatcctgcacatgtactcctgaacttaaaagttaaaggaaaaaaaagagaaagagatggcataaatgaaaaaaccatgcactttggagtcatgcaagttgcatctgtcccctatctttgccttttactccctggtaacttttctttgaccattttgaacttcaactttcctgtagatagaatgaggaatcataaaatatggcatgatcatttaataattaaatgaggatcatttatatataatacttgggatggcaccaaacacaaattatggacttagtaaagaatatacattatcattactattctgtttacaaattgtcattgtgaaatttccagaaacatttaatgactaagcttaatgatgtaagtcatgaaagcataaaaaataaattatttggatttaaataacaagttattgactggtttctttttctttacctgtgtggctttactgtggcttgactaacacaaattgaatacattctcatgccaataaaatctaaaatgtaaaggtataaatgaattttagtgaatgtgtgactattcttaaaacattgagtgcaatattagtatctcgggcacattggagtgtggcatgtaaaaccttcattttaatctcaagaaaaggaatcaacaccattggttataaaaataaatgaagaaaataggaacgatttggtaacacaataaaaattcttttagcaaatttgtacttaactagctcaccagaataaccaatgcttttcattccttccataaaatatgtcaactgatagcaacagctacttgaaagcttgtagttattacagattttctaagcatcagtggtgcctattctcaaactttttatgttactgctacctgataagtgtaataatgtagtcaattaaatgttacataactatgaaaaacgagtgctaaaagaaagttttattgaaaactgtaatgaacacattttaaaaacttgataaaagtaagttgctagaaattgctactatgttaggtttaggtaaaacacccataaaaggttagaaaaagatatttaagaatattcatgtctagtttgctcttggatttctcaaatgattttaagttctcactgtttaaagaaattgaaactgaaaatcataaatacccattatggtcatggtttatttaagaactgtgatcagtaaatatatatgcaaagaaaaggccttggccctatgttaaaatattatccaattaacatacatttctgtttaatggtaaaagttaatggcatttgtgtccgattttttttcaactcatttacttctttctcaattttttctattaaccgtccaactcttggtgtctgtagagtcaggagaaagaagtatgtgtgaaaagttaacaaaattttgagaaattggaattgaaagttaagtgatagagtgtgtgctttcaaatttagtcatataaacactgaaacccaaaccaccagagccttctgtgcggagctttttgtggtgttcttattcttatactgccagtcttggctttgttaactcgtttgagttttggagaactaactctctataataaccatttcatctatatatttaaagctttttttaaatttatataggtctttaagtggacaggagataatatgttttttatcaaaggagacatggattcactagctttcggtggtggagggtaagtctcttgaacatttcactatgagatttttgaagaactttaaaaatgcatttggattatttataaattcagttgtctttagaaagtgttgacgttagaattcaaatttgtatattatgaaaaagagagtataatgtatttgcaagaagtagctcaagtgtagttattgaaactattgatggagtatttgtttcttcattttaaaatactgttcagtttattcactgtttattaagacccatctttttctttagagcacagtggctctttgataatataaagggaaatatctcagtacctttgaacttctctaatttttaaataactgtgatggaatattttatttctcccaatgcatagaacaagtccaattgttttcatgttattctactctggagaccatttggaatgatattttagacaataatggaaatggggtttttgcttgcttgttttttaacaattatgaatcagacaataatgtgattatcttggcattgcaagtactgtgaggagctttgttttttatttggtatcccagcctcctttaatctttgcattgttgggaggtaggctgctctggtcccacctagcctgggcttagcaagcaacaactccttcctttggtatttctgtctttcagtattagacatgggtatgctaaataattttcagacttgtaaaagtgttacattatttgtatcccacagttgaggatatataatgataatttattcagaccaccaaagaatattcatcatcccaggttattctattattaacaaattttcttacaacttctctgtaagtaggtgtttggaggatataagtagggtgattaaaaagtgatcatggttattgtagccttctctgttagttttagttgttgaactcagcatgtatttacatggtccaattataccttttggggggggtatcattcagccctcccctaaacagtagtcttacatgtgattctgttagctctccaacaggtccactcaatctagtggcttataatttcaagattttatgggtgctttaagtcttcaaaaatgtcatacacaatgccattagatgtctgctggaactagattttattgtacaacatgatttcaccaagctagagtaaccactgggttatttgataataaattaatataagttttcagtgtttaaaggagagtacagcttcagaaagcagaaactacagggagttgatattccagaattccaagggaaaagcaccccaaaagaaaaatgatgtagtggacttaatgtaggctttggagtccaatagacatgattcagattctcacttcaacatatgctgtatgtggtaccttgagcaaactccttaacaaatctaaactttccttagctataaattggagattaaaccagttttgtagagagattataaggaattcacaaggatataatttttgtgcaaatcctagtatagtatctggcatatagtaagtactcaacaactgatagccacctaaactgatagccacctttactcattttctttcatccaacatgatctgttcccttctgataccaggaagaattctgcctgcagtatcattggctgcatgagctataagacattaattaaagatttagaagactacttttattccttccacttccttagccattctcttttcagaaagtcgtatgaatcatctttgaaagcattgctcatataaaaatacactttctggctttctgggtgtttcacctgggacagatctgtaacctcttaaatacatttacttaaatatttggatatcacatacctttttgaaatgctgatgaaatgcagaggtacccattgtcctaaaatgaatatacaaataatccaattttatatgtgatattaagaaattgacaaaaatgttgaaagcttctactcagggcttcagaaaattcaggttaccttggaaaaaactattcatacttggtaataaaacttactgcagcatcagtgacattcatgaatcttgaaggtcaattttgaggtactacttagatgcagtcatctgagattacaactagatgtcttaatcttttattaaccctttcatatttagcagaaggtttttatgagcaagtctgaccctttcatattctcctttctaatagattggctatgatagtctattcgcgcttttaaggctcatggattcagatatctctttaaaggcatgttgttgccagtagagttagagtctctagaagtctattgtcataagaccataaactttttaattcaaatgcgtttctaatttatctctgtattttccagtgccagtgtctgaaacatgataaatgcacatttaaagttgaacaaattagacaaatatgaatttcaatttgaaccttaacaaatgatggcttcctcatgggacagggggcattttggggacgatatagttttgcagtgcttctgtatcacagactctggattgttatgattttcagggtgttcttgtatcttagcaaagtcccattttcatttatagaagaggttcatcagaacgtcatcactggttatcccattacagtttttttgtactgtcaactctcttcttgagtgacactggatgatctctttacctggtcattgtgaattactatactgatctgtcttttctgttttgttgtgaagtaccaactctttttttttttttttttttttttttttttttgagatggagtttcactcttgtcgcccaggctggagtgcaatggcacaatcttggctcactgtaacctctgcctcccaagttcaaatgattcccctgcctcagcctcccaagcagctggaattacaggcgcccaccaccacgcctagctaacttttgtattttttattagagacagggtttcgccatgttggccaggcaggtcgcaaactactgacctcaggggatccaccagcctcagcctcccaaagtgctgggattataggcgtgaggcactgcacccggccccaactcttaaaggaaccattctacatggtcactgtagccaccttctctacttagaaacacatctctatacttaaaatttgtatatgtaattaatatacattatatatttgatgctgttttttattacagagtataaataaatagttcctttcttttgttctaagatagtgttaaaaatagatcagttccaggccaggcacggtggctcacgcctgtaatcccagcactttgggaggctgaggcgggtggatcacaaggtcaggagatcgataccatcctggctaacacagtgaaatcccatctctactaaaaaacagaaaaaattagccgggcgtggtggcaggcacctgtagtcccagctatttgggaggctaaggcaggagaatggcgtgaacccaggaggcggagcttgcagtgcgccaagatcacgccactgcactccagctagggtgacagagcgagactctgtctcaaaaaaaaaaaaaaaaataggtcagttcctctcccacacaagtcagttaactctgtaatgccatgtgactcctgatggcaagcctgaaggtcagaggttatagccacccaaattatagagttgtgtaagtctttacaattacctaatatgcttttcttttttgtgtgttttaatataattgacaaactctaccccagagaggttaagtgacttaactaagtttgacataagttgtggccactgagttgacagacaagtcttgatcccagaccagtttttttctttcaatgaaatataactgcccatattttttaaaaaagcctccgcctcctaaactctggctcaattctgctgacttgatatattactttagatttagagaatcccaagggatagctctctggatattatgttaattaatagtctttgccccctctcctcttctattaggtaggaaaacattttctagagaatagaaagaagtcctctcataacctggtgttttcccctctcggttatgtattagataattagataaattggaccttataatctatctgttaagttcctgttatacctagattatatcttggttcttctgcttgaatctcaacatcacatatttgtccatttaaagtcctttcaaactgagctcttttgcaaacagcttcctatgcaggaaaccagagttatttactaggtccttaacatgaatccccaaattttattttagatgatactgaatttttgtgcctttgcgaaagtcatgttaaatatgttaaaaccataccgaaaagataaacacacacatacacaaaaaaaaaaccatactaaaaaaaatacccaaagaaaaactcataataccaggcaaaaaattacagcgtagtacctgtctcaaaagctaatcctatataaagttcattatagaggacactgttcctggtctgtatcataaataatttttttcttttcttttcttttcttttttttttttttttttgagacagagtttcactcttgtcgcgcaggctggagtgcaatggtgcaatcttggctcattgcaacctccgcctcctgggttcaagtgcttctcctgcctctgcctcccgagtagctgggattacaggcatgtgccaccgcgcctggctaattttttttgtattttttagtagagacagggtttctccatgttggtcaggctggtcttgaactcccgacctcaggtgatccgctggcctcggcctcccaaagtgctgggattacaggcatgagccaccacacccggcccataaataattttttaatggaataggagtaaaacaaaattgtgtcagtgtggaaaggagtagggaaggatttgagaaaattaataactttagggttgttaggtattcaaagtctcatttaaattgttttataacttaaggcataaatattaacagattattatttatgtattgcagaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtgtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttccccttcggtcttccacagcagtattattgtctttgtggagttgactaatgataatttaaaaatcctgtaatggatttctactaaaataaggtcatagtggcatataccaaataaaatcaaatacagaaatacaa

SEQ ID NO: 1464 - DNA, 482516 bp, Homo sapiens
atgtctgcaagcgctcagcggcgccggcagcagcggggctagagctgggctgcgtcaggctgagcccattcacctcgcggccacaggagctcagcgccggcgccgcgccgcccagccccgccgagaggggcgcactcgccgccgcggggcccgccgccgctcaccgcagccccctcctggcgacccgcaagtaagtttgtgaggctgctgggcgttagggcgagggcttggcgcccgggggagtccaggagggatagcgagaggcgcggctggcgcccgggagagccggctggcctctgccccctgtgcctggcgcctctccgagccacttagccaatttgaaagcgggtggccattgggatgctcgagcggggacgacgggcagagcaggagggcagaactagctccagcgggggcccagagggcggacttgggaagaaggaaagaccgcgcggcgagggaggagaccgggcggcgagggaggagaccgggcggggaggctgggtttggggcgcgggagcccggccagggacagccgcagaaggaaagtgggggtgtcgccgggggatagagtgggagcagcgtgagagcagtgttgggggcgcagagtggagggcaagcgtgtcttgaacagaacggcaggaggatgggtggaaagtggggcgcgtggaaagcggatttggacgagagcaaaggacgccggtggaagggacagtgggctccggaggggcgagtggattcggataatttggggaatcagtaaaaggctagggggcacatcatgatggagtcagcctggaatctgtctcccgctagagtacccgaggccacatgttgggaactggctggggaaaggatggatgtagaaagtggcctggagggccgactggaaaatcgctgagggatttgggtgaagagggggggagctgtgcagtatcgggcggaggaactgggctgctggtagggcctgaaaggttcaggagagggttggaggcttccccgtgccgccccttgaatagtgatttagtactgttatctgaggttcactttcacccctggctcctcctccgtctactacccggcttggacgcacctcggctcgctgtaggcgagctttaggagatttaaatagacattaggcagtggggaaggtagtcgtttacggggggagctgctcgggcttccgttcagtggttcccggcacgctcagggtgcagtgtagggtctgaatgtgtgtattgcgggggtagggggagtggtgtcagttctaggccacaggaattcgtggtctggccccagaggtgcggtgtttttggccgggaagtcaggcagaagtctgcagcgtgcaactcgcagcggggcgtgtgtgtgcgtgtgtgcgcgcgcgtgtgcatgtttccggcccggggtcgcgtgtgtggctgcagcctgtctccgtgacaagaagatccagggatctacgggcggcacggggaagggattaaggggaacatacttccctacgtcttttctgcctccttttcccagggtagcattctttgcttatccaatgatgcctctttctaacctctccctctccacttacatcccaaacctgatgcgggtcttctctgattcggcactctaaggaggactcagccgccggctgcgaccaccgtggactccctctatggaagggaatcctgggagtcccggccgtcagaggggttcccaaatccaaagggtccatctccaaggcgtcactccaggggtccgcggttcactttgctgccccttgcaggtgatgctgtgattgttgcctgcggactgggaagcacgatggctccaaaaggccagcggggccgagaagcagggacagagaccagcatttaagggatctctggtgggggcctccctggagttctccacatgtaaatatagcgaaaaaagaaaacactacgttactagaataaacacgtcctaaaatttctgtgcaaaaacacctttttgaacagcaaagatttcacccaccaaaacaaggaagcaagaagcttccacagtgtgcaggatccgaaacaggaccggcccggcgttgggtgagagtgggggaggggttgtcggcttctccatccagcttgccatgttctgtcgtcggtttcacattttcagagagactttaccagatgcaggaaatgaggatgaaggcaactctggaaggatgcaaagaagggagagcaagcactgtacctactgtctgctgtctaagagggctggtctcataactaaaaggtccagtccctgagatcttgtgtgcaaccgtcagaaatagttcaggacatcaaattgcacagagaagattcagatgaagggaaacaagaactctgtggaaaactgttggggacagtggcacgagttgtcttgcaaggtgatgtctgtcccgtggagggacacaagagcgaggacagcatggttctaatggccagggcatgtcttcttattccatgtgacagtggctggctgagttgctagtacgtttttgaaatataccctttgaaatatgttgattattctggacatctgtaaggtgggagatttgaataaaaagacttctgctgtcattattggcttttatggctatgatttttttcagtcattattataaatcatgtgaaggtaaaataaatgatcattttagccattctgttctgcacagaatgctgttcaaataaaacatcatctgatatgtttgcctgtattgttttgtttgggggtcacggaagagggaaagtcggccaaattgattagggtatcatataaaagcagagattaggtccgggtagatcttttgagtgtgtgcaggaaaaggcttcattatagaatgctaaatttaatgtgagatgagagaatcttttactcccgatctcctgcatttgaaatacaaaggattgtacccttgggctggttcctggtccttaagtggaagcctaactggacactttttttctggaggattgttccctaaatcctgggaagctttagaaaatagtcaatggaatttttgttgccctaagataaagtcattacaaagaaaaaaaaaaaagaagaagaagaagaaagtaaaggtggtgaaatggcttgaggaggcagaatgagaaatagagatgtcagtcaaagtggaagaagagaaatcactttctctcactttagggatagatcttgttgataggcttagagcagtgattctccactgggggcagttttaccccctaggggatactgacaatgtctggagacatttttggttgtcacaactttgggggagaggtgctgctggtgtcttgtgggccaggccagggatgctgtgaacattctacaataaactggacagccttctgcaattatccagcccaaatgtcagtaatgcttaatttgagaaacttggctttcaataagatgtgcttaacattaaaagcaaccccttttaggatactttcaaatattcctattggaagtccatcttgaaaatcaagagtagttaataagagactttctttgcaaaatggtccatattcaaaaacacttgttttaaggaaattaaagaggcttccttttggcagaactgtttttcagcctttaaaaaacaaacaaacaaaaaatcttaagacatattgagaatttctaaaaggtgaatcatatgcatatgtgcatgtgagctaagtaaacattgtttgataaaaccaaatcagaactattctgctgtactaatttcactgaacttgtttggtaattgctttttaaaagcgataatcttaatttttaattcaaatgaatttaattaaaattacaacttgtaagttctttatcaagtgagggattgaacaatcagagaaaaatgttagacaaatatttatttgaaacaccccaaaatattccaaaatgaaatcttagtatttataggtatctacatagaaaggtaagaatgtcgtataattttctcgtattgtatttaatttccatttgaaatcgacagcatggagcgtattgagaagcatcaagcctttcgattccgtagcacaatacgttgcctagaaaggaggaacaataccttacactcataaatgtaataagatactgttctaatatcccctgcatgcaggagctcagagcacttattaggtaaaagccttgtcattagcacaatgaagcctagtgaaactaaaatttggtcgttgtatctaccccctcttctgtctcaccattccacccatttttgttattggtttgtttcagaattcattctgaaggtatcatcattagggttgcttacttcctttcttgttctaataactattccaatcacccttacctattactgtccctcagggatttgtgtcgcagcagacttgatactcctgctaagactctggggcacccagcaacgccaccccccccccgaccccgccctttctcctgtgcatacaaacacaaacagctcttttctgcttctaggtggaatggggatttgtacctgtcttggaaaaaggcagtggggagagcctttgtttttcacaaaggcaacctcagtttctctgcttctatatttactgaattggtttgttcaattgcatattcttgctattagagaggcttcctctttcccaagggaatagtgaaagacctgaggaaaagatgacttcagtgtaagcaacactggtactgatagaatgcacctgtcattggactacgtgaaaacccaataaatatggtttgaaccagtgataatcatatttgtaaattcaataagcatttgtaaactcagcagtagcaggttctgttctagacactgggactcttgcacttgcaatacccagatatatctctaaaagtatctgtacaaagaaacataagatgggcattcattttcattgaatttggagcaattatagagatatttcccgattgttgaaaagacttcagaacataattggtgagatgcagaaggcagaagaaatcattaaagggaaaacagttacatggatttctgtacagcctagacaaggaagaaatgagaaatttgaggtgaaaggggtcagttcttgtctcccttttcctttccttagcaaatgattattgattttgtttgacatctgagcaaggagaggtggtttccttccctgcagatacttgttgaatggatgtgtgcccttttgcacttctgatagccacagtggtagaagacaatgggctggctggcactggtagttagaggaagcagaatttcaaatcagttttgttctaatggtgtttgcagcaaaggctctaaccacacactttcaaagactgaacattctgtgtcactattttggggggattaatataaagactacagaactgagcatttttgttattttgggtactagggaatacctatgctttaaagtatacttgtttggagaaaccatatttatttgggggaaaaggaaatattgataagatggcagctccatttacctaaaaacaaacttgctgcttactctggcatgtcaattattgtgccagctggaaggagggtcatgtgagaattttatcaaacaccttatgttgttcttgttgaattcaggagcaacaacaaacacacacacacacacagagcaagattttgaaatttatgctgtagcaaaggcaaagagaatatctttttttaaaatttcattttatcttataattgttaaagataagtaatagcaatgcaggaaaaaggcaaccttgtttgtggaaggttttacttttgtttacaaatgcttattcatcttaagaaaaaaaatagcctggaacatttccccaggctttcagtcttctttataaatagtgtatctcttctatctctggattattcattatgtgatgccgtttggaatctgaatcctgggctcagatggctgatgtggttccttctgattttgtcattcagaattgtctctatcctcctaaagaaggtgaaagagacatgctgtttgtcattgggggcacagtaataggtgcaggctgtagtctgttttacagaattacatgcatgttgcttgaccttggtctgggaccccactgaccaaaacactgaactcagccttctggatcatgaagcctggtttttgcaattttgatttgaacaacagtgttttgaccaggtttgacaatcaactgatgtgtttggaaaagactgactgatgagccagaatactaaccacccatttacaaggaaagaggcacagacatttagggaagatcaagagctttgcagtcaaatctggcactcctgcttagtagtttgtgactttagatgagcttaactttatggaacttttatttcttcatctttaaaatgaagataattatgaagtgatttgcctgaggtcagtagtcactctgcatcatttcagcttagtttacagttttcaaaatctccatccaaacctctttctcaagagcatgcttattttcttggttaaatccatgtttcttctgtttatttaaaaatgctcaagaaccgatatttagctcaagagcttctcctttcagctgttagattctgttagaggcaaaaaaaaaaaaaaaaaaaggtaactgatgggtctctaattatgttcaattcaggtattcacctaaattgtcaaaaagattaaacgcctttttattttttcctaattgggatgaaaataagtagagctttaggtaaagatttctaaaaccaaacaaaaccatatgcataatgtctttcaactaggatgtattttttgatgatcagaaaattgaagattggcccttgctgataattctgttattaagtttatagatgtttttataccagtttagtgttgttgccattatggtttattgaagcatttcagattcaataaaaatctgaaaacctgttgtatgttgttcattgtaaaataaataatgtatgtattcttatttgtaatttatggtgactgatatgcatatgatcaattggaataatgaaagagttaaaattggaaaccagaacagatggaaactttgaaagaacattctctttagcaccacccaagtttgtattcaaatctctgttcctcagttattagctacaaaaaaattgggcaaattactttctaccttactactttttaagaatcatatccaccggattataggttatgattcctgtgatgattcggtgacataagcaagtaaagatgctagcatgatgtctggcaccctctttgtccttgtactctgctaattccaccacacttcagctgtgcccttgcaagtgatcatttatgcttgaattagttccaactgttttactctcaagaatcataaagcctgatctcaagtttcttgaggaaaaaaaagagagacatgattcatgactgtgtaagtggagccgggagctctatgtgactctaagcaggacctgattcagggctcacacccatgtgaccagttgcactgcagtttccattgcaatttcttagctcctcttccttaatcttggctatgtccttgacaggcttactcttcagggttctaagatggctgccagaagctttcagagcttcatgttcccaggttcaaacctagtgaagaggacagtctcttcctgtaccttttacagatgaaagaggaagctgctgttcctagaaattccagcaaatatccctggtcaggtcaagagccctccaccagtcatagtggctggaaaggtggaatatactggttgaggaagtgtgttttcccatagaaaattgagggattgctgtttgtatgctgattgtatgctagcacaataagaagccaccacagcatttatgttactgtttggccccaaagaaaaatgttagagccatggttttatttcatctgggtcatggttaaagtctagaggattctttctgtaccattactgaatatgtgtttccaatgattgatctgaattttcaagattaatgacagcagtgcccattagctctcttccttcaatctacatcattagactggctgggtacacactagaatttatgttttgctacaaacaactgttcaaggaacaaattaatatattttcttacattagatactaggtagtagaatcactgttttctgataaaagtcaggagctgtcatcatgtaaattgttaatctaacatcccgtgatttattcctttgttcctggcttaccttactaacctctggtccttcatctacataccaaattacactttacaggaaggctactaagatttatgtacaaacaagtcttagtatctacaaacatgggcaactaaaaaaaaaatccagaaaggttaacttgttaaatgtatattaaaaaaaaaaattctacatcatccattagggctgttgaatgcagtctcttaaatgcagtcattttctaagataaaatgtgatcttacttttttaattaacatattaatggactaaggatgctttctctcatttatttttcaccctttgcgtagatcacagtgactggatgtcatacatcacatattaagcagaagaatgttaacagccatgataaatggctttgagtgaaaaatattttcttctgttttcattcatccaatggtttagtcacataaataaatgtaagtgccttattttaaaatgtcttaaaatgggaaaataaaatcacatatctttgcatttttaaagttagtagctttcaggctactataaaatgtagtctgcttgtggtaagtatgtcagtgtagcaattggtttttccatatgtagtttccaacatgggaggtgggggagatactttagcacaatgcagttcaaaaattaaaaaccacagaaatgaaccagactttcattttctgttatatctatttaggttcttaaattcttaagaagactaaagaagttgaaaggtattctttcacacgactaaagtatcattgaagtgagatttttacctctttgccagcatgtttttaaatttccaatcagcagttacattggtgggtgtataacagagaaagcataaagtcatgtgaatgtttcagatacagtttttaattatctgaaatatgaaatgaacaactaagaagaaaaaattaccattctggcatggtaaaaatattctgtaattttaagaaatacctagagagaaatcattttaacatagcctttaaggcatagctgttgattatatactgtattaagagttttgtgtttgagtatcatgcacacattatgtttgttcctaaatattatgggtaaggttttctttggtattgcagtttttaaattatttttgctgtctaatgggactgaaaataaaaggtttttagtagcttaattagaaactatgcacttttaaaaagttttccatcaactgcctcttctgactgaagcacagagatttgcaaaaacagtaatagatacattatagataactacatagaaaagctctgaactaatcatttagattactttgtggaagggaatggagtaaggctgaaatttcactggaacttactaatagtagtaagtccaaataaggtaaatcttaaaacaaaacagaacaaaactcaaagttatgatgttgtaacttatcagagttccttcactgacttcaatagaagtgtattctattcagattaagcagaaaggaatccattggatggttatggaggagttcatggaattgaaggaaattctgaagagcaggaccttggacaggataatatcccagtgctggaatggatcagctctagctattttccatcattgtgtcactgtcctcaagactcagcatttagaaaggacagagagagagagagagagacagagtttgggggaagaataggccattttgaccaatagtcctaaagcataatctataatctgttactactggaagaggggaataaatgataatgtgcctgctgggcaggcacattagactgatgtccattcaggatgcagaaacttgttttagtgatcatgaattactagaaagagaaaaggaaaaccaaaacccttgagtgtattatctcaacaatgtctatatggtaaacagaaatactgttttcatttcctaaggctacataacaaactaccacaaactgggtagcttaaaacaacagaaatgtattctctcacagttctagaggctagaagtctaaaggtgttgacacggccattcgggctttggaggctgtatggggaaaatctgcttcatgcctttctcttagcttctagttttgctggccgtccctggcatttgttggtttatagactcatcacaccaccagtctccatcttcatcatctcatggctttctcttctgtgtctctgactcaaattcatagagacagaaagtagaatggtgtttgcaaggggatgggtgatgggggcatagggagtcagtgtttaatgggtacagagtttcagtctgaaaggtgaaaagactactggagatgggtggtggtgatggttgcacaacggtttgaaggtactggatgtcactgaagtgtgcacttaaaaacggttcacatggtaaatgtaatatcgtgtattttaccacaattaaaaaaaattaaacatgtaaaaagtgaagaagaagaaattagtgaaaatttctaattcttaaaaatcaagtgagggccagtaggatagttgagagtaactgggagcctcagacacaagggaaatctgtgctcatccatgagttctttcccagggacctttacttagtacttatcagaaattttggggacagagaagttgaccagagaaagccccctttggttccacaggtgtgcaggtactgagaccctgcccttaggaacaggcacaaaatcccacataccaccccagatttttctctcatgtgaaaagccttacacaactaggggaagggcagaaactatagggcccacggttctgcgcttatccaaagcagaggtctgcaagccatatagagcatagtttggtgccacatgaagagggaggggcagaaaagttgtggaaaagccagcccaaggcccaggtccatggggcctaagactaaggttggactcagagaactcaaaagtttacagcagctgcgttcataattgctccaaattggaaataacccagatgtctgtcagttgaggaatggataaacaaatagtcatggattccacagaatagaattttacttggcaatagaaaggaatagagggaattttatagacctcaccactgtaccggtgatcactgaggataaccactgggacaggagccatgaaagtttcatgaaaacgttcggacaatgtaaatgtttggaagtagattaagacagttatatgccaggtgcggtggctcacgcctgtaatcccaggactttgggaggccaaagtgggtggaacacgagtcaggaatttgagaccagcctggccaagatggtgaaaccccgtgtttactaaaaatataaaaattagccgggtgcactggcgcacgcctgtagtcccagctacatgggaggctgagagaggagaatcgcttgaacttgggaggtggaggttgcagtaagcagagatcgtgccactgcactctaccctgggtgacagagcaagactctatctcaaaaaaaaaaaaaaaaaaaaaaaagacacttatatagaaagcaggagtacttagaagggctgattataaggggagaatataaggccaggaatgagggaccataatttttcagtgagaaaaataccctatatacaatctgaattttttcattatcatacataaaatactactgatttatatgctatattctatttttaaaactcaaacccatttatcaatatatatacaactttccccctaccccaaacttatgtcaagttaatcatagtctccaagtttaaatgattttaaaattaatctaaaatctttctaaaataggtggttttaacctgtagctcactgacatggatagaattcagttaattcacaaacctggacagagaaaatgacatctttattgttacctctaattggaatttggcatattcattaattatgggtgtgggtcagaaaccacataagtaattagcagtacctgtcactttgtcaccagtagaagtcacagagaatatatcacattacagctgtttgcagatattttgaaaaaccatttatgctcatcacaactttgaaaatatgattattagacctgctgttagaactttttatttcaagtatagttgactcgaacaatatgagagttaatggtgctgacctgccccacagttgaaaatacacatataacattcgacccctcaaaaacttaactactaatagcctactattgaccagaagccttaccaataacatggctattgtgtgtgtgatatgtattatatactgtattcttaaaagaaagtaaactagagaaaagaaaatgctattaagaaaattataaggaagataacatatgtttatacattaagtggaagtgaataatcataaaggtctttatccttatcctcttcacacagagtaggctgagaaggaggagaaagaagagggacttgtcttgctttcttggggtggcagagatggaagaaaattcacttataaatgggcccatacagttcaaacctgtgttgtccaagggtcaactgtattaataaagaaacacatagactgtgtcagaaattcattcttttaaaatttgataactgtttctcattgcatttagtttcatttgaaatcctatgtatctcatttttagaatgtattataggttttacagactcccagagggattcgtagatgaagaacctaaaatctttctttgattcctcccagtagtaagttctattcagtgtgaacactggtgtggtccagaaagccagaactattgagggtgttctgtccacgcttgtgcttgatctgccagatgtcagctatgcaattccataggaaacactggttctagcaggtttcatgccatttgctgagttagcacgtttctgagcatctgtagattctctgtgggctttctacagggcttttcctatgtggagcaacgcagtcttagaattaagtgccatgtacaacccattgtaacctttcctatcaggaggcctaggctttagaccataccatatgcatgactctggatccctggaaccctagatggagagaggcagctctgaatctgttgggttcaacctcatgtgtctgtggattccagaaggaccgacgtcaaacttccaggcccatagatcagggatatttttctaagttttaatgtggttccctggcaggctgggtatgacttaaatgaacataccatccttgcctagatctatactcttatcttttaaactttatttattctaagggctgtcatgccaaagcatatcatttgagtgacttaaatatcagtggaggtagtagtcaaagggcctccccctgaggagtaggagaattgcttcctcatgagtcgtatttacaattagatacatacccattttaaagctaaacttcctaaccattttaataaagcttatttcttttttgactccctgacaggaagttttggctcttttagggtaaaatctgcttcagtttaacttctgtcattgacctaactcaggtcagtgaaacctcacaattatttaggaatttcctgaagttactaaaatgctcttactgtggccttcctgatgtattcaaggaatgctaatcatagtgacatctgccaaatcaaaatatatttactgggaaacagcagttttaggttgcatgaaacttttttttttaaccctttgaccagcctcttcccaaatgcacagaacatttttctaacaaatgctgaggatccaagtatgtgccaggcactcagccgaacatgggatacaataaggggtaaagcaaacatggcccatgctttcatggagctaatagtataatatttgtgctggggagaggatgtcagttagactacctggaaggtgctctgaaggccaagcagaggcggtcagcaggttgtgctgcagaggaacatgacactgagaatggaggggctgcctagtttgaaggccacttggagctggcggcaggagtagagaggtgttccaggcagaggaaataggttggcacatatgaggacaccaaagatggtcagagtgtctggggcaaggtgagtgtgggaccagatggaggtggagaggtaagccagtgccagataatccagagtcctcttggtgaggctaaggattttggtctttgaagcagggggtgacatgatcaaccatcctttattggcacagacataatgatatctattttccaagagaacagatagtattcagcaaaatcagcatgcctagcaactttttaaaaagtcttctatttaaacataatggacatgatacatataccataatacatatacaacattacaaatatgccttcacctctggatagcaagctttcagtttcagtgctaggattagattacttagtttctctgaggttctgaggggagggaattctaaaccacttgcctttgtcatttgcctttgaagaattgtttgtaaagtttccattataaaaagctattaacattaacctcaatctttttttaaaaaaaaaggctgttaaaattattcagctgtttgcttgctattgccatagcttacttgtttatttgaactttattataaagggctggagatactgttactgtaattgaattgaattgacttgaaaaatagtcccttatagggatggtaatctctagtacatttaaatatatataaaataagttctagggtacatgtgcacaatgtgcaggtttgttacatatgtatacatgtgccatgttggtgtgctgcacccattaactcgtcatttacattaggtatatctcctaatgctatccctccccactgcccccaccccacaacaggccccggtgtgtgatgttctagaaaattttgagtccccatttgattagcaaacatgagccaaagtcatactaaacaattgtgtacatggccctctcagctaatcctctgaattaaaagtccttgcaatctttagatcatttgagtaagaatgtaaaatgcagttttcatttcatgcttatatttttttaaatgagaaaattttgtctgcagagtaattgggcagctctgcctcatttttagtgttaactaccagtggggattaattacttgccagctcattatattattctcatggaaactcagagtttgtttgtggatattttggagtattggacagtaacaagtgtccttccgtttaatgctgccaccctaggtctgtgtgtccccatatgtgcaatttctgaaacgtttcatgtgaagcaaagacagcttgtgctgaaacagctggcctccacctgcacttgggaggctcattattattcaccaggtacttattatctagtaagcagaagacgtaagaagttgcatattgattctgcatcgtgatgcactttcaaagaccccttaaacaaggatattcagaggaggtgactagagcagttgcagagaattatttttctgtgtgtgtggcatctttatacacgacgtcaacaagagccttagagtctgactactatcagaggaccttgttctctagcaggttctgtttttgagactgtacttctgtgaatgtgtgtctttatgcatcattcctttgtggacttccctccttctgggaatgtgtgtctttaatctatgcaacattcctttgtggactgccctcgccccgtaaccacctttttcagtcctgtggtagatgtggggctaatgtgacctatccagccaaataactctcacctctagtctcagtgagttgctcaaggatagattcatggtctaagttggtaaaatgatgaccttattccctgggattttgacagaacactaaaaacatgctgtctttctcatggagcttacaaagctattaggattcttgcctagtgcagctgatgcccatcattgttatccagtggaggaagcctgcctgaaagagaaattagtcaaaacaaaacaaaaagtaaaaaagtacatctagcccattaatcccaccacacctgcagccagtatgatttctgaatatttcagctgcattaacccattatttttcacttctatttaagctaatttaagttagggtttttttttttttttttcaatgaaaagaattaaaacataaatgctgcctaaactgtccctacactgaggtggcagcaggaagggagaggtctgaagatatcatctggtatagatgtaaaaatttctgttgccctgagccaaaaagagtttgtaagtgagaccaaagaaggtggtaacttttctctcctgtttccattttctttaagtagcactggatgttttaacaaaacctgtttacattccgaggttgtagaatcctagtttttctcatatacagaaatgagagactttgtgttgctatgtactacagaaacaaacataaatgagctggatgaatcctagttacagctttgccatttgaaatccatggatacatttatttctcataaatttgcttttagcatgaggtattctaaggtctattgttcaacgaataagatattacaactcccgtaatggtctctaacatgaataacaagattagagggacaatcagtaaaaataataaaagacaaattatcttgtcaattctctatttctagtaactcagcaataaaagccatttatgttctcatttggacattaaatagctagaaaataggagtcagtcatttcggatgcaaaattctgccacagcttcattccatttggtatcgtaggtatcagtttcttacagacatttccttttaaccacaggaaagaaaagatacccaatacggtaataaaaatgagcatttcaaatgtcctgtagacctaaagtagaaagcagaaaaacagaggaactaaaatgacatttctgatataagtttaaaatagaggcttatttctcatgatttctttatgaaaagacgtgtgaaacatgtataaattaggattgttcatggctaaaaggaggtcaggggtattggaggtattattaagattcactttatcttacattgatacttgtcctgtggataataatttctgctaagatgggttataagataagctttttaactaaaaatagaacaaggttactaagctataagaagagataatctgcatattaattcagtgaccagaaaacagtgtcatccaaggtgtggtctgaatggtctccaagtacattatgaaacaccttggttggctcacttccaattagagggaaaagtgcaataaacaccaatttcccacatggcatcatagaatgtactaaggtgtttattatcccttatgatactgcaataggaaaaatagatttctccttcccaggtaatttaatgagaagaacatcccatttcaaaaaaaaaaaaatctgtgcaaaagaaagtagcatgagcataatgaaactctgtgctgtatttaatgaactgatggcttaataaactattgccttggtgacaataaaaagttctgacctttgtatctataagaaatttttctagtaagcaaaattagcattcacatttaaatttggtgtttgcttccaatacttgatttgttattagttcctatttctacaagcctatatagttaacagagcagagctcctctgagctgttccagccagatggaacatttcatagtctcacatgggaagtggctggaatccaaacttctgtgcgatggagtttcctgtgcgtttggatctgtctgcaagttcttctaccaaaaggagtgaggtatgaagcatatcctcttgccatggacacacccatgcagaatgcagaggttgctggatgggacctgtagctgcagcctgaagacagctggccatgaaaacagatggggtccctgggctatgagaatttagtactggcaggtgaagtgtattggaaggtgtgggagcctccttaaattttgtgaaattaagagagagctgggtttgcagaagtccaagtgttgactctgaattcatgaacactgcatgtggaacattgccgacagcctgagcattctgttatttacagtacagactctgatgcaaagaagggactgttccaatgcagaatagcatgaaccacagaggagcaacatcagggcaacaaaagtagaaggaatgtccaaatatttcctatagcctgtcatgaatgtggttctgaccagaattgatcggaattgatttaagaacacctcccttgacaacctaaatatgtgtgtgtatatatatatgtatgtgtgtgtgtgtatatatatatagtgtgtatatatatggtgtgtatatgtatatacacaccatatatatactctctatatatttatatacacatacattatatattaatatatacacacacatactctatctatatttaaatttatgtattaaatatacaaatttatatatttatatattatatatatttatatataaatatatagagagaatatgtatttgtgtgtatatatatgtgtatataaatatatatgtgtacatatatatagtatattcttaagatacctgcataataaactgtgagtcattttcattctgaatttcagggattcacaactcattcattcattcgttctttcattcagcaagtatgtcgattgtgcactctttgccaaacattgggaaaaaagtggtgaataacaccagagaaatccttgttttcacagactctgctttccagtttatagtgacaatcatccaagggacatacctcaaaataataggagacatctatgacgaactcacagccagcatcatactgaatgggcaaaagctggaagcattccccttaagaactgaaataagacaaggatgcccactctaaccactcctattcaacctagtactggaagtcttagccaaagcaatcaggcaagaggaagaaatacaaggcatccaaataggaaaataagttatcaagctatctctcttcgcttctatacctagaaaactccaaagactcttccaaaatactgctagaactgataagctattttaataagttttcagtatacaaaatcaatgtataaaaatcagtaacatttgtatacaccaataatgtccaggctaagagtcaaatcaagatcacaatcccatttacaatagccacaaagaaaggaaatacttaggaacacagctaaccaaggaggtggaagacttctgcaaggagaattacaaaacactgctggaagaaatcagagatgatacaaataaatagaaaaacattcaatgctcatggattggaagaatcaatttcattaaaatggccataccgtctaaagcaatttatagattcaatgctattcctatcaaaccatcaatgtaattcttcccagaattagatcacactacctgatttcaaactatcctacaaagctatagtaaccaaaacaacacggtactggtacaaagacagacacactgatatgggttggctatgtccccacccaaatcccatcttgaattgtagttctcataatccccatgtgtcatgggagtgacccagtgggaagtaactgaatcatcggggctgttacccccatgctgttctcatgatagtgagtgagtgagttccaccagatctgatggttttataagggactttcccctttgactggcacttctccttgctactgccatgtgaagaaggacatgtttgcttccccttccaccatgattgtaagtttcctgaggccttcccagccctgcagaactgggagtcaattaaacctctttccttcttaaattacccagtctcaggtatttcttcatagcagtgtgagaatggactaatacacacatagacgaatggaacagggtaaaaatctcagaaataaagccacacacttaatctgattttctacaaggttggtaaaaacaagcaatagggaaaggactccctattcaataaatggtgcagacataactggctagccatatgcagaataatgaaactggacccttacttttcaccaaatacgataattaactcaagttggattaaaaatttaaatgtaagatctcaagctacaaaaatcctagaagaaaacctaggagatacccttcttgacattagctttggcaaagaatgttttgctaagtcccaaaaagcaattgcaacaaaaccaaaaattgacaagtgggaccgaattaaagagcttctgcatagccaaagaaactatcaataaagtaaacagacaacctatagaatgggagaaaatattcacaaactaagcatccaacaaaggtctaatgtccaaagtctataaggaacttaaatcaatagccaaaaaacaaataaccccattaaaaaatgggcaagggacattcacagacacttctgaaaggaagacttacaaatggccaacacacatatgaaaaaatactcatcatcactaatcagcgtagaaataaataatcaaaaccacaataagataccacccccaaccagtcagaatggctattattaaagtcaaacaagagacgatgctggtgaggctgcagagaaaagggaatgcttatacattgttggtgggaatgtaaattagttcagccatagtgggaagcagtttggagatttctcaaataacctaaaacagagttgccatttgacccactaatcccattgcttggtatatggccaaaagaaaatagatcattctaccaaaaagacacatgcactagtatgttcattgctgggctattcacagtagcaaagacatggaatcaacctaggtgcccattagtggtggattgtatacagaaattatggtacatatacatcatggaatactatgcagccataaaaaaatggaattatgtcctttacagcaacatggatggagatggaggccataatcctaagtgaatgaatgtagaagaccaaatactgcatgttttcacttataaattggagctaaatattgagaacacatgaacctaaacctggaaacaggagacactgtagactactagagggggaaagagaaaggaagatgtgactcaaaaaactacctattgggtattgtgctcactacatgggtgcaacacacccatgtagcaaacttgcatttgtactccagtacctaaaataaaagtacaacaaaaagtctcagtggaaaccattataaatgcaagatttgtattagcattaaattgcatcattcttggaagtaaatataaacaaacaaaacaaaaaaacaagcacatacagcagtctcccacttaactgtagttttccttttcaaggtttctgttaccagtggtcaatcacagtctgaaaatattaaatggaaaattctatacataaatttcattagtttcaaattgcttgtcattctgagtggtatgcatatattagtccattttcacactgctgtgaagaaataccagagactcggtaatttttgaagaaaaggaggtttaatagacacagttccacatggctggggagggctcacaatcatggcagaaggcaaaggagaagcaaaagcatgttttactaggtggcaggcaagagagcatgtgcaggggacatgccctttataaaaccatcagatcttgtgagacttattcactaccatgagaacagcaagggaaaaacccacctccatgattcatttacccccaccccccaacgggtccctcccacaacacgtggggattatgggagctacaattcatgatgagatttggatggggacacagccaaaccatatcaacacgtgatgaaatctgccatcttgctgtggcccaactggggtgtgaatcatccttttgttcagcgtatccatgctatagatcctacccacccatagcctcagttatcatatctattgttgcagtattgtagtgcttgtattcaagtcatccttattttactattcataatggccccaaagcacaagagtagtgatgctggaatttggatatgccaaagagaagctggaaagtgcttcctttaagtgaaaaggtgaaagttctcaacttaataaggaaagggaaactaatcacatgctgaagttgcaaaaatctgcagtaagactaaatttagccaagaaattgtggagaaggaaaacaaaatttgtgttagttttgtggttgcacctcaaaactgcaaaagtgatagccagagtgcgtgatgagtgactagttaagatggaaaaagcattaaatttatggatggaaaccatgaatagaaagatgttctgattgatggcaattgggtttggtactatcctcggtttcaggtatccattggtgggtcttggaatgtattcctctgcagataaagagggactactgtacataataaaagctttgaagaaaacatattctgataatgtgataaagcatgacaagcatgagggttggtgagcagtaatagaaaagagaaggaacatgaagattgacctgagagtagaccaatatctagaggataagaagacagggaggcaccaggaaagggaactgagaaggagcagcctgtgaggtagcgaaaatcaagtaagtagttcttagcaaatgtttatgtcactgaagaatgttaagcccaggagtgacctacctgatcaaatggatgctttcaggaagcttcgccctggttgccaagggggcaggactagagcagggtaagagcagaggcagagaaaccatttaatgggctgttgctgtgacgtgagaagtaaggactgcttggactatgattatagcagtagatgtggtaaaggtagctggatctgggatatatttcaaaggtaatgtgcaaaaaatggtagtacacagaagatttactgatggattcaatattggatgtgagggaaagagaactgggcgatctactttagatcaatgctacagaaaatattcatctgaaattttgctatctggtctgtaacaacatgagaagcttgggccaaaatgtaaatcacatttttttccatggcaagattctttcaaggaaggaagtacattgatttacattctagcacagtcccttatcttgtcgtagactggaaggcacttccagacagcctcatatgcagatcttacattgcagcattgaattagatgaagtcatcagtgaaagccattattaccaagtggtttatccagtcccattcttgaagaattgctgattttgtcattgtacaggagtgtcgtggttgccaacattacttggaactgcacacagataagttataacatactttgtggagcaatgccttcttaaacttttgtgtcttgggttattttgtgctgctataacagaatatctgagactggataatttatgaagaacagaaatttattctctctcatgattcttggaggctggaaagtccaagatcaaggcttcatctggtgagggcctttttactgtatcctcacgtggcagaagacagaagggcaagagagggacaaactctttgtccttacatggcaaaagggcaaaagacagaacccattcctccaagccctttcatagaggcactaatccattcgtgaggttggagctttcatgacctaaacacttcccaaaacaccctgtctcccaacacttttgtattggggataaagcttccaacaaatgaattttgggggacacattcagaccatagcattatgatttctagattttcatatgacagtttaatttttttttttttttttttttggtaagtaggcaaatagaataagctgaggaaaacatttttttttaaaaagtcaattactttgtgtttatgaagtagggtcacagggtatattaggccaatcttgcattgcaataaagaaaggccagggacaatggcttaaatgtctgtagtcccgtctgtattcctggcactttgggaggccgaggcgggcagataatgaggtcaggaattcaaaaccagcttggccaacatggtgaaaccccgtctcttaaagaaacaattagccgggtgtggtggcatgtgcctgtgatcccagctacttgggaggctgaggcaggagaattaacgtgaacttgggaggcagaggttgtggtgagccgagatgcaccattgcactccaacttgggcgacagggcaagactctgtctcaaaaaaaaaaaaaaaaaaaagaaagaaagaaatacctgagactgggtaatttataacgaagaggttagctgtctcagggttctgcagactttataggaagcatggtgctggcctcttctcagcttctggggaggactcaggaagcttacaatcatggcagaagatgaagggggagtaagcacatcacatggcagatgcaggagagagacagagagacagaaagagagagagaaaggtgccaaacacttttaaataaccaaatgtcatgggaactcactatcacaaagacaacaccaagccatgaaggatctgcctccatgatcacctcccaccaggccccacctccagcactggggattacaattcaacatgagatttgggcagggacaaacagccaaaccatatcacagggtaactcaagcaaacccttacttgttcttgaaaacttaactcatgtgccacttttatgcggcctttcatatcttttaaccattctacatgtttttcctttgtgttttcataacaatctgtgtattttaccattatcatagcattattataaatcaagaatagttgacttacctttacctgcctcctcctaaactggaagcaagtagaaggaagactgtgtcttataacttcagtacctaataggatgtatagaatattgtagatatttaattaaatccttacaagctaagtgatgtgatcttaatttcaaggaacaaaaggataattgtgtacactgctgggcataatggttagcacttaactttggggtaactaccaaggcaaagccttcattaggctaatgacagtccaaggtaaatgatatcagttgcaacctcaaatataaggataagaggttttaggatttaaatgaggattacacattggacttaaccatctctattaaaagagagcaactggcatgagtgatagtgcttcaaaaataaaggacattatagtatatattgtgtatatatacctacatatacactgtatatatgtctatcatatatatgtgatgtatacatattataatgtatacatataataacctcattgtcacgttatacaacatgttatgcacgactcattatatgcataactcattagataatgttaccataagatttgaggtgctgggatctagtaatttttttctcttatttgctttagtatcagctggagttcagaagtggtatttggcaaaacctctgagaatctaaagagttgattatagtttacaagctgaccagttaccatccagtgcatctaggtttcttaacaaatcacaatttgtgaagctacggtgttttccattcaagagattttttgaacatctaccatgtgaaaaagtaccaggtgccattaaagtgctaggcactgtaggggaatagaaagatgaattacacatgaatcttgtccttagggaagagtgagatgaaatatctgccatttctttgttgcacatacctccacatactgaaggataatgcaaactgaacctctgtcctgaagagtgagtcatgcttccttggtggagatctcagagcctggaaagtcttctaacctgacagtgtcatgtctgttcttcccactgattgttcccagaagtggctgctttcttcaattcttgaaattgttcctgtaggtgtaccactcattaggaaagatcccaactatctcagcacttttcaaagccagtgttgtttgaagtctcctgctggttgtcccaacctgcagttcttcgagtctcatgggcttataatcaacttgcactgtactcccagtcccttctcatttccttgttttgccctgaagcaatcaattgttctatcaactttcgcttagctacaggtgagttctccaaagatctctttcttaccctgttcctaaaagcaggcataaaaagaattagtgatcgcctcaggctcttttaggtattgataatgatgatgatagtactaataatgatattagtaatatgtattgagggctaaaaataggtgagttcccattctaagtgattggcagattttttctcatttgttccttgtaactgtggaaggaagatggcattattattacattttaagataagtaacctagtcaaagagaagttaagttcttgcctatcaccttcctcatttcttagcaccacctataaaaccagccccatattgagttctggttttctcataagcttcctatgattgactgaactctagtgatcacctgtttgtgttgatgaatagtagtaaggccagtgtacatattagggactaaatatcatctctggctgtcatgctctccttggacaagcagtgaatgtttgtatggttcttgagcttgtatcaaaggctgaggcaggtttaagagaggaaagataacactggaacaagagtagtctcaggttatgacacctgtctttgcccatgctagtatgagtgtttctaatttttgtcttataatggtcatgtatttattttgaactgaattggtaacagatgctgtatgaatattgcttttccttgaaaaagttagtcttcatctctaggaggagtccaagcacaccctagagctgtgatggtaacgctactcaacattatcactgctgtttagaggcacttaggcctgaaactgtatgtgtttcatgtgcattatttcacttaatcctcataaaaacctcaggaggttgattccactgtattatgaatacagtaatctgtatatagcaatccgtgtggctgattactcattcctttataaaatgacttgaacctcatgactgggaagacattagatgaatggactcagattttattttattttattttactttgtctttgattatataattttattttatcttatatcagatatattattttttcttggattagataattttcctaaggaggaggatcctaccacttactaaatacagtaatgtgtcccttaatgacagggcagcattctgagaaatgcatctttagttgatttcattgttatgtgaacatcatagagtgtgcttacacaaacctagatggtacagcccattatacaccttggctatatggtatagactattgttcctagactacaaatctgtacagtacgttattgtaccgaatactgtaggcagttgtaacacaatggtaagtatttgtgtatctaaatattgctaaacatagaaaaggtatagtaaaaacacagtattataatcttatgggaccactgtcttatatgccatacatagttgactaaaatgtcatcatgccatgtatgactgtacctgctgtttgggggacactatcctagctgtttccaaatagtttcttatttctaccaaccttatgatttaggttaaatatggatttagaatgtgttttcaaacatgcacaactctttgcctaagaacaccttgggaaaggagtagggagaaatctataagataaaggaaatgaacaaaaagtggtgaggggacttaatgaatatggagcaaatgtttaacatggagaagagatctttgccagcaagctattgccctggcagatacataaactttatcctgtgggaggcaatgatctggcgacaaaccaaatgtaaaccttgcaaaggaatattgcaataaaattcggctggtagtcaacagcaatttttcttataataagtatgatttgtttctctgccttctctatcagatatgcttctgcttatttatgcataacaagtagggatgggggaaaaataagtccttacaataggaatctgtattagtctgttcttatgctgctaacaaagacatacccaagactgggtaatttataaagaaaaagaggtttaatggactcacagatccacatggctagagaggcctcacaatcatggcagaaggcaaaggatgagcaaaggcacatcttacatggaggcaggcaagagaacgtgtgccggggaactgccctttataaaaccatcagatcttgtgagacttattcactatcaagataatagcacaggaaaaacccgtccccatgattcagttacctcccacgacatgtggggattatgggagctacagttcaagatgagaatttgttggggacccagccagaccatatcagaatcaatcatgataataaagtctctgtctctataatgccgatgttttctgcagtattttatgaaagcgagtgggatggaatagaatgcagtggaatagaaaatatgcaaaggtggatactcagagccataaatattgacagatggaagatgcacatagctgatttgagctatagtgtcaaataatacttttttattgcaagaaaaactttctggaggaaaaaaaacaaaacaaataaacaaacaaacaaacaaaaaaccaccccagaacaaaagcaattgtgtttattggcagaaggataaaacctttactaatctgtccagattgaaacacgttcttttctttccccttcagtgaccctgaaaaacaaaacatgagaaagatgcatttatatatatatgtgtgtgtgtgtgtgtgtctatgtgtattttgtatgtatgtgtgtgttatatgtaataacattgcttatttaatctcacacatatacagatatacaatgagttgggataagctagacaatattgtacgttaacaatcaaaccccaaatctcagtgttttagaccacaaaagttcattgctcactcatgtgaacttactttatcactttgtgttcatcgcagattaactgcacctctcctttacctcatttcattctggactgaggctgacattgtagcctatacctgtaatactacctatcttttaacagagagaaagataagaacatggcagacctcatactagatttaagagcttctgctcacatgaatcaattctttctacatgtcattttgtcaaagcaacttaatgtcagcatgggacaagtatatataatcctcttgtagaaaatatttttgaatagtaatgcaagctgctacagtatagtagcacattagagtgatacacaaaactaatactgtatctgttggagagagtattggtgggtgttgaatgtgttgtagttttcagaatgtaattgtacccagggcaactgttccatctgatactaggtgtgtacttttttttccaggtggttggggtgatgttgatagtaacagaatcttgctttgtggcattagcctcatttattctcatatactctttctctttattcttcatattaatgtcattgcgacactatttctatattataaagttcactcccaatatttttaaatcaacagatacttattgaggactgactttgtgtcaggcaccttgccgcatgcttgactatatgttgatctcattcagaaacactgtttcttagtgatttaaggcctgaagtaaatagttaattttagataaaaaacacattgatgaaggactatagtgcatgaatgaaactacatcacagttttgtgggaagagacggacacgttgtagaaaatttcacagagtgcttgggaccatagttacagagaaagattgatgggattttgtcagaagtcaaggaagaagtggggtgaaagccttctaggcaaagaaatcagtataaagaagagcatataaatgtaaagcatgtctgagaaataaaactagttctttatagttatggtatagaatttggggaaagcataaagatacatctgaataaatgcaataagagaaattggagatatttgaaacaattcatcatctctatctagaaaggtcaatcttcctgaacttctgagtattctcactggcacctctgactgtgcagtctgacctcttcatttttactcacccttttcaattgagcagtgtcccagggtgagtcccatggttgctttgtatgtattaactttgattaatttgagtcctgcatttcccattttctatgactacctaagatttatacttcagcatctttattatggcttattccatttggatagagtgacctagctccaatgagtggcctaaaagatgaccctcctctaactttctcatgttgatttctatatttctgtccaacatatacaatgtctcctgttatactagatcctacagttaacgtgtttacaaaaatgaattaattcaacaaaatgagtcatttgcaacatgaaatgcaccgtgaatcattgtttttctgctgttctacaaatattcgacccaaggcattcaatgactcatgtgtggcataaggactgtgctgtacagacatttcagaaacagatcgaaaggtaacctgctaggaaaaccatcattgctttagttactttttcataaaagttagtggtatggatattgcacaagaagctcctgtgcattatctttttgaagagattcaattgaattgaggttgagaacactatgtatcaatgctttactttccactagggagaaacaatctcttcatacactgccttccagggtatatttctgcagaaattagttggacaatgttcttctttttcccaactctttttcatttttatgtctggattagatgatggatagtttgggtttagaactggaatatttcagagtgactcaaacccatatgttttaaaatgtgacaattttaggtacaaaaatgtaagtgataaaacgcacgtcatataaaagatgcggctataaaccagcatttttgactttcaatagtgttttggggggcataactgtaaaattgccccagaataagaacagtgaatgcattacctggagccaaagatttgaagaagcagcgcttgtcactgatagggtgttgtttataaattttgcagtcactttatatttcagctatgcttacgtactgatttcactacttagaaaattgagtcatttatttgagagttgaggtggcttccatgttatatatgcagaatacaacaactatttaaaattctaataatttgctttttctattttgattgatttcaatactcagtcagtaggaaaataaaaaagatgtatttgggctttgaaatttacagggactgggagctcagtcaggttttgaacttcaggtttaggcccatctaacttttgtaatgcagttgtgtagaagagcaaggtttgtattgaacaaacctgcctctgaatccctgctgtgatgcccttgttagcaaattttatccaatcaagacaccattgattgtaaatagtacccagactttagggatgcaaagaatctgataaatatatagtacctgtctgattttggtaagttaagtaataacctctttgaactttaatttccttatcagttaaaaaggtaagtgaataatggtattctcctcagaaagctttcaagatttatagagatattctgggagttatatgacagaataggtagaaatatcgagccttttttttcagggactcagtaaatgcctcagtgattgtagataggttgtttatatttcaaataaaaacccttttaggaatgagaaataaaatgtagtcttgaccatcttttccttctaaaagaacataaaagtatcacgagtgagaattaaaagcagatcagataaaaacaaaagtcaattttgttaaattactgataatagggataagaaaggagtaaccaaagaaagacctgtctacttatagcaagcttgaagtcacctgggagtgttggcctcctaactttataaagagttcatggccatctgctgctattttctagtctattgtcagttttctttgtcccaggttctagaatcattcttcagtcaaaataacttcctactatatttgaattcaacaatttgttttcccaaaatattcagtttaataagtttcatagtcaatggtggatctatgccttaaaaaaaaatcaataatcagccgagcgcggtggctcacgcctgtaatcccagcactttgggaggccgaggcgggtggatcacgaggtcaggagatcgagatcatcctggctaacacggtgaaaccccgtctctactaaaaatacaaaaagaaattaagcccggcgtggtggcgggcacctgtagtcccagctactcgggaggctgaggcaggggaatggtgtgaacccgggaggcggagcttgcagtgagcttagatcgcgccagtgcactccagcctgggcgacagagcaagatgctgtctcaaaaaaaaaaaaaacaagaatcgtttagacattatgacctaggtataatataatgacagagaaaatgtaatggcagtaaaatataatgacagagaaaaaaagttataaattgggtatttgtggggaagaaagggaaaaacaagcatacctgtttgggtttttttgtttgtttgtttgtttttttgagacagagtctcgctctgtcacccaggctggagtacagtggcgccatctcggctcactgcaagctccgcctcccaggttcatgccattctcctgcctcggcctcccgagtagctgggactacaggcgcccgccaccaggcccggctaattttttttgtatttttagtagagacggggtttcaccgtgttagccaggatggtctcaatctcctgacctcgtgatccatccgccttggcctcccaaagtgctgggattacaggcgtgagccagcgcacctggccgcaaacctgttttttttttttaaattacagatatgaaaacgaaagccctgaataagttagcctaatatttcagtttttctatatagattggctgaatttttctttaacttttagaaggcatgcatttcacatacatacagaatcaactttattggatgcttactctgccaggaacttggcaatttttttttctttctttttttttttttttttttttttgagtcagagtctcactctgtcacccaggctggagtgcactggtgtgatctaggctcactgcaagctccgcctcccagggtcacaccattctcctgcctcagcctcccgagtagcccgccaccacgcccggctaattttttgtatttttagtagagacggggtttcactgtgttagccaggatgatcttggtctcctgacctcatgatccacccgccttggcctcccaaagtgctgggattacaggtgtgagctaccgagcccggccggaacttggcaatttgtataccttacttcattcaatcattcaaggaaacctactaaatagattaaaaaccaggattcaaagtcaccgttggcatagcgtttatggtacacatgctcaaaacagaaaaacctacataatggaatagtttatatattggaataaaatgtataacaataaacttgttttaattaaaatttaactaaatattttaaaattggtgtggcttcctttccaatacccttcaggtaagtatatttgtgtatgtgtttctccttccaaaattgtgatatctaccagtgatttaataagtatcatatgtatttcagtaatttttcgcttaagacaaaagacatcattattcacttctctcttttttagctatgcaaattattaacaaattaatctgtaaatagtaaaaaacactaaaatgccttatgtatttcattaaataacattgccttagttttaattactttcacaggaaaattcattcaatcaagtcttttctgactagtgattgtaatcctgactaaatgtgtgttttatatcaaatcctctctaatttagtttgttactgtaccacgttttaatctgtctctcatctctaagtggtaactggactctatgctaaaccaaaatcttgactcatcacctcaaattcctaaatatttatttatttttttaaaggcaaactggattctttcttttgcttgaagacatattttcttggaaaagtgttttgaatttgatcatttcttctgtctgaagtcaaagcttagaattatatctaataagtaaattgtcagactagccagctattctcaaaaaatgttggacatatcattgtgcattttaatttgaagtcagatgaatccacagatttaaaaatctttgagaaccagaagttcattttgttttaaaggctctaagccagagctgtctactagaaatataatgtgagccacatatataattttaaattttctagtagcaacattaaaaaagtaaaaagaagtaggtgaaattatttgtaacaatacattttatctagctcaacgtgtcaaaaatattttcttttcaatttgtaaggaatacaaaaaagcattactgcaatttaatttaacatttcttagattaagtcttcaaaatgtggtatatattttaaatttacagcattatctcaaattagcctctttttaagggctcagtagccacatatggctagtggtaccctattggacagctcaggtctatttgatggaacatatattggcaggttctaccttttactcaagggaattttagtttcatggttaattggcgttaattatcagtagtaatcataatgtaactcaccatagttattactttagctaatatatgggcagaagtccacatgcctagtttaaataattccttatttttggttgagaaaaagtataaatatttatatcaaaattacctttctacatgacacttaaagtagtataatattttataaagaaaagaataaaaactgggttcagagattttgtgattttgctttccaaattagaagaaattaggtccaggaaaactattatgtagagaagaatcatattcactgaaattgaagtgttacactactttctttgcccatgcactccatcaatgaattgtattttcatcatttgacttttatgtttcattctttttttggtagccaaatttgtgttaacaagttttcttaatctccaaaatatattttataaagagataataaaaaagttgatgtgtatttacagcttaaggtccatcatgggtgaaagtacactttttcaaactttactttggagagtcaaatttagctaataactgcttttaagggttaacatttctaggtaaggcaaacactcaaatttaaattagtttaggagacagatttaaataattcttttcatgactttgctaatatctcactacaataaaaatgatctttgatctatttgtattaacttgggaaacatttgattaaaataatatttaatgatttatttagctgtgtggatggatgataattttctacattcatttttaattccatgcatccccaaaatacacacccacccattatcctctgcagtggctgcttctcatgtttttttatctgccactgttccctttgatttctccaggcccaatatctcttcctagcagtgttctgtatctaagattcaatttctgttttatgtatctgcttcattaccattatgtaactatattccttggtacttccttctgttttgtaacatctaacgaggatagagagcattttatttgctatttctaactcaaagccacagttttatactagagaaaaaactgaggattctttgttcttcttaaatacctcaggagaggatataagagactacccaattgacttagatttttagaaagcaacatgtttgagttatttcttatttttaggttacccttcttgtgcatttccctccattccttcagagctcttttttttttcattaaaatgcagtatgaatctgattatctagattttgaagagccagggatactattatacacattagtttaagttgcactgagatggttctcctctgggaacatctaaggaataattttcctgatggctggggcaatattagacataagtgttcagatttaatctgcacgtaagattcaacaattttggattcacaaagcactgatgtacaaatccttaaagttaataattttatttcattcttatatcataatacattgggttttaaagcttccggtatccattatatcttgatctcattaaacatacacttaacctgtgactagaaagcaggtaatagggaggagccagctccctattaaaatagttcaagatatttaccaaaagcaaatggaaagctttgtttacaaaaatagctgttcatgatgttcacagcagttttaattgtaatagctaaaaactaaaaaaaaaaaatcccaaacaagttttacaaattgtggtatattcataaaatggaatactacttagcaatacagagaaaatggtgtactgttatacacaaaaacatggatgtctccatgactttactttgagtgaaaaaatagtacattttgtatgattcgatttttatcaatttctagaacagacatcagaagaggagttacttatgggctaaaagggaaagcaagagaactttctggagtaatggagatgttctatttcttgattgggatgttggttacatggttgtgtacaactgctaacccttacccaactctacacttggtaactgtgcattttgctctgtgtagattttatgtagattttcaaaatagattgtagatgttaacaagcttgtgataataaaggaaaatgttagccagccaaagggagagaaataaaaaggattgccaagatggagggagaactagaagcacttgtagcttcaccttacctagcaggagaaggggataccaactctacataaatttctaaaaataataacaggattatcaacaattgggaaaagaaggaaggaatagcatgaatcatcaagaaacagcattttattcagagttggtagccaacaagtgacctaaaataagaaaacgttataggaggttgcttcctgggaatggtatgtgaagggaggcgtgggcatgcctccttttcagtataagtttgtccatggatcaaatatgttactgtgtatacacagtgctttgatgaaaataacattttaaagatgttatgatttccccattgtccccaggataacattcgaaagcttcaatccttcatggtctggcgtccccttgcccctctagccttatatttgctagtcctttttcctcctcacactcctcatccacccattgtcttcgggtttccagaatgtgtcttactctgtttcatcctgggctttttcctataatgttttctcaggttcaaacacttaactcttcggttcccatactcactggcctaagggatttttttgtccttttttttttgttgttctgttttaatctgtgtgtatctacctccagaatgaaagcatcctaagggcaggaaccctatgtggatcttttggaaggttgcatccaaaccagctataacaggtacctagggctgtagttggttcccagtcatatatttaaaatgagtacatagtttgacattttaaaatagtagcatgactttaagaagcaatgtaagtgtcgaattctaaatctttccctgtttgtagacagatctcaagatgttaggtcaatggctacaaaatcttggagtgatatttctgaggatacagtaaaagcagtgattatcatatgtccattttctgaaaataaatgaggaccacttatattaatcaatgattttcagagaaatgaaaccaaaaggacacacacacacacacaaaaatggaaccaaaaggacacacacacacacaaacacacacacacatacacacacacagaaatttattaaaagagagattggctcagatgattatggagactgagaagtttcacaatctgttgtctgcaagctgggggcccaggaaagccagtggtatagtttcaatcaaggacagagggcctgaggaccatggggctgatggtgttaagtcctggtctgagtttaaaggcctgagaactaaaggcactaatgtcccaggttgtcagaatttccatctcaaggagacagcaaatttgcccttcctccacctttttgtttatgtaggccctcagtgattggagggtgactgcgcacattggtgaagtggtgaagtgatcttctttactcaatctgccgattcaaatgttaatcttttccagaaacgcccacacagacacatctagaaataatgttttgccagctatctgggcattctttagcctggtcaaattgacacataaaattaaacatcacacctctttaggttaatatcccaatactgacctggtcagacctaggagaagggcccaagaattccttgccttccctgtgtattagctggttcctcgctattaatggctttctagttagatcaaaatccaaagaaagaaactgcaggtgaatatctaaacatcaggaagcttttacatgatcgcctattgattaatgcttaaaagctacttatttaaaaatgctagaatgcattagaacattctctcttgcataaactactgtgtagtactagagatctacacaaaataaaattaaaaatcagctaaatgtgtacatttacataggaaaatattcaatatttacttgctttttatccttatattttataaattgttggcaaagcagacataaatagttctcagcttgacacaatatgtgacttaatttgtagtactcaatgaaaagctctggtactactggaggatttataagttaaattttaattttttttttgtttttttttgagacagggtcttgctctgtcatacaggctgggctgcagtggcacaatcatggctcactgcagcctggcactcctgtgttcaagagatcctcctgcgtcagcctgacaagtagctaggaacaaggtgtgtaccattatgcccagctaattacattttttatttttggtagagatgagctctcactatgttgcctaagctggcctcaaactctggggctcacgtgatcctcctgcttcagcctcccatagtattgagattacaggtgtgagcactgctcccagctaaattcttatattgagcaaaacatcttcagaaaaataaaatcaattctgtactaatcatagcaaaattatctttcataaccttacatacacatcttaaataattatatatgtttgtgtgtatctatcatatatacgacatttacatagacgataaattagcaggaacccactccaggatacgtgagctatttatagccattttagtggacctattatcagtcactttggttagctttcatatgagtatttgaaactatatatggatctctattaatataaaaattagttattgaagacttttctgcctgagaaaaatgaacaaaatgaatatttcaatcttagagcagtaaattattttttcctttgagagataaaatttgttttcacatgtggtaaaattttctaatattttattaaatataaaattttagtcatctttggacaaaccaatagctttgctgctttaaatctaaattttaaaataaaaatatatatacacatatataaatatataaaggtatatgtatatacacatatatatatttgtccacatatttattgagcttgagggtttgtaattttacaaatgtttaagaaaatgtaccattactctgtccctttcttcccacctctctattcttattccttagggaaaccatgttcaacatttttagctgctttttcttccggtttacctctgtgattctgaatatcttcattttttatgtttttgttttgcatattgtcttctgatttcctactgtggaaaatgggaatgattttaaatatatattttcctatatttttcagttagtcataaattttcagttaaatcaatattagtactcatattatggctataaaaatgttatattttattatatgattacatttctttaacaatattttgtttttcctggagttaataattggtacagttcctgtgaccttttttttttttttgtgaactctttcctaagctctctatcagaaatataaacaacttctcaataactttgttaaaatcaggtattctgtcatggctttggttttagttttgctttcctggagacattcctcagacagttgtttcctggttgtctgccctcctgttccaatctggggtggctgctctgtaattctgctgcgccactgtcatgcaccatttcccttcactgtcatcctgacaattctctttgcttttctcctgtcttggattttctccccttggggtttcatgtcttcctttttcttagttttcttcctaattttagtcaggcatatcctcttataacttctagagaaggcttccataattgagagtatacatttgtgagatatcacatggtctgaaaatgcctttattctaatctcacatttgattgatagtataataggtacaggaatataggttagaaataagttcctcctaaattttgaaagcatttcttcattttcttctagcactcaattattgagaggtgtgatgctattctgctacctaacattttgttgttggtctgctttttacaattgctttattttctttgattgaagcttttagggatttctgtttgtcctcagtgttccaaaattttacatttttgtgcctcaggttggatcatttttttatccattgtgtaaaatacttagtgaatcctttctatcttggtgattcatgtacttcagttctagtgtattttctggaatattgtctgatgaataccttggttttctgtttgacatttctggagctcctacaatatgtgtattggaccatcttgatcagtcttctaattttcttattatttatctctaatttttatctttttctcattatttttctactttgtgagtgtgatttcttcagctttattttctaattcctttatgggatgagttatttctgctcttcttttaaatttcaacgataattttttaatagtatcctgttcttgtttcatgtttgcatgtcttcttatatcggttatagtgttctaaagttttcctctgttcttgcattgttcctttttttggtttcttttgtctctgtctgaattgtccattcatatttgcaaatcaaggatttaaaagctaattagataactggtatttatgtgtagaacttgttgagtggtaagcattactattttatcacttgttcactttatttggtatatttagtttatatactaaactatcattaattctaggtatttttgtcctgtgtgtgttaatttactcagaaaggaatattctgaactcgttcctactagactattggtttaactttttagaagacccagctgctattgtcttactgggtggaggaggtgtagtcatctggttgcttagggtagggattggatctaagagcctatatgctttttagatgtttaaccaaccatttttctcagccctacctataccactgccttcaaaaatacaaatatgtgccctattcctgcacccttttctgatttctgtcaagtgaatttgcttgttaattggctatttctcttccctacccattcttagcattgaactttcagcttcatctgctctgctaagttagttgttttttatcttttcactttccggcatttataatttgcaccctgtctctccctccctgcctcttctctctgttattgtttcccttcttattctcattgttcttttgggcctctgacttttatatcctcatcttcacctacacccccacccccctgcccacagacctttttttcacttgtgtgtgtagttataggagggagcagaggctaacttgtttgactgggagtcttaacgattttaagagattttaaagattgaattttatatgatttcagtgaaataaactaaagcgatttgaattaaatatgtcttgaacatacacctcctgctctaccctcttttgcttcttgtgcagtagttaacaatcatagtaccaaattctaccctgagtacattaagataaacagccaagttcaatctcaagtcagcccaaggccagcttcagtttcaatgggggatcatttgtagtcaaaaatagagagcagtcttagaagagtgtcctcagggtatggtggctggcttccgccagagtgagcaagacgggaaaacgaggcagaagccacagtgtcatctgtgccctggcctcagatgtcacatttcttcattaattcagcatactattaattacagagataggctagtcaattcactgtggaagaggtggtacagggatatgaatactcagaggcaaaaatcaccgagggccatattggaagttagctaccacactggatgtttactcaggctccctcacttattaagttactctcagatccaagcttgaatgactcaggttgttgcacctatatgaattaagtcttatggtgttacttgtgaagaatgaaaataacaaatgtcagttttttgaaagccatttataaagcttaaattaaaaccccaacttgtgtaatttgttgtatattattaatacagtcatcagctaactaagaccctataaattggcccaacataaaattatccttcaagatgctaataaagggtatccacattgtgtatgtgtccagtgtttcatctgggtaggccaggaatcagatgacacccaaatagggacttctgtttggaagggctaatgttttgaaccacatagtatgtattttggaaggactttcttattaagaaaagtgattattagaaacgtgattataaggagcatcagagatcacttaccaatgtgaaattttaggaggatagagagcatctttatttttttctccagtagtcatttcttatttttttttaatcctaatactctaagtagtcacaatgatatgtgaatcattgcatgatgagacaataccggcttctctttttttgagaaataatttctattatcatgactgcttttgaggttggtgaagatttaatattgccttacatcatgccattgaaactacacattcaactttgggattttaaaaattctctaaatatggacttttagggggtaagggagtgagagagttgtaatttccattttaagtccactagaaaccaatataattagggtacagcatattctgtcctgtagtagattttagaaacatgcaaatgaagcacactgttttccatggttgtttgattttcatttgggtgttttgaatttaatgagattttcctgatttagtgaccagtaagctgacaccatgttttactgtggaaggatattttttttcttttaataagcacagcaattcattgcatgatacaccattgctgttttgtgatgaggaagaacctaccaatccaatgtacgtttattctccttttgctaggacaaaatgaatttgtccagccatatcatagcctagagatatattatttctgtggcaggaatccattgccaaaaataaaaaaaaaattatggaactaaaacagttcatgtaggtaggaagtgtaagactcactgccatatgctgttctcatcctatcacactcaacattgaattagttgaaattttaacatgtaccttcatttctctgtagcagaaactttctgaaaactgaagaggagatcaatcataccattattgttactggaaattaaagaagaatgtttttctcatctttttaattggagaatcaaaagaagtgtattgaatcctggactatgtttccacggaactagttttaataggtttcatgtaagaaaaacaattctgtcatcatacacattcagagaattgtgaatctgtaaacaaagttaaacagacttccttactgcaggtcaccagagagcacatacgcagcctgcatgcccaaaagggagcttttatattaatccaagattgcagggacccttttttcctctaggagtatgttatgatgttagtgtctatggaataaaatctgggaaacacctttgtaggtaattttcactcattgcaaaccgaagttcactttggttcttgatattcttgatcaagaattgatctctaacaggtgcttattatgggccaccataccattttcaccagtacttctctaattctatggagaaggcaatatttgatatgttaattagtgatgaagctgactataatatgcttgagtctaaaattaggcataattacttctatatataagacactgagcacagtttgcctaagctgaagttaaatgtgttgagaatttgaattcccttttataggctatttacctcagtaacatttaaaatatttatggaatgaatcatccagatttactctatgctaggcagagctttaggaacatgaacttataaatgatgttgagattgtggtttaaacaggctcagtaaactagtccagggtcccatggctggtaacgtagtgaagcaggtactcaaacccagttcattctgacttcacacagctcctaactacctctggcatatataggcatagatagaatgcaattaataataattgtttagccttatcagagaacaagtatcctaatttaagtaaaaataatgggattttatctgcattttaaaaatgatgatgtatattagagcataacggtatagacactcagaattttatctccgtgatgacattggctttaacagtagtgcttagtgagtaagtatccccgaataattagatgaagataatataaaaggtgtatttctaagcaaactgttttaagcatgtggaagtatattttatcagaggtttagttttttttttgtaaacttgtcgagtgggcgtttatttgagaggcattgtagtagaaagggtcctaggctttttaagtttccatttctccacttactagatatcctattattagtatattttgctcaagttttttgtttgtttgtttgtttttgttttacctctttggagcctgaatttccttcaatttaaaatggtaaggtagtatgtatttcaaaggattgttgtaaatattaaatgaaataacttatataaaacacataggacaaggcacaaagctatcacatttttcttcccgttttctctatttcagtaatatttaaaatttttatttgtcattgaaattaactcatttaatatatatgttaaatcccaagataaaatatcctagaccttctacaaccagatgttatcctcctaacaaactaatttgtagttgaacatctgtttaaagcctggctaaaaattgccttaaaaatccttcttttctgatactaagacaatgtttttactcatttaatatttcagaaatgttcagaaaagcggttattcattcactagtgggacttgcaatcagtggcaccttagaatggaagaaatatagcagaaacatactgggtgatgcagcaaagaaatgtgttgaaatctattacatatgaattgttattttctccatttcgtagaaaggaaactgaagttccaaacacctgtgtagcagtgggtagagaaaagactcggattccacttttcagagaagatcatctctacttacacttaacacaagtccttaattccacaggagtaaatccggatgagccaaattggaaacaagaggcatgtggagtagatcagaaaacacttttttcacgtgtgtgtattatttttaaacttcgacatgaactaaagaataatcatgaaatgtatttcttcaaaagcctttaaaaacagataatctataggttagaccatttagagaggtaattcgtctgggataatttgtgtaactttctaacagtttttgtcaaataaaaaactgtagtaagtcgacagtgcattcatgatgtgcattcactgatgtggctcaacattggtaacagtatgtagagaagaatctgacaatttcagaaatataggcacacatatcagatgattatatcaatgcaaacctgttgctttggttatatgagggtacacttcaaaaatacacaactcaaagcttttttctttttctctgtcaaaatagacaaacccaggttaataaaaatagccagggagttcagtctcccaggaagagcagtctgaagaatgatgacatacattgtgccttgaaggctacaatcaatctttattgaaaagaatctacactgaggacaggcagggctttttggacattcctacctcattacattttgcatttatctgccatcttcttacctctgttggtcattgagggttataaccatttacttagagtgattttttctttttacaaatgaagataaatgagcctacaatattaaatcacatccttgtttcctcattttatttcggtccctgtaaagattaaatgttgaacttttttctttaaaacttaagtaaaacattgggctaggaaaggttagtggcttaatgtatttgtttttctctctttttttctatctatctatctatctatctatcatctatctatctatctatctatctatctatctatctatctatctatctatctatctattgctcgaaagagagagggagagagagatgtaattttttgtgcaagtagaaattctaagtttaaggtctgattttatttatttatttacttatttatttaatttatttatttagggacagagttttgctcctgttgccctggctggagtgcagtgacgcaatctcggctcactgaaaccctcgcctcccgggttcaagtgattctcctgcctcagcctcctgagtagctgggattacaggcatgtgtcaccatgcccagctaattttgaattttaagagcaatagtttgcagactgggagcctcaaaactgaaaaatggcatcaagcctcaattctacagcagttacagcacagttgacagggaataaaagaggaagtgtgttcacctttgtcgtgattggctgtcatgttttcttttttaaggcaaatagagctatttaagctgatttgtctatagctgattgatttaatttcactgaatcatgctgtgaggggcaaaaacataacgcttgcatttttatgtttagggttaggatttccaggaaattgggatgacctaaattttgcttaagtgtctatgggtggttgaccatgaggtatccaaacagtagcccccattttcatttatttatttttagcaataggaatacaggaaactataccaaatttaggcaactatttactaaaggaaaaccaaaaaagggtatgagcccattactttgttcagtaaggtctggttttaaatatcgatcttattaatgctttttgcataaagtgtaaccttaatgtgtatttttccttgcttcatctccgaggtgactttctagttaggacaccattggatcaaggtgctcaaaaacaggggggcccctctcccattacacagcacagtgcttctgggtatgtcctgtttctggcagcttgaggatctgactgacatagcaggatgcttcagaatatctttttgtaggaaaactctctctcattctctctctacttcatctgttctaactaaattccaaaaaaaaaaaacaaaaaggagtgggagagtttgtattgttcttctgaaaataaaaacttagaaaatagctttttttggtattcagccacaataatgtgcattaatattccaatcttccttctgctcatgaaaaaggacacagaggaaagactaacaaagaaaataaacctgtaaagaatagtattgaatgtgagaagataaaattaatatattcctaatgaccatgacaggaaataatgatagcattaaactgtagtgtcttttccataagttttagatatactgggcatatgtgatgcttattatacacgtaggcatctcaagcagaatttaaccttgagaataattgttaacaaaattgattattaaaaaaaatcaatggctttgttatttgagtgtaaacacgtacacaaaaatgaagagccaaaagttagtggttacgatttctctcttgttccctgccctagaactgagttgttaaaatccaaaacaatatgctttttaaaagctatgttgtatagtatttattgcagctatcatttgcttcaactttaacctaaaggcaaagtcatggtaatctcttccttgctcagaaatctttggcatctcctcagagcctcgaggaaaatgaatttttttgtatggtattcaaggcttcacaaagatctcccttgctagcctcttccccactccttccaccctgcttcctatgttcacaaagttctctgccttgcctcaaatgttatagatttcagtcttctttgaaataccctcttaacacttctctgcttagcaaattcctattattctcaagggtcagctcaaatttaccctttagtgaggagggcatcttgcattcttctttcttctgacttctggccaaattactttcttcctcccttgcattccctggctcctttgttcatatcacaagtttggcttagattacacaattattataagatacttgcttttctgctagtttcttagtcttttggagtgcagatacagtgttatttatcttttaatcattagagcccagtatggtaaaggagagaaataaatgaattgaatcataggtctatctccagatgttaaaagtcattgtaataaatgagggagaaaatatccaaaatgtttttcttctcctttatctgagtctatcaatcttattgcttaagtggatggactatttgaatagttgatatttctaattagcttgtgtattccaaaggtaatttacgttgctcctgtgttttaccattaatcccaaactgtggacatcataaagatgccttacaaaattaatttaataactagctaaatatagcataccattttcttcaaactgattgcttcatgggttcttatttccatgagatcttctagcagaagtaatttcgggttggtgtctatctgaaagccttctgtctagcagatagcattgaagtggagctttccttaaagaggacagaaaagcagactgtcttccctctttgccgcagagccagaaggacagggtgaaaagtgtctttcctttgactaaagagaatcacattccactaaaggcagcccatttcagactgattattggccaactttatatccagaaggaaagcaatttaacagaaaaggagtagtctttcagagaattaaattttttgtctagatttggactgaagaaacaaggcatattgaggtagagcaattaaagctcttttggtctagaagagaaaatcaaactctaagggaattttaaaagccctttttgttgtgaaatatgacagtttgcagaagcctgttcttcttccacttaccctttcaatgaggaaacttatcttcctgacaaaaattgcattaagaagcagctgcagccgttttcccgtaggcagcattctgagggaatatttgagagaataactccccaaagataaatgggttcctcagtagccttgggcaggaggaataaaggcgattctttatttttcatactgtgggcacttctgtgaatttgctggttagcccaagctaaaagtcaacacaactttttgattaggaatagttgcaggtcagcagtactttttgttttgaagttttgcagcacagtcctgtgggtggttatggttcttttctctgtttccaagtttgcagaagtttgagaggtgaccttttgtggactggaggaggctgagaaactgagtgaagtgcacactgtatacccctttgccgagaaattgtctctcaggctgcagaccttagagcagtggtaactatgattgacatgtaatgatgcattcaaagcacacatcacatagcaagaccaaatcttcattctgaagtcgtatctaagtgctaagtcctcattctgaagttctgaatgaagtttagcccctcattctgaagtgccaacattcatcttcacaatgatctgtgactctcctcaccttctgttgctttcttcccccattgtccctacagatctttccttcactgggttacatccactcctgcgtcaggatctccttgtcgtagacttaggtttctccaagtatttgtcccctttacctctggttagcccacagtgacaaggcagcaaaactcatttttataaggggtggagggggaatcgttgtgataacttaccctttaacatttgtctcataggctcataattccattactttgcctgtaatagtggtaagtaaatatgcccttctgtttaggttttagggcaaagtagtattttagcagttaagaatttactgagcatattcctcttcacaaataatttattggtgattaagtataaaattaccctgtgtttttaattcttattttctcccatctcttttctcttctctttttctctcattcttctttttttggggggggcggggacagagtcttgctctgttgcccaggctggagtgcagtgacacaatctcggctcactgcagtctctgcctcctgggttcaagtgattcttgtgcctcagcctcccgagttcctgggattacaggcatgtaccaccatgcctagctaatttttgtattttttgttgagacatggttttgccatgttggccagactggtctcaaactcctggcctcaagtgatccacctgcctcggcctcccaaagtgctgggattacaggcatgagccaccacgcctagcctctttctctctcattcttggtagcagttattacctatacctttttgaatgctgaaagtattgattaatgctcgtaagacttagtaacacaaatctgtagtacttcatgtaacaagagcaaatgtttttcaaatctattataggaaccattttatctctacaaataagaagttaaaaaatagtttttaggtaatatgaaaagtaatttgaaatcacaatttaacaaaacagggccttgtgaaaaattttgtttgttgataggacaactgatgttaaataaatttttccacattaaatgttttcagttgactatgtttcaaagaaaaaatgtaatggattttatagtatatagtatagattttatactacaactaatgaaatggaacctttatggtgaggagggtccttggacagtggacgtgtgactggtagtaacatgtggtccaaagtgcagcagggacagataggagacagaagtcagaggttgatgttgaggtaggggtggtggtggtagtggtagtggtggaggaggacacagatgggccaaacagccctacatttgacaccagtttctgaatggtgttaagactatttagtaaagatgttgagtgagcagtgagaagtaagagcgaggagcgagaagaaaattagagtgtagcccctccttcgcattcaagcttccccaccaactaaaggcacagcctccagattctaccccaaagtgcattctgactgatgttataaattgcttttgcttcccttcataaggcggtattttctagaatgataattaatgatagagttgtaaaacaatcttaaacaattaattgggaactatcaaataagtatctgtgatgtttgatgttggaaaaacatgatatgaaccttttgctgaggaggccctagtttactagttgaaagataaatttgtcatgacatctcttaatacaactttatatatcttcattactcaattaaataaaaactcagcaataacaaaactttattatatgagaaaataagaaaatagtatatgatgcagaggaaaaaactaaaggctgataaccaatatgcctgaattttagctctgccatctccatccccaacaagaggggcattgcttttgttttgcgtattgagtttcaatataacactttagttgaaaagaaggttcttcagcaaaatacttgcaaacagaatccagcagcacatcaaaaagttaatccagtgtgatcaagttggcttcgtccctgggatgcaaggttggttcaacatacacaaattaataaatgtgattcatcacataaatcgaactaaaaacaaaaaccacatgattatctcaatacatgcaaaaaggctttcgataaaattcaacaccccttcatgttaaatactcccagtaagctgggtattgagggaacatacttcaaaacaacaagagccatctatatcaagcccacagccaacattatactgaataggcaaaaactggtaatattttccttgaaaatcagcacaagacaactgccacttctatccaacacagtattggaagtcctaaccaaaacaatcaggcaggagaaagaaataaagggcatccaaataggaagagaggaagtgaactatctctgtttgcagacgacatgattctatatctagaaaaccttatcaactcatcctaaaagctcttccagctgataaacaacttcagcaaagttgcggagtacaaaatcaatgtaaaaaaattactagcattccttacaccagcaacagccaaactgagagcgaaagatagaaaggcaatcccattcacagttgccacaaaaagaataaaatacctaggaatacagctaaccagagaggtgaaagatctctacaaggagaattacaaaacactcctcaaagaaatcagagaagacacaaacaaatggaaaaacactctatgcacatggacaggaagaatcagtatcattaaaatggctatactgcccaaagcaatttatagattcagtgctattcctatcagactaccaatgacattcttcagagaactagaaaaaaaaagactattttaaaatttatatggaaccaaaaaagagcctcaatagccaaggcaatcctaagcaaaagaacaaagctggaggcatctttaccagacttcagactatactacaaggctacagtaatgaaaacagcgtggtagtggtacaaaaattggcacataccagtggaacagagtagagagcccagaaagaagtctgcacatctacgaccacttgatctttaacaaaactgatgaaaacaagcaatggcaaaaagacttcctattcaataaatggtgctgggataactggctaggcatatgcagaagattctttacaccatatacaaaagtcaattcaagttggattaaagacttaaatataaaacccaaaaccctggaagacaaactaggcaatacctcgtgcacataggagcaagcaaagatttcatgacaaagacaacaaaagcaattgcaacaaaagcaaaaattgacaagtgggatttaattaaacttaagagcttctgcacagcaaaagaaatgatcaacagagtaaacaacaacctgcagaatgggagagaatatttgcaaactatgcatctgacaaagttctaatacccagcatttataaggaacttaaataaatttacaagataaaaacaaaaaccccattaaaaagtgcgcaaaggacatgaacagatacttctccaaagaagacatacatgtggccaacaagcatatgaaaaaaagcccaatatcactgaccattagagaaatgcaaatcaaaaccacaatgagataccatctcatgccagtcagagtggctattactaaaaagtaaaaaaataatagatgctggcgaggttgtggagaaaagggaacacttatacactgttggtggtagtgtaaattcgttcaaccattgtggaaagcaatatggtgatttctcaaggagctaaaagcagaactaccattcaacccagcaatcccattactgggtatatacccagaggaatataaatcattttaccataaagatgcatgcacgtaaatgttcattgcagcagtgttcacaatggcaaagacatggaatcaacctaactgtccatcaatgacagattggataaagaaaatgtgttacatagacaccatggaatactatgcagtcataaaaaatagtgagatcatgtcttctgtggctacatggatggagatggaggctgttatccttaccaaattaacacaggaacagaaaacccaatactgcatgttctcacttaaaagtgggagctaaatgataaaacttatgaacacaaagaaggaaacaacagaccctggggtctacttgagggaggaggttgggaggaggaggaagagcagaaaagatagctattgggtactgggtttaatacatgggtgatgaaataatctgtacaacaaccccccctacacgtgtttacctatgtaataaaccttcacatgtaccccaaacctaaaatattttttttaaaggaaaggaggttctatacaaaaaaagaaaaaaaaaaactttagaactctctggcaatacatgttatgcatcctgtgttagtccttgggtaccgtgaaatttccttcttttttttttagagcacctagtgccctccatcgtcatcaaccacccactgctgcggatgctgagcccccatctgttgagtgcttaccctgtgccagaaactctgtattgcctgtgcattttctcactgatcacttagactaggcttgggcaaacttttttctgcaaagggtcaggtaataaatattttaggcttttggaaccataaggtctctgtcacaattactcatctctgctgaggaggggaaaatggttccataagacaatgtgtattgtgttgaaataaaattcacacactacacggtaaaggaattagaactagaatcctggtcgttcaacttgaaattttacaatcttttcataattcctgctaatagtgtgacctcctaaactgtaaaggaaattttgtaggttaaaaaaaagatgtatttatcttctgtaagtggatagcaggacctttaggaaaagaataaaagtaatagaagaccaaagaggaagagactcttgggaagaattttttatttcacagaaatctttctcccccaatagaacaatgaattgcttgtcctaatattgtttccttacctcttaacatattgccatataacatattctgctaacagtataaagacttggctgtctttactttgctattattctttctgaatctacaaaatttttctttaaaaataatctgcatgtgttctccttcatttatttccacacttttccttcggaagacttgctagtcattggagaaaatatggtgtaatggttaagggcccaagagcgcaaatgagatttcctagtttttttatccccaactctattaatctttatcaaataacttctctgtgcctagatttctcaactgtagagtgtgtataataatagcatctatgacctagggttgctgtgaaggttatgattactgcatgagaacacacattgtgtacatgctggttactctccagcttgctcagtacatgtgattctttaccactcttgtttttagtacaagtcagtccttgagtcaccctgaaatttgccagtcacatttatttacttgatttatatttttcactcagatctgaatgctttaggaatatacccataaagagaaaaacttaaaatatattttacatttacatttttatgcaaatatgcatagattattttgattttaattgctctttattaaaagaagagtgccttttaaaaattaagtttactataaggtaaaatcctcattcaaggtgaaagcatttgtatttgaggatctgaagaagaatacatttaggtgatgttatctaagtgcaatgtatttttgttacttgtaaaagaacagtaaataacagacatatgtatagtcattagttatcatgattgtgattgatcttttaccctagataccaagtatataaagtcagttgctttgctgtctttggaattataataggtttgggtgaatgttctgtgattgctgataattatcgtattggtgggaatgtaccatctttgaccacatcgtctgtcaaaatttcagtatgtctaccagtctcccttcacctctcactcgtccaagaagcattcccaaggtaaagcagtcttattaaaatggaaggatgtccctagtgtgttgcgtagaaaacaacaaccatgatgagtgcagggatactctggttaggtaaattttctcgtgtttacatggatcttaaatgttaaccttgcctgcagcataattccaataagacaagaaaaaggtaagtaaactatattgaaaaaagtgactcttgttttccaagctaaattctgcctctggcaagacaagtcaattatttttctagtcaatgaagatagaaaaagaataaagtaaccagttgatttctgcttctgattagaaaattttgttttaatctcagccagagatgtttcagctttgccgcagggcaattttaaatacagttgtcaagggaggacttcttgagaaaatgacactagaacaaattcttgaagggagagagccatgtgaatatagggcaaagagcattccaggcagagggaccagccagtgcaaggaccatgaggtgggaacatgcctggaacatttgaggaacacgaaggaggccagtttgattggtgcacagtgagcagaggaaagcaatagggaatggagtcagagaggtagtagggaagggtagagggacatcatgagagctttctaggactttgtaggaaatggtgcctttttattaatttctctgtttagaactttgtatttagaaaatagtgcatttttataaaggaaattacttttataattaatacttcctttatgagagaaatcattacattattttaatttttaggaaaattcacaaatacatatataatcattttaatttcccatctctgatgaaaatttttgcctataatttcagtaataaagtatcctttgtaaaaattgttttctatatttgaccatcataccattttttaatatgctatattcagtttgaatgccgaacctccaatggttagctcattgttttctatatttttatttgacagaaagtagttcaaaagcaaatgaactactttgtggagattaaaaatatagtgagcaattttatgtcctttcaaaaagcatagtttgaaccaagaaaaagttactttttgttcctgctctttgatttcattttaattttaaaactaatttcatgcttttaaatgttaaattactataagggttttcaactttctgtccttaattctagcattatctattatctaccatgctaatttcctttctgattaattgggagtacgacagacaccagcacaaaaatagcagaggtcaaaatacttaacaaatgagatactgatacaatgcataattcatgaaatatattcactcctgtttttgatcttcctcaattgtaatgcgtcttgctaaatgcagctcaccacattgttttaaatgttgctgaaattttcagattcctaatgtttttatacttgtgaaaaaaaatctcttttggtctgttttgtcattggctttctttataaaagtttcttcttaaaggaatactcatttggctttgtacttcaaagttctctaatatttggttactcatgccagaggaattgtgagtaccagctcataattcaagttaatctatcgataagcaaagtataaatttacttcaccatataatgtaccagcattctattgttttgtgttttcaaagaaaagaacataatttattgttgtccttgcattagtcatcaggactattgcagctgcaagtagcagaaatccaattcaaattattgtattttaaaaaggatgaggggaaactaaaggatgtgggtttgattccaacccagtggctttaggtattcaaatgatatcactaggatgctgactgtctgtgcatttctctcacttcactaactcctgagtttagcatcattttcaggcaccacatggcagcaaattggcccctgtcagtctcaggcttatgcggctcatagctaacaatccagtgtttattatttggccacaagggctatatttggccattcttagccatgagaacacccctggataagtctttgtccagaagaatgggaaactgatatggattaagtgctcaactgagataggaaaggtgaaatggcaggaacagagaatgggagactttaaaaccagagatgcaagatgaacagcagcaataccaaattccagtgtgggttagtttcatttgtttcacaataaagggaaagattatgatgacatttttatcatttgtttgtttttatccctgtccagtaaaatcctcttttagattttaaaatatcctacattaaaagttaaaaataaatttaataagcaaaggcggtcctgctgtattctgggaagtgtctgtaaggctaccgtgctggaagctggttgtttggggtatgtgaaacttcaatgtcagtctgcctgctttctgagattcagatattgagatggtgacaattttgtttcagagcaaagaataaagaataaaaggcaagaaagtaataagaaaaaagaaaacccttgagcaggaatagtaacataacaagatcaccaccatcctttcagaccaacacatttaatgagtctcagagatacatcaagagcatatttcttattccagagtcaatagttagcaactgaaataacctagtggcattaatgctcctgcagggccatttccctttttcatttctgctgtcagaattttcgacctcatcatccctagcctggattaccactttggccctctgcttatcacacctgctttgagggggtcaggagctcaacttggggtcaggctcaccatcatttttttctgagttggagtctctgttgcccaggctggagtgcagtggtgcgatctctgctcaccgcatcctctgcctcctgggttcaagcgattgtcctgcctcagcctcccgagtagctgggattataagtgtgtaccaccacgcctggctaagttttgtatttttagtaaagacggggtttcaccatgttagccaggctgatcttaaactcctgacctcaggtgatccgcccacctcgccctcccaaagtgctgagattacagtcatgagccactgtgcctggccacaccattttgaaatacaaggttaatcatgctgctcatctgtgtaatactcattgacactttttttttttttttgagacggagtctgtctctgtcgcccgggctggagtgcagtggtgtgatctcagctcactgcaagctccgcttcccgggttcacgccattctcctgcctcagcctcccgagtagctgggactacagacgccctccaccacgcctggctaattttttgtatttttagtaaagacggggtttcaccgtgttagcccggatggtctcgatctcctgacctagtgatccgcctgcctcggcctcccaaagtgctgggatcacaggcgtgagccaccgcgcccagccatcagtgacactttcttaactacagatgcacgttttggagcacaggaccttttatgatacatgcctaggctctggcgagtgggaacagcagtcacatgacagtctcacatccccctacctatgagcaggttgcataggtgtcagtgagcgggttgcatgggtgtgagtgtgtatccagtgtacttttctgggtcttagtttcatcacctataatggggaatcaaaatagtgtctgccttgtagacttgtgttgtgagaactcaattcaaaaaaaaaaaaagtgacatattcaccacagcatttggcaaatactaaactttaaatgaatgttggctattctctgacccctctctgtctgtagccctatccatggacactctcccaaatttgtcctatgatttagccacagcaaccttctgagttcctcatttgccactctgtttcacacttcttagccttcattcatactgccccttctatttcttccactagactgaacagtataaagttagtaattctctcttccgtgcttttatatacttaacacaatgccaggcactttgctgaagactgtaacaaatactgctggatgaggacaactatttctttctcaaaattgaattgacttctttgtgtacttgccttagttcagcttcatggtggggtagtgcagaagcctcattgaaggaaactattttgccctagtgtcagggatattctgcaacactgcagaatgggttttgtgggctaagtgtagtgattttactgacagccttttaaaattttctatgctgtcccagagacttcatgaaaaaaaagttgtatgatcggcctgtttcaaataaagctaacattagatcatttaaaaaagaaatcatgtttatttctagggttattagagaaaatataaaaattgtcttgaaattgtagaagcttctctggagctgttttggggagttttggatggggtttattactgctggatgttaagaacttcttctagattatgacttgtcttcttaagactccaccttccctgtgccggagaaaacaaacatgacccctgcaagtgcaggtcactaatattgagggtattgggctctgccatcaaagtgtgaagaactactggccctttcattttcatcagcattgaaccattcaaccagggtgatttgtccgcagtaaaatacattagaagcatttctcctactcaaatgtgtagttgttaattggcaacttcttctgagaactcaaaaatattcattcttccctgatttccatagccagtcttgataaaagtgaccccccaaaaatggtagttaaaaggagaaaagtatgaagtgctaagagaaataaagttttattataaatatctttcatattagaattactttatttgcaattgcagtgatttatttttggtgagttgcccagaattgcttcaatacagtaaatgactgtcttgttcaagacatgcttcttacttgtttgtgtatgaacacaaaactatttgccctactttataaatatttaggttcattttatcattagtccccaagtaaacaaacatctcatccagtgacaaaaaagcaatgtattctaattgtctaatataacaaaacatttttaaattaactttatgcaaatttgataggatatttttcattagttgattaaaatgaaatgtttgaaaagttgcttcaaatatttttcacaattaaaattattgttgccatagattaatttgtcattgaaacacttacaaaaatacaagttaatttctttgcaaactcattgcaattgcacttagagatgtcttagaaataaattataaaatattttttaaagatttatattagctttataataaaatataataaatgatggctttgaaattatttgtattgaactacaaaaggaaatgtcgtaaatcccattctgaaaaactttttattctttgtaatggtaaagggaagcattacatagaatatctttaagataattcttttgaggccaggtgcggtggctcacacctgtaatcccagccctttgggaggccaacgtgggcggatcatatcaggccaggagttctgtaccagcttggccaacatgatgaaaccccatctctactaaaaatacaaaaaattaaattggcatggtggcatgcacctgtaatcccagtatgcaggaggctgaggcgtgagaatgatgaacccaggaggcagaggttgtagtgagacaagaacgcaccactgcactccagcctgggtgacagcgagactctgtctcaaaaaaaaaaatgataattcttttggcattctttgttatatttatttcttagaaagaacatagtgtgtgtgtgtgtgtgtgtgtgtgtgtgtgtgtgtgtgtgtgtgaatgcccttcttcctccccatcctcagcatactagtttcttattttcataaaataagtgataaatttttttggatttgagaatttattaaatcaagtcacgtattaaggaattgggaagcaaatatgagagagggtcaatgaaaaatttaggatgctcacatggtaaatcatgagctttaaaatcagagctgtacataagaagctgtgttttaataatctgcctttgccatgtttcttcttccagttgaatcttccagttggatatccactatcttaaatgttatgaacacttaggatcttgttatgtatatttaagaaacttaaaatgcttattacaaattattaatgcttaggaatttgatttttgccaatgcccaagtaacttattggttggaaactgcatacatttgatagaacaagggctgattataggtgaaactaagaaagataaagctaggttttggagacttgcaccttatatcggagacccagtcctaccatgtgtgtctgagagtttgcatttcctttggctatacattaattcttttaaaaaatttgaaatataatatacatatcataaaattcacccttataaagtgatttctttatacaactttatacaacttagtgatttctagtgtattcaaaaagctctgtaaccatcaccactatctaattccagaatatttccatcaccttaaaaagaaactgtacccattaatagtcatttcttacttccttcttttctagcccctggacaccatattctactttctgtctctatggatttgcttatcctatctctatggatttgtcctataatggacatttcatataattgaaatcatacaatctgtgcccttttttgtctgacttctttagctttacataatgttctcaaggttcattcatgtagtaacatatatcatttattcattctgctttatgattgaataatattccattgtgtgcatatactatattttgtttatccatttatcaattgataaactagaataattccactttttggctattgcgaataacacttctatcaacattcatgtataagttttgtgtgaacatatatttttaatactcttgtatggatacctaggaatgggattactggatcatatgataactctacctttgagtttttgaggaactgccaaactttttcacagcagctatgaaccattttacattctcagcaatatatggagattcaagtttcttaaccttctagtcaacattttaatttgcagttgcctaattttgagttatttatctttttattgctgagttgtaataatttttcatatattgtagatattagatccttatcagagatatactttggaaatattttctcctattatgtgggttgcatttttactttctttatagtatcctgtaacatgtacaagtttttagttttgaactccaacttacctttttctgtttttggttggctgtgctttagctgtcttatcaaaaaatatttctctaatccaatgtcatggaaaattatacctatgttttcttctaagattgtcgtagttttaattcttacacttatatttgtgatctattattaaattaatatttgtatatggtgaagtagaggtccaatccacttctttttgcatgtagataatgattgtttcagcatttgttgaaataactgttctttttggcactcttgttgaaattcaattgaccatggatatatgagtttgtttctggactctccattatagattactgacctttatgcttatcctatgccaataccacactgtttttattattgtaactttgtagtaaattttgaaatcagtaagattaagtcctaccaacttttgttctttttcaggattgttttggctttgctgggtcccttggattttcatacgatcttatagataaacttgtctatttctgtaaaaaagataaaaggcagttgaaatttgtggaggaattgtatttaacctgtagattaatttgagaggattaccatcttcacaacattaattcttcgaaaccatgaacataaacatgtctgtacttgcttaggtcttaatttctttcaacaatgttttatagttttcagtgtacaaatcttgctttttttgttaaatgtgttcctaaatacttttttatacttgattgctattttaaatgaagttttttttaaatttaatttacagtttgttcattggtagtgtatggaaatacaactgaactttgtgaattgatcttgtgtcctccagctttgctgaactcattactaactctaatagttatttctttgtgtgtggaatccttaggatatctgcaagtatttttactttttcctctgtactcttgatgccttttatttcatttttgcttacttcctctgactagagcctccagaatagaagtggttaaaatggccatcctttctcgttcctgatcttaggggaaagcttttagtcttttaccattaagtatgatgttagctgtgaaatttggataccatttaaattaagttcacttaacttgaattagattgttataaatttagatgttgattgtagtccctggggcaaccactaacaaaataactcatcaactcatctaaactacactccaaaaccttgggaatttattgcatgcttccccttctcctgccattcttgatttcagctattttcatttttgctgggcctattgcagaaactttaaaactatttcctgatattccattctttctgtcctccagcttatcctccatactgaaagcagaaaaatgcatatttgatcgtatcatctcacaccatcctactactgctaataaatccttcagtggttcggcattgacttcaataacagatgcaaactccttggctgccatctcagcacctttcttgaaacatcctattacctcccctgcttcttctgatggtctacccttcacatcagacacatacattgacacacacacacacaaatgcacacacacacatccttactcctttaaccatccttgtcctaatcacttcacaaacatgccattctctctctctctctgtcctttccatgtgttgtttcgtctgctgaaacacttttattttctccctcatctatggtgcctcaaattttcaaactctcacattaccttctttaggaagcttgcctagcttccctttttctgtttgatggctttctatcctccactttcctcttctaaccctcaagtataaaattacactttattttaattgttgatttacgggtctgccactcaccttgcccgctgagtttcttgacatcaaattctatttttggtttctggatatctcaagctgaacagtgatatggagtaaatgctcaaaaatatttgaatgaatgcttactactaatagtgtactcatactgcccttctgggtatccagaattaaatactgagttttactcagacatttctccatggaaggacatggcatcttgaatctttccttcttttatccctctttcagcccattctatctgcttggttataattactacagtacactcttcactgaagaaaaaataaaaaaaattttgatttgaactaagtgatttcccgattatttgattcctaatctaagttataattctctgggtcaatagttaaaactatgctcagggttttgtttttatttttttcttataaaagagtgattttttaattcagataatatagacacatgagatataaattaaaaggctgattttaaggccaggtgcggtggctcatgcctgtaatcccagcactttgggaagccgaggcaggtggatcacctgagatcaggagtttgaaaccagcctggccaacatggcaaaacactgtctctaccaaaaatacaaaaattagccaggtgtggtggtggttgcccataagcccagctacttgggaggctgaggcaggagaatcacctgaaccccggaggcagaggttgcggtgagccaagatcatgccactgcactccagtctgagcgacagagtgagactgtttcttcataataataataatagaaataaaaaggctaattttaatgttaatctcattttcctgaggcccactggaaagaatgcagtggtggcagggctagccaaaatgagataaaaggatcacagtttctccaggtaaggcaaagtatacgttgtcagtgcagaacaggagtagccattgtctggcaccccagtggatccccaaggacacagactttcattgtgtggtttagggaaaggcagaaattatattgtagagattcagcaattccaatgacagattcagagacttgattgtgttccatcagggtaccctggatgatagtcttatgaatcactccctattgaagcagtagatctgactctagtcattaagggattcatttgcttttgcataacaaacccaccaatccctttgtaacatattgctacctcactttcacatttcaaatatagacttgtgcctacattcaaactgatgaattggaatcaaattatgttacccgtctttaactaacatcaggtggagtgtcttgccccctctacccactaaatcttttattactttggggaagggacactggcaagccccagatattgacttcagctttctcttctgaagatatttcatttttggtgaactcttaaagccatcttagattaataccaaataggagaattttgggccctgtggcaggttgacaaaacttcctggtacttcatgtcataaacactggatcataatggctctttaataacctgaaaatgttgacataaacccatggcttatggcattacctagagtcatttagatactgagctaattcaaaatttgttaggcaaatgtgtataccattatgataggatatttaagcccttagtaaataaaactgtacttatattttgcaaatataaatgtaacatcaagcagctatgcttagtcagttttctaattgggaaatatccgtgaattataaagcatgacttaaaatatttaatttgtaattagcgtagaattacaaagataattcataaactcactgtttacagatgagattttaattgtgctttttaaggcttaaatatctctatcatatggcatatttaatgagtcagaacaatttggaagtaattattattatgaaaaaataattctgtggcctagataggtactgcagatgatatgggcttactgactaaaattaaaaattggaagtaagagcttatagaaaatgtgacactagcataaactaagaaatatagagagaaggaaggaaagcctgtaaatgcttgacattttatgagatatttcatttactgtgtcacattagactgatgatctaattcaacttccttgtttcacgaatagagaataaacttgagattcttcaaatggccagacgaggatcacacaacttactgacaccatcctggggtagaacccaagtttctaagccatcaattttatgttgtccccataggaaactctcattatgaaacaacttctcagatgcctattgatctgggtttaaaaaatacttaaacattgtcagaatgtgttatatgtagtcttaagtatctcagagtttcaaacataaatgttcttgaggtcatatcttttccttcatgatatgaagaaaaaaataaaatatttttcctaacaaagaaagtggaagtataaagtctattggaaatcacctttctcttatgttgatgtataaacagaattccatatcttgtctggttataagcactatcaggacaatttttatttcaatagttaaaattgtacataataaagaattataatagctacttaaaacactaaaagttaatgtggctttttataggtttaggagaacaaatactgaactcttttgtgggaaaactcagagcattcattgttccggttatatctgaagttatttacaagtataattcatgaacttctattttatctgttaaacaaaattataggaggccattgttttggactgagctcctgttctgggccccaacaaaccagaccaaaccaaaatggagtcactcatgctaaatgccaaataatcaaacggaaactttaaaggagcatatgcagtcccaagcagaccagtttttcctcaaaataggagattctattctatccgaatcagattaataaggaagtccagtctgctttgccccttacaaaaaaaagtaatctagggctgggcgtggtggcttatacctgtaatcccagcactttgggaggccggggtgggcggatcacctgaggtcagaggtgatcaacatggtgaaacctagtctctactaaaaatacaaaaattagctgggtgtggtggcccacacctgtaatcccagctacttgggaggctgaggcaggagaatcacttcaacctgggaggtggaggttgcagtgagccaagatcacaccactgcactctaccctgggggacagagtgagactctgtctcagaaaaaaaaaaaaaaaagcaacccagtgttaaccaatccattttttccttattcccactttttaaaaaaaccactgttctgctatagcccagtgggagctctcattcttttttataaaacggaggctacttgattcatgtgtctcaaataaaagccaattatatctatcactaaatttgttgtaattttatcttttgacatatcctaagccatccatgctttataacttgtaattctctaaaacatattttgtgattcttggtatttataccaagaatttctctctctctctgtaactctctcactcacccactctctctctctttaatttaccctctggtccctatctgattatttggcaaataggactgcgaatactccctctgtctcttcaagctgctctcatcaaaagaaggaatttacacatattacataatggacagaaatgtttttgccccaattttctcttagtttaaaggtgcttcttttcttaaagggaaatttgcatttttcatttcatgtttccctttaagaacatacttacatacttttgtgtccacattgataaatttatttgaaatactgctctttggggatcattccctaattgcatgtattcagctataaatattgataaatataacaaaattggctgggcgtggtggctcacgcctgtaatcccagcactttgggaggctgaggagggcagatcacaaggtcaggagatagagaccatcctggctaacacggtgaaaccctgtctctactaaaaatacaaaaaatcagccgggcgtggtggcgagcacctgtagtcccagctactggggaggctgaggcaggagaatggtgtgaacctggcaggcggagcttgcagtgagctgagatcaagccactacactccagcctgggaacagagcgagactccatccaaaaaaaaaaaaaaaaaaaaaaaaaaaatatatatatatatatatatatatatatatatatataaaacgaaatcacagataaaatagatactcaataatcattatagagactagcatgcactgctatttagatatacatatttaataagtcatactggctctttagctgtacctaaaacatgccaaatccatttttgtgtcagggcctttattcattattctttcttcctttgataaaaaaaaatacttctttctatgctaaatgggatattttgtagatcataaattcgttagtaaaactctgaagaaggtactactgctttctccattttacagatataaaactaaggcagagacgtttagcttttgaaggattaaatgagataaagtacttagaacaaagtttaaaatgtagtaagcaatataaatattactgtatataaatgtgaatcaataaatattagcttttatgatctgatatgtaaattttttgcatttctgtaattcttttcccaaagtcactttacaaaacacaattttcttagctgatgaaagaatttttataagcttccagcctaaagctcttctgtaggcaagctgtaaaaccatcattcagaagttttaactgtttaccctgaatccttttaaccataactccggtttttgtactatagtgattagcagcagtcaactgataggatgtgattggaacagttgtgagggaaaagaaaaaaaaaaaaaaaccttctgacttgaatggatcataataatgacctgccaccctaagtcaccaggaagcacttaaattatctttattttagtccattaaaaaagcaaaggtatatgtaattatatgctttagaagttctacctgagctgctgaataccctgtcatgttttcaatacaacttttaaaatccataaatacttcagaagaaagtttaaattgtcccctttcatgttttctgcctaagtataattttcctagataggcctttcctgatcaccacatctaaaatagatgtaaccctgtaacccactagccccttacatacttgctgtatttttcttcatagcatttatgatttcttaatattatatatccctgttatttagttgttattgtctttttcctcccctaggatataaatcagaacagctttttgtgacaattgcggtgaaacagcttttcctggttttgtgctatattcatggcacttagaacagtgcctctcatatatagacattcaaatatgtgttgaatgaatgaatgaataaggaatagaaaaccaccaaggaacacagcaggaagcaatgatttacatttatactatctactataattttaggaatctcaaacaatttttcttaaagcctctgtattattcaacatttactgatatttgcaaaaagtttatagcaaatcttagtgtaatctcaaagatacattgggtaaacttgcattattcataatgtagactaggcaaatataaacacagtacatgaagatactaagtgataagcccaagcttgaacagcttgtctgccttaaaagcagtcaacatatttcaactgctgctactaaaagtttcgttttatttattatataaaaaagtgaagacgtcccaatattttttctctgtcacctctgtatatatagtttattttatagccttcaccttacttaattttatatcttgggactaaggctactattttccaaataaacgtgctcatatatctaaaacaacagtaaatgctacgtataaatatgatatacaaattcaggttaatgagacttgaataagattgagaaaaaaggaaaatatttaaaatagtacatctttttagaaatacttacatattgatttcctcatttattcaattagtcaatctacatatatatatatatatactttctaacaaacagtattattaaaagacaactaaatgtgatagaatatatgttaatgaaacaaagataaataatattgtctcatctctagagggacttcagtgggggaagacaggaatatcaaatatgtgtgaatgtgtctgcacacacacatacaccatatatatatttagtgttctgtcctgttcaccatctgctactgcttcccacacaagttcttctgtcctctgaaagctctattcttctatccacctgactgctaaccaaatgatctcacctctaagggaactggaggccatacatttgcttagtcataagtaccactgtttcccattttcccatttctgtatttaaaaagtgtttctctatctgcatccaagatcacctcattttgtcaagcctcagaggaggttttctcctctttttctggactaggatcatccttccatctatatcccccacctctattttttttttttctttttaggtaaaagggtcttgctctgttaccaggctggagtttagtggctccattatagctcattgcatccttgaactcctgggctcaagcaatcttcctgcctcagcctccagagtaactgggattacagatgcataccaccatgcccagctgattaaaaaaaaaaattcttttttttttgttgtagagatggtgtctcactatgttgctcagcctggtctcaaactcttagcttcatgagatcccacagtgctgggattataggtgtgagccactgaacctgaccccgtctatatccttaatctgatgtcttctcttcaggaattttcttgcttctttttcttttcttttcttttcttttttctttttttttttttctcgagacagagtctcactctgttgcccaggctggagtgcagtggcacgatctcagctcactgcaacctcggcctcccaggttcaagcaattatcctgcctcagcctcctgagtagctgggattacaggtgcccaccaccatgcctggctaatttttttttgtaattttagtagagatggggtttcgccattttggccaggctggttttgaactcctgacttcaagtgatccacctgcctcggcctcccaaagtgctaggattataggcatgagccaccgtgcccggcctctcttttcatcttttatgtatttttttagcttttctctctctactggctctttcccataccctgtatttcacctctgggttgttttttcatagttcatctgtgtgcagcccataccagtttgcatctgagagtccattgtgagcatctcttcccaacattgcatttggtgtcacactggtagattgaaattgccctcactatagtggggttatttttgtgtgggaaattggcaaattctatgaatcaaattcccctccactctccagcaccggttgttaaacatttacaggcaaactgctgctgtagtccctcaccttcccttaaaaccatgttctggaaaagagtatactctaaatctatcagcttcttcacttcacatcaaatctctgaaactagacagcttcccttgcctctactggaagtcctataccctgggagtcatcttagactccttgcttttcttcactctgcaaatccagtcagtccctgactatctttctgtccctcctcctccatcactccattctcactcccagctaccttctttcaggtctttaccatttcttacatagattgttataatcttctcccagtttgtcctcctgccttctgtcagactcagcccattcttcccaatgccactggaatggtgtgttttaaacatttaaacctgatcaagtttcttccctactcaaaatccttccctggctcttcacagcctctgggataatgtctttattatataatactttgtcatttccaaatagcagaggaccatgtccagatcgcttaagcaaaatggaactaatggcaactgaatattctagagaatggatctaggttgaatgatgtcaacgggaatttgtttctcttcatatttcagttctgctttccattgtgttggtttcagtctcaggttcggtgtgatagcaaggatggtggctgccactgcagctgtataatgtctcaactttaacatatagcaagaaagaaactagaaactccaaccttcccatgaagagattcataattatctcattgcaactgggccatgtgcctaccccaaaggaatcaccattgctagtaaattgtaatatgttgattggcctgtatccaagccacatgaaagttaaggaaggtgtatcctcaaatggaaattcaaactcttgctggaagaatggacagtaggaaagcgactacttataatgaaagcatctaatatgtatttagcgctttgtatatctcgggtagtgcttcagtgttttgcatgtgttaacttaatttttaaaacaacatcatgaggaagggagaaaactgatatacagaaggcttaggtagtttaactaagttagacacagcaaattactggtgtttattgcaaaatacaaatttctgagtatgggccttcctttactttcttacctaataaattcctgagaatatttgtaagccagatgactggtagttcagaaactaacttaaataatataaagtgaatgtgttacatttttaaagagctaaaaaccactggagatttctcacattccctgtcttccacagcaccagatgacttttagagtgcatagaaatgtcaaaatgggtggggttccctggttttaggaggttaatagctcaggattgggttggggtggagatgttaagtccccagctgcttgcagcagatatctgcttcccacgaactacagtttctctcctaatccctccacagggatcagggtacaaagatagctagccaccgttttttgtttttgtttttgttttgttttgttttgttttttgagacggtgtctcgctctgtcactcaagctggagagcagtggcacaatctcggctcactgcaacctccgcctcccatgttcaagcgattctcctgtctcagcctcctaagtagctgggactacaggcgcgtgccaccatgcctggctaattttttgtatttttagtagagatggggtttcaccattttagccaggatggtcttgatctcctgacctcatgatccatccgcctcggcctcccaaagtggtgggattacaggcatgagccactgcgcccggccaatttttttaaacttctacttgagtgaaaaggcaattacataggattccggcctttctcccagtagaagcagtggacaggaagaatttagccagctgatgcatgaaaagtgaaattttgtatattatgtgtaacactcttgtattcctttccagtcttacatcttaccacatacccctcacattcatcctttattgtaaaatcccgtatgcctttctcttacatgcctttcacaattcttttgtgtcttgacaaattctacaccatctgcatctgacacatcatctctcaaaagttgtgtcaagtgtcgtcttcttagtgaacaccttcctggaatcaccctccttgtgaggaaacagctgtgcttccttttgtccaattgcacttaaaagaacatttgccatagtttctgtaactaattactgtgtttctgtatttatgtttgtctgcttctcttatgctgcaagatccttgaaagcagggagcctattttattatttcttatatccttagaaaagtgcctgacacacagcaggtgctcaataaatgttagagaaattaatgaatgacataagaacacatagcaggtgctcaataaatattagataagtgaatgaataacataagagatatgcagaaaatataacaaggactcctaattggcaggaattaaagctggttagagctaggagggatgtgttgggcaaagcttctcactctaagattctagatttgagaccattaaacacatatattcctgcaataaagatagcctttgctatccaaatatttactgtcacattttgctagaattttcacaaaagttttagtatccaaatagaaaattctatcataacatttatataagtgcaagaatggaaatgtttaagtcgtaggtgagtccatgtaggaggatatagagtatctccatatagaatcatgccagtgtcttctaaggaagtagaaaagcctgtgaagaaagttggtgagtacaagaggtctagaaaatcccatgtattaaaagaaatattggtgcataaaatatacagagaaagattaacacataaaacatacgtttgatcatgcacatggctctctctataatgcttgtattttccacatgtaagacaattttaaaatatattatgattattggttttttgaaagcttccctgtgtcactcaagcataatatggtatgtttgagaagctagagacctatctcatgtggtgggtagacaatcagaaaaattgaaaccatggattacctactgatggcgctgtaattctttgaagatctgaaggagatgaaaaaatttgatcattcggtaaaaagttgactttcagctgaaattctggactagtacaaaagattttaaaactatgtaagatagatggaatcattggaatgaagatcatagaggagggaacatcttggtaatggggttgcagcagtttattccaccccccctaccgccgccagtgaattgaagaaaactatcgacaaaggtagcaaacaaattttcagtaatataaattttcttgatataatttggctttttataaataagtgttatcagaagataatgaaaaagagctagaatattacgcatccaaagataggttagcataacttttaagtgaaaattgtggaggcgatagtaaactaaaacctctctacttgtgtaaatctgaacagccgggactattaaagaaatgtggaagggtaaagtgtctattatgtggttcttaaatctaaaacttggttgaaaaaggaagcattcagtcatttttcaaggagtcattgtttccagtggtccattttttaggggtatagaatcttagaacataaagaattgtggctgaggtttgggtaaatttcatttaataaaataaatggttaataaagttgctgtgaagaaacctagtttggatgataaactaagaaaatttctttttttttttcacatcagcatgaatatctgaattatttttccatccctaattcattttgccagtggcaacatcatttctccaaggatgctgtggcttcactgaatcttcagtggtactctctgaggtttagaggccctttctgttgagttccaaaaaatggaagctctggctgggcgcggtggctcacgcttgtaatcccagcactttgggaggccaaggcgggcggatcacggggtcaagagatagagaccatcttggctaacacggtgaaaccccgtctctactaaaaatacaaaaacaaaattagccgggcgtggtggcgggcacctgtagtcccagctactcgggaggctgaggcaggagaatggcgtgaacccaggaggtggagcttgcagtgagccgagatcgcgccattgcactccagcttaggcgacaaagcgagactccgtctcaaagaaaagaaaaacaaaaaaggaagctctttggtgttcgattttaattaagcatgtccgtgtctgtggagtgaaagccaaaggcttttagagaataggcaattcttctctaggctcaatgaaaggacttgtttaagagaagccaattgatttttatcacgttgtatattttccaataatgccctaaagaagaaaacattttcctaagcaaagagtgacatgcagatttcttttgtgatccgtatttgtgaaaaatgcctcacttcaggattgcaatatgccctaacaaataatactgcctgtgcctgggggctgagtagtggttatcaccggagaaggtcttaccctcttagaagtagacattagttttctactatctattgtttgagtatgagtcaaacagtagatgcagatgccttcactgtctaacagaggaaatatcaataacttatataacctttataacatagcaattcaactaaaattgacttaacagatatttattgattgttgattgtaggcaataaactctactaggttgtacagggactaggaaaaaaattaagatataattattgttcttgaggaattagtaaaagccagatcaaataagtaaataagtagttattgggtttattttgcttttgtactttttctaaaatacctataaatgattaattatattttatgtgactattactatatctgctctttcattgactgtcatttgttatgacaaaagggggctctctgattcccatggctagaaacttcaaattcagtatttcttaaataataaatatttcttaagtaggtaaataatatcatattattaacatttagtgttcacctttcacagataggtaaaccgtaacatgagttttctgatgaaccttgttatagaaatatgtacaaaatgtataaaatgtgaagagtacatatatgaagggaactgaatttttccaagttttgaattaaagtgggtattgatttttgagctagattttgcaagactaatatttctattcaagaagggaaaggacattccttgaaatgggaacataatgatcagtttgttcattgtgaaacataaggtcatggatgcatttagtttatttggagagaaaccaggtacatgttgccaggtttagggggcacgaggggtgggaaagtttaggatgaatatcaacaaggtgacttgggctgtgctatgaaggacattgaagcaaagtctgaaaagtcttcagaaaacacacacaaacacacacgcacacacccctacctatttatatattgcattcctaagtgcattgtgttcaaaagctgattttcctcgacttgtcccacgttacttcggaacattaacatgcttatgttctgagaatacagaaagattcattaaatgtgcctaagatattttctcatttgaaacatttattttaaaaaatttaatctgctgcttttttttaacttaaactgttttttggcaatcttttttattgggcaatccacatgggtttgaacctttaatgactcattaaaattgattgtagattctaaaaacattataaaaacattgataaatatatcaaaacagctggttttgagatattgtacttttaaaaaatgattatttatttagtgctacccttgagtacaataaagtacacctgaaaaactttgagttttgaaccgagaattctgtttaattttgggctagttccaagtgaagagcactgtgctaggccttcagcagagagtggaaacaaacacactgagcagtagtaatccgagggaagacaagccagaagatatagcataggccacactgaggaggatcccaagcgtaatagttaggttgtaggaatagtcatcagaggttttctaaataagaaatttgcatatgtaagtgctttcccttaataaaattacattgtaatatggattggagggttagagacaagtttgaaggccaatgcaataatttccagctaatttccagccagtgatgtgcaaactgtgtaccaggaacaccagtgatcagtggagaggattcaagtatttgccaatgatatgttccccatcaaacactgaagattttttaattttaagaatttaaaaaaattagggtgattttttgattattaggtttttgatcatatgattttttgatcatccaaatgatcaaaatgatccaaatgttcaaaaaatcattatattatatgttccccattaaacactgaagattttaaactgcccaaagaatttaacttttttaaaaaattaggatgtttgtccatttttaagattttaatatgttattcagatgctttaaaaaatctgaaaaaaataaaccagtcaagacaaaagataataaggatttgaacttgggggatggcaatcagaataaagaggagaaagtgacttcaagatatgtagttgagcagtaaacaaagcaaaacagaaacgaaaacaacctcggactaccatttaataaaaaatcagggaaaattattctggaagccaaagaaaaagatcaactccatagattaaaattttgaaaattatctcctgagaaaatcacattagatagaactttgaacaatattaccatatggaaaaatggtgatggatccatgaagaacagtgaaaattggagagcttcgatgtttcagcaccctggaagtcaagggttacaagttacccaaagagagagggaaaggaaagggatgggtatagcaggcaaagggaataacacgtcaacatcctatgagctatagaggcacaggtgcactcaggaaaatgcaaaggagaaatcaggaacaagtgggcggagtggagtctgacagaagcctattggaatcagtagttaagtcaatacaccagttgactggtgatgagaatgttagagtgaagctcagaaaacaagagtggatgtaaaaaggtgaaggctgtgggtatagggtaatagttggtggcatttgtgaatacagggaagaagtgagagaaagcaatagtttgaagtcacagctgaggcaaggaaagattgtacagaatcagaaacagaggagaaagaaccagtaagaggcagacatgaaagacggaggcaccaaagaagcttacaatcgcattaaagttcaggagaaaatgagatcaacgcacagggacaaaagttgtctttatagttcatatatgaatgaaatgatcttttttctcagaaaattatagcagtatctgatatagttaattattctcgagaaaatatctcaaactgttttagggtgatctttgtttgaagtaataatttatttaaaagttgctgtaaggttcataactgtttagttctctggctatggtaaatacttcctgtaatttgaacataaggatatttctgaagggggtgcttaggctaatcacaaatatagacatgttgctgtgataaatgctttagactaattactgacatgctcaattgaatactaatacttcccatgaaatgactttaatacaagtaaaatgacagctgcactgcagtgagaggacacataaaactgcattagtttgtctccaaggttaccatctgtgctgatctgaagttttaatgtgtgggatttctcaacctgtgcaaagactgtattttcaggataggtatcaataggatataaaagcagcttggaagctacttaagcatttatttgggatacatccatgctgaccttaatcattcaattgttctagagagacacatatctgtgttctgttagaaattttgtgcaacgattggggaaatagaatgtcaggattatttgactccactttgcatatacaaataaaaagatgtgaatttacatgttgtacaactgaactacattctggataaaattgaggggcaaaacagatttgaaaaattggatgacttctactctagagttttcatagttattccataattaatattcaagtttcaagaaaatatttaaaaacttataaaagtatagacattttaggagtctagaacctataaatacggctccaaattaaagaaatggtattttgatagtctaaaaggaaaagagagactgctgttagttcaaaattgtatagaacttaacatttcttaatgtaaaacatttatcattttttcaacaaatgttgattgaataccttccctgtcctaggcaccgtgctaggccataagtttgcaaagtcattaaaacttgctgtctgtcctcaaggaatttacaatctagatggaaaacagaccagcccaggtaattaaaccaccctttctgaaggttgtcatggaataagaacaggatgttgtgaaagaacataggggctgcacataatgacgattaggcaagtttggaagaaatgatgtgcatgttgagatgtaatgagttagaagttagctgagcagaggggaaaggaaagggatgagtgtagcagacaaagagaaaatagcacatcaaaggcctgtaagctgtggagacacagatgcattcgggaaaatgcaaatcagcttagctgaaatatagtgtgtattggggagcaggggaaaggaggtaagggtctcagtgagagaaggtggaaaggaaagcaggtgtcagatcacctggagtcttgtgaaccatctcagggaactgatactttactgcgagggcaatatagagcaattacagagtgttggggaagacatctattaccaccagcatctccttgttcttcctcatgattgtcgtcatcatcattgtatgaactcactatgtggcaggcaatatcaagttagttcatgcatttttacataaaatttttatcatgagcttattactacatctaatattcctattttacaaatgaagaaataaacaaggaatgcacttagtttccccaagctcacagttaccaataagcacagttggtaatcgcatccaggagtttctgacaccatagtagtccctgcctctctactctgcagttcttatgtagaaaatgactgtgttccaccaagagcactcagtttgcagtgtattgcaatgatgtattagatgacagctaaactggaaaggggggctggttatgaagtcattgttattaatcaggcatcagaagacagtggatagaggtagtgagaatggagaaaagtggatgtgttccaaatatatctcagaggtagaatcaaccaggcttagtgattaactggatgggtggaacaatatacttctggcttggacgatgagtatatttcaggaagtgtatttgtaaaatccactggatatgttggttctccaagaagcagtaatgtcagaaagattacatttatacatttctggtaggaatgtaaattagtacaacttctatgaaagggagcttaccagtgtgttttagaatttaaaatgtgcataggattgacccagaaattttatgtgtaggtatttatccacaaatataaaccgatattatatcatgtgtataaggatatacactgcagcatcttatgtaattgcaaaatattgcatacaaactcaatctccttcagtatgagattggctgatgaattaaggtaaatccattcaatgaaatgctctaaaatcctgaataggaatgaggcatctctatatgtgtattgatggggaaatattgtatatgtacatgactttatgactgtatgtatgtaaaaaataaaggtgcaggtaaaactgtatatgttaggctgccattttatcaaagccaagtagatagatagatatcgaagtagatatagatataaatctgatagctgggtacagaggacagaaaagggagagatatttattcttcagcgaatatccttttgattttactctataagcatagatttcttattaagaattaataacaagataacacaaattataaaaattcaaggcagaaccccctcttttaaaatcttgtctctagagaaagtttaccttaagggaaaagtaaaactgttagtttggtttccttgtttattttgtgcctcattaagaatttaactatgggctaggcatggtggctcacgcctataatcccagcactatgggaggcagaggagggcagatcatctgacgtcagaaattcgagagaccagcctggccaacatgtcaaaaccccatctctgcaaaaaaatacaaacattagccaggtgtggtggcgcatgcctgtagtcccagctactggggaggtgaggcaggtgaatcgcttgaacccaggaggtggaggttgcagtgagtcgagatcacgccactgtactccagcctgggcgactccagcctgggtgacggagtgagactctgtctcaaaataataataataataataataataatttaactatatagacaatcaattttcacaggaaaaataatatctttccccaatgattgacttatatccttccaaagtcctggagttccaaaaattcataattcaagtgtaagaatataataatgtcactaaattattatttttgagtcattcaagtcatattgttgctaacattttattttgttcattttttacattaaatttttttcttattttttaattggcaaatataaattgtatctatttatgatatacaacatgatgttttgatgtatgtatacattgtggaatggctaaatcaagctaatgaacatgtccattacctcactaatgtatcattttttatggtgagaacattaaaaaatctgctgtcttagcaattttcaagaatgcaatacatcgttattaactatagtcaccgtgttgtgttgtacaatagatctcctgaacttattcctctagtctaactgaattttttgtgtcacttgactaacatcttcccactacctccagcctgccgcccctagtaaccaccattctactttctgcttctatgagttctgcttttgtagatctcacatatgactgagatcatacaatatttgtctttttgttcctggctgattttagcgtactatctttcaggttatccaaattgtttcaaatgacagaatttctttcttttgagaaatgtccattcaggccctttgcccatttttttttttaatgtatagtatattcagagctcaggtatgagcattgtaagtaagcaagctcaagcagagtagagagcctaggttaggaaatatcaataaggtaagtttatagggaaaccagaaaacaagaaagaggctttagattttatgtgaaaataaaaaggaatccaccttgtaaaactcaaaagagtctaatatttctttgataatttgctctgctaacatttatttgaatctttagcataaaagtcttctcttcatacctcatgcattttattcttcattttatgcccattagctcttgtagtgccctgagtggaattcaaatatatatgtacctcattacctgcacagtacatctcttaaaacaaaatccaatggacccttggatatcccagtttgaaattatctataatgtttagtatcccctttggaattgaagcctaattttctgcaggcaaggcaatgtcattcactgtgtacacttaatgcttatggtgcttatggtcaaaaccttgaaccattttggttcttccaagaaccatttttatagatttactgttttaaatatgaaatatagaaaacctatatttattatgtggtaggttacttaaactgatattcacagaattttaagatcttaatgatacagcagcatctaggtatgtatagaagtagtttagaaaaatgtgtcttttgcttaaataaaatcacttcacagaagatttgtgaaatggcaaagtaattacaactaaacgaatttattagaatatagtattttttttcagatggatttgaagcctaaaatctcattcatgaataaaatgattaaaatgattattttggtaaagtatcatcccaataatccattgttgtattcaaggactcttcacattttaataaatatgttaaaagagagagggtttattaaattcacatcctattttccttaatattgcactaaatgagtgacctaaagagaacaattgtgtctatgcttatagcttatatcatagctgggcattcaggggaagtcaaatcactccatatattttaaaatgtttcctctaatatgaagatatagtctttctcttgtgaaaaagggacagatctcactcttagcaatgttagaattttggctgaaagctatgaattcatatgtaagtgtggagaatgatgttggagatttgtgttaagattatgaatcaccaaaatgaacaaaaaatttaaacttatgtgaagattttaaagatgttttctctggaaagattacattgataagcaatcaatcatttacatgtaattaaaaaaataacaagcccaatacagggttttttaaaaaaatcacgtcataaaaaagtaaatataacaggctttttaatttttttcaactcagtaagctttgagtgcctgttaggcacattgtgcctattcttgacaaaataaatcagatagttataagttataaaagaaaaggaaagatgatataacaacaaaatgaatgttagagtgattagtataattgctatgaatggtcactataaatttttttgtgtgcttggatatttacttataaacatgtaagttttttttctttttcttttttttaatttttggtgtcatcagaaaaaatgcaattctttaatatttatttcattttagaaatctacatataagcttatcaaattccaagttggtagttattgcaggtaaaggacattgagtaaagattgcacttttaaacattatggttaggatcttaggaaattatcctgaactttaaggactaaaaacaataccctgtcaaagaaaaaatgcatcagacagagttaaacagctgcgaggaaaactggattccatattattgcaatagaggagagagactgaacacaactccgctaaaacaaaaggcagaagtgtttttaagtgctggattgagcttgcagaaaagttctagaggacattgagtgagggcatggttggtcaatttgattatgccatctttgtttactaattggcacttatttaaattagacttctaccctcccacagggagaggcagctagcaaagctatctttttcaatggctacattttaaagggatggctcccaggtccttgagaaatacattactggattatgaaactgacaggtggttgacacaagatttgcatctcaaaggggcagagaatggatttacaattgcaagtttcctgaagtaaataccctaaggaaaaggaagtcaggaggccatagacaggaagaaacccacctaaagtttagtcaaactgagggaaacattaagtctatcttggtcaactcttcagttatactaaattgtaccatgtacattgacaatatttgaccatttttgacctacaaaagcaatgggttcatatgactctatctaagattctaggatccagtttgtttttgtattatttttacattctgcagaagcaaacaattctccacttatggtttttagttttacactttcttatttcaaaaaggacttagggggattttatgtgtatttacattaaataatatatatatttatgcatatgtttgtatatatctgtgtgcttatttaaaaaaaggttaaaattgaagttggcaaaaataataataaaaaaaaaggttagcagaagtcttgaatacttcctaaagaaatgtcacaggtttgtttcagagcttcccataagttaatgcaaggaaagaagtgtagtaagttgcagtaatgaccctaggagaaaagcaacccagaaatttagaataatagttttacaggtgttcagacctaacacaatttttccctttaagtgctcataaaggcaacatttgtgtgttggcaacttgtccactaagcctaatagttgatttcatagtctgggtttttgctcgttgattgtttttttttaaatgatgtctctcaatgcaaacttggcaaaactccacagtgtaatttagtaaaagcaatttgattaggtatgaaaataacaacatccagatacacagtcctctaaagatggaattaaatatatctagaagaatgaattgcatcagacaatattccatatatatgtgtatatatgtgtgtgtgtgtgtgtatatatatgcttttttttttggtaaactgaaccctcgataaaaatgaggcaatacagcttggaaacttttgaagttaactgttgtggtgtcagaatttggagttcctttgcctttacagatgtaagtctatatgccgtaacaattttaccaaggacaggatagacagcctcttttggaatgtaaacagacaagttaggatgtggatgaaacttcatagctgcttacttcactggcaggccaatattattattctggcagtcagggtccagctaaaattagaattcattaaaatcatggttcttgctttattccttgatagccactcatatgcgcttgtatgcacacaacaattttcagagtgtgctttatttttgtgcttttttaaaaatatgatggcctctatgttaaatggttttttataggtaaatattatattttattaatccttgtatcattaatactaatagtaatagggcacgagaaatattttgtttgcttatgaatgacttaaggaagctgaagtttgatatttaaaattataaatataaaatgtaaaattgtcagtaaacaatggactgattccatctctcctttgccccatgttttccgctttgcagtaagtaaaaaaaccacaaaactttgggggtcaaggtcaccaagtctcaaacgtggtggcagacgctgctagttttctgccagtatccacttccccaccttccttaccgacaggcactttggtttacggttaggacactagatgcccggaataatggctgcattttccaattgtctttagagtaagagtggccaagtatctaaactcaggccaataaaatgtaggcagaaatgtcatgtgtaaatgttaggaagcatccttcttttcttcgtcctcctttctgctggcaggaatgcagacatattcgctggagctcagcaacctcttggaccacgaaggcaaacacatgattgagaagggtggactacaagaaagaatacacctccttccctggtgtccatggagttgccatatatgccttggccttctcaggtcgagatttatttgtatgaaagaaaaataaactttttttaagccactttatttagtggctttttcttaaacttgtagcccagcctaatggtagtcatttggggcacatctttggaaatccttcccaactccctgagactgggctggaagcccccttttctgtgctcccacatgccctgtatgtgcctttattagaacactttccctattttattgaaatcatcttattttacataaaacattatttgagcacaagaacaatgtcttattcattcatccctgagctaaagctaggatagtgtacgttcacataggatatgctcaataggtatttgtttaattgaaaaacactggattaatgacctgactgaataaagtgctaacagtactatggaattaatttgattgattttgattcaaaatcataggacactatagtagatgtcaaaatacatgtgtggagatgtttgtcatatttgttacatacataacaccctggcttatctcccccatgttaatcaatataaatcatttttcctattatttagtggaataatttaattcactaaataatttagtgaataatttaattcactaaataatttagtgaataatttaattcactaaataatttagtgagtaatttaattcactaaataatttagtgaataatttaattcaccgtcttatttagcgaataatttaattcactaaattatttaatgaataatattttgttaaagccttgggtgtgatggcaacttgtgtcatggaattcttttctttctttctttctttctttctttctttctttctttctttctttctttctttgctatgggctaatcaggatctttgttctaatctttttatcacaggtatataaaactgatttggagagtataaccatatgagaaaatatttggttcctccaaatcacattctctcatttccctgaattctctactccggggatttaacattttattaactgttcagatggttttaaaagtaaagcattcagcttatcatatggttggtttaattttatctttggtttattacatgtcttatattttaagaaaaagatcatattttttgtgtgtatcttataccatgacaaaaccattgatttggatgaaataaatctgtgacaaaccacatagaccaggtactagagatattcatttatttcttttctttataggtcctctcaaactgtgagtaactaagtggtttgtgcatcattccagaagcaaagctaaaatttttagcggtgttgtcgacttgacctgctaatttcctgttctggaatcgagagaagactcctcaacaagttgctgcaatgtctgtgtctaatctatcatggtgagtgaatggttttcttgccttaaatgtaaatgaaaatatatcatgagcagtattttctgagggagtcgtacaggcagaacttgggcagagagaaaacttaaaaatctggtttccaaagattattgtcccatgttagcgtaaagaaagcaatctaggattagaagtctgacactttcagtgctatgatatctgggggctctggaaaggattgaagcctcgcactgaatcccagtgacctccaatacctttcttcccagcacaccctaggagagagaagtaatattatatcctttcagtattccttgctatcggtatattcccagatataggactagcaagctatatgggtggctgccagtgtggggtagatatttgctcatcagtacttctttgcttcaggttttatatttcaacaaatctacccagattaaactgaatagaactgaaatacggaatagaaaaatttgttatagatgcacatctctaaatagctggcattctaaataatctttgactttcagtgcatgtttaaaagctgtttgggatttaaaaaaagaagtgtaaggatatttttctgacaaaaaatgagcttttctatagcaatgaagaacaatactagtagggataaatttgaaggtattttattgaactttgacttttttatataacgagatgagtaagtgacatttatataaatttacagtattcaatacatgaatataaggaaaatctggtaattttttccatttctttaagaattcattttatccttgctcttcaatttgtgctggaaatgtagatagcatcagattaaacagttgttactggctcaacttagctccataaatttatttttagtgaagtcagcaatttttttagggcaaggatgtaattatttgtttagattcggagtcatgtttctgaaggacccactgttcatggactccctagaagatatccttggatcttttggcctgggtgctaagaatctcagtttgaaaaaaaaagcattaaagaaactaaagtataatcaaacaaatttcatttaaactttgaattattactgcacagtatgttttcttattatattattattaaaattaaaagtttttaaaaatgtaatttttgtagaacctgtgagtcattttgagctcctgggagaccttgacacgtttccttaaaggaattatactcctggcaaattgtgtgtaggagatgaattctcaaaaagcagggagcatgtcaaagaagggggacaggagggttggggaaaggaaaaggaaagggcaggagattgaaacaggtatgattgttgtatttcaagatagtgtgcagtgcagcctggttcacagggtcagggcaggactaacattgaggcctggcctcggtgcatgcttctattaactgctttgatgtgatatgaggatatgattgttgctccaaaacacagtgaactccgcaaagagagagactgcatgtcatggttccagcccaattgtccagcacagcacctagaatttagtagatattctgtaagtgcatgcttggaaatgagtgaaaaaatgcaaagcaggtaattcaatggtaaataaatgttatccttctaaaagaaagctttaaattgtgaggctatcttatagaattcatctatgtggaatttgtaagaattctttccatgttacagcttcagattttatagaaatgattcttggatatttttatcagcactatcctcgattctagctagtgttctgcattagatttccatgcagggagctattaatttgttttaccagtgtcacccccaccatgcagctgtgaggtgtttggcatcctcattctcccacttagcatttgggttgcccaagtgctggcagcaaaggagacaagaaagtaaatctaaagcatgcaaaacgagtcactgatttatgtcactgatacctagtttagacatcgttaaccttctattttttttataataacctttgtaattcttctatattcctaacatcttctaatttttattttggggattattgttttataaatattttaacaggaatgcacagtaactcatcattacattaatttagttaagctgttatagtccctcatcgggctctctgttttgaaatccagaaacaaagacatgaaaatattgactgatatgggaaaattaactgggttgaaagattactaatttaaaataagacatgtaacatttaagtgtatgccatgcttgatttagcctgactagtgcattctctaactgttgtggaaaactacatgggaatctaaatcagaagtttggctgataaccatataatcataacaaggagagctacatgcttccagtgttcaaaggaatcaggataggatacacttggcaggatacacctgtcaatagaggatccacctgctaaacacagaggtcagcctcgcagggcagcttcttcgtgtctaggagttggattagcactgccaatgtttgccccgatgattctgagttccacttctgccagactctgtctgcttggctgtcttgtcaatgttaccactgagcttctagtcaaaacttcctgcaatctgtgaacagtgtagtctgcctactatgacatcgtattagttgaccatatccacgtgttgattttaaaatgtaactctgaggttaatgtgggaagtgcaggatgcctgttgtgactctcgtagaaaacctaggaattttaaaagcataggttagtatagttacaggcatatttacaaatacctaagcaattctcccagcttttaaataccctgtataagaaagttatctttttatacattaaagaaacttcttgctctaatagttatgtgtatgatacttgaaaaaatatataaataatttagccatttcatgtaaaatctaagaaatatatttaatctaggaaacttccaagtttccaggaaactacagtctcagttggaaaaaaggaatagtggaacttgattgtttcatgaatcttcctatttagtaaataatgatcagagagagacaatgagtaagttgatgctcgttgaaatagaaacaaagggatgcgcagaatctgttgcagaaaactacgaataagtgacaggttccaggctaatctgagggaaagaattgtttctggtagcatggataagtaattggagacaaaatactggtcagcatatgtacagtaacactaaaatagtgggaacttagtgtgtagtagggcctggagattagcaaggaattggtttagtagtggagggtctcagtatgttgatagagatcctagtgaaggctcaactgattttgcaagatgacatctttttgacccaaattatttttcactgtgatgcctgcacacactttaattttggtccccaaatctgttaaagactggacagcatcttgtggaggtgatagtaattcttctagagccatgtatgggagaaagaagtcactggatgaaaggcagaatccaagtagccactcaaaaactagtgagcatctataacatgccatgtcctgtgctaagcacagggaaacagtattggttaaaagtaatgactgctctttttggagctcatttataagccagaagactgataagtgatcaaatagctctgatttaatgtgataagcgctttaaaagataaaaggtacgtgcagaatgtgtttgaaaacaaaagggatatttgttttgcctgcttgggatgaaatgacttatttttcagaaatacaaatacacctcttgcatttattccttaatataaagaaataaactaattgcaaatggtcaaacactacagaaaaattatatagcagaaactaaaaatgacctaaatcttataattcacagaaaaccattgtttaaaacatttatgtatattattttctgcatatattcgttttttttttttgcaaaattagactcaaaacatgtatgatactttgccatcttctgtttttagtgaacagtttctatggccctcactccatttggtggatatagagccacatcatcacctatagaggctggtgtatcattgcagggcagtagtgttgtttagccatctaggttggaccttcagatagcttccacttttcttttatacgattgtaaatatttctgctgtggggaaaattattcagagattattggtcacaaagtactgtgccattcagggtatgcagcagagccctatcttgttgcaactacctggattgtagacatcaaggccctggaagaaataacgtttctgcgaaagagacttgttaattcatcttcttttttttttcagttttagaaaagggtccattatgtatgctcacccttttcccagatttagttcctcataaacatcaagtaatgtgctggtaactgggaaatactgcagtttgttagtagaattttatcagaagtcaacaaaatattccgttttgcatgcctacagattggaaaaataacaaagcctaagttgggtaagttattaatgttttgactaaatttagaaatggtgaatgatcttcattacatatgtatatcatttaaaatactattatgaatgttggcaatttcaataacactttaataggaaataaatacatttgaattattctctttatccaaaaataatgattttttttaggctgggtgcagtggctcacgcctgtaatcccagtacattgggaggccgaggcgggtggatcacttgaagtcaggagttcaagaccagcctggccaacatggtgaaaccccatctctactaaaaatacaaaaaatttgcatggatggtggcgcacaccagtagtcccagctactcaggaggctgaggcaggagaattacttgaaaccaggaggcagaggttgcagtgagcagagatgacaccactgcactccagcctgggtgacagggcaagactccatctctaaacaacaacaacaacaacaaaaacaaaaaaagtaataatttttttttagaattttagagttcagaaaaatgcaaaattagaaatgcagaaagttttctttgtcagattattcacattacttataatatttatgtctaacttcttatttaatgaataaatgaagaagttgaatcattctatattgttctttggcacctgcatttaggatgagaaaattctggagagacagaagcagccacttcattttaaggaggtggaatggggaaatcaaactcttatctcaaaaattgctatagccactgttttgcaaactacttgtcctatttgtgctgctaaattgcaggctctcagggacaatactaatgtacttgtatttgcaatggcagaggaagtagagacttgaactgtctctatttgtggaacaatcaggacctgcagggggaacaatgtggataaatagagattgtaagggaagttattagccccggttttatagtaaaggaggaaaagtcagaattttgaagggtctattgttgtcaagaaggaaaaaataaagagaaaggttagatatgaatataaggctgatatttctaatttttttttaaaaggagacctctgtgtgataggaaaagcttagttgtgagagataatatgagtatttctcagtggtaagttcatgttgaatgaatgactgtttcattacggtactgagaagagagtgggtttgagaacctgaaaccaaagaatcttcctgttaagtggaaatggtcagcttgtaaaggagtagagacagagtagagtaactcaagtttaggggagcataaattaagagaaaataacctaggaagagaaaaaaaaaaaagaatagaatagccaaaacaaaagctcaagaggaatgaaaaatgtgtcctcccaaattacataaaactttaaggtaaagtatcattatttgggttaaagttaaatttaattaattctacaaaatgccaatgtctttctattcaaactatgccttttcaaattgaaagtctttcattagtaaaatgattaatactattttgatttgggattgacactttaattaaatacactacatttttagaatccgcaaccattttttggctttgagctatgtgcctttagaataactttttaaaaattagacatttataagagacttggatatttttcttcttgtatctccctcaaattatttctctttgaatagtcaaataattagtaaaacactatattttaattttgtctttaaaaactaatgccaactagacataaatcacatccttgaaaggaattgcttggtaagttttggtctagatagaggagtttgatttcctgtgcatttaatgagcctgaggttgcaggttcaaaccccacagggactaataagttctattctctttcttttccaaagcctactagacctgtaaccttgaccagccctccttctcaaacttgccattggtcataagtcattagaaataattgattgattatcaccagcttacaaccaggtttggggaaaaatataaacatgaaaatcaagtgttctttaggggttgataatgggtcacatatatcatcttccttttgaatatcatccaggtcaaataatttagatttatgctttgaaataagacttttcatcattctcaaatgaaccataatttactttcttgtggaagatctacagtgaattatcacaccaatatttccttagactgtagaagctttaacataaaactgggtagtccattccaaaccttaaggctagagtttctaaacaccacccatttgtggacttgaacaattaggtaaaagaccagcaaatcgtctacgatataatttagttatcaaaatagttatgtaggctaagagatgttactttcagcatgatcaaataaaattgactgtcaagtcttaaacactattttctgtaagtgtataaaattatcaacattgtgttatcctagtaaaaaaaataaagagaaaggttagacatgaatataaggctgatatttctaattttttttaaaaggagaactctgtgtgataggaaaagcttagctgtgagataatatgagtatttctcagtggtaagttcatgttgaatgaatgactgttccattacggtactgagaagaaagtgggtgtgagagcctgaaaccaaagaatcttcctgttaagtggaaatggtcagcttgtaaaggagaagagacagagtagagtaactcaagtttaggggagcataaattaagagaaaataactgaggaagagaaaaaaaaaagaatagatacattctccatcttctttcatgtattacattttgtttggtttttatttgtttttaaaatttccagcttgattataaaactattccagtttaaacaatcacttttcattaccattatatggtcaataaaagaattcaatgcattcatttacactgagttttatgtttcccttttttttttttttttgagacggagtcttgccctgttacccaagctggggtgcagtggtgcgatctcggctcactgcatcctcgcctcccgggttcaagggattctcctgcctcagcctcccaggtagctgggactacaggtgcgtgccaccatgcccggctaatttttttgtattttttagtagagagagggtttcactgtgttagccaggacagtctcgatctcctgacctcgtgatctgcccgccttggcctcccaaagtgctgggattacagacatgagccaccacgcccgatctatgttccacttttaagggtaggttcattgatatgagctttgagaataatttaaagttagtttatgaatgaataattttaaaataattcttgctcaattagagataaattagtataatttatttctaaacaggcagtatattatttttattaaattagaatttaaaaatatttatattcattcatttctttattcaacaaatttttgagcatctacattgtactatttttaatgctgtggagagaatgatgaatgacagaaatttctgctctcatgaagcttagattaatttttatctatatctgtgctgaagacagatatagataaaaaatatgtcagcatgacagatagtgatatgtattttgaagaataagcagctcataaagatagagtatgatggtagaggattggggagttggtatgaagaggctcctcagaagtgacatttaagcagaaatgaactatacaacttttagaggaaaaccatttcaggcagagaaacagaaaggacaaagaacctgagactgaaaagtatctggtatgcttggggaactgtctaggaagccaggtaggtggaaaacagccaataagggggagagtcccaggaactgagcttagagaggtagcagggaggcatgtaggccaagagaaagactggagtgtgttctaaatgtgatgggaaattttgccctcccttactaggttacaggtgagagttcatatgaaatgtaaatttagagaaattcagtgataggaataattgagtgttgaaagcagagtcttgacatgatctgatttctaaattcaaaaggatttctctatgttcttcaaagtttatgaaaataattcatattgtatccttaatataaacatatgacagaaaaataagatataataaaaaaagaaaagataccaaggtaatggaaaaccattttcatgaatataaccagtttctcattattatacattttaagagattcaacaaatctgacacatctgaataattaaggacatggtatgtgttttgttttgttttattgcattttattttattttttatttttattttttgtttcttcttaaaaaaatgggatatatgtgcacagttttcaggtttgttacataggtgtatgtgtgccatggtggtttgctgcacctattgacttgtcctctaagacccctcccctcaacccccaccccccaacaggccctgatgtgtgttgtttccctctctgtgtccatgtgttctcaatgttcaactcttgcttatgagtgagaacacacacggtgtttggttttctgttcctgtgttagtttactgaggatgatggcttccagcttcatccatgtccctgcaaaaacatgatctcattcctttttctggctgcatagtattccgtggtgtatatgtaccatgatttctttatccagtctgcagttgatcggcatttgggttggttccatgtctttgctatggtaaatagtgctgcaataaacatacttgtgcatgtgtctttagagtataatgatttatattactttgggtatatacccagtaatgggattgctgggtcaaatggtatttctggttctagatccttgaggaatcaccacagtgtcttccacaatggttgaactaatttgcattcctaccaacagtgtaaaagcattcctatttctccacagccttgccagcatctatggtttcctgactttttaataatcaccattctgactggcatgagatggtatctcactgtggttttgattttcatttctctgatgatcagtgatgttaagctattttgcatatgtttgctgcataaatgtcttcttttgagaagtatcttttcatattctttgcccactttttgatggggttgtttgttttttcttgtaaatatgtttaagttccttgtaaattctgaatattagacctttgtcagatgggtagattgcaaaaattttctcccatactgtgggttacctgttcactttgatgacagtttattttgctgtgtagaagctcattattttaattagaacccatttgtcaattttggcttttgttgcaattgtttttgacgttttagtcatgaagcctttgcctgtgcctatgtcctgaatggtattgcctaggttttcttctagggtttttatggtttggggttttacatttaagtctttaatccatcttgagttaatttttttataagatgacggaaggggtccagtttcagttttctgcatatggctagtcagttttcccagcacaatttactgaataggagatcctttccccattgcttgtttttgtcaggtttgttgaagatcagatggttgtagatgtgtcgtgttatttctgaagtctctgttctgctccattggtctatatgtctattttggtacaagtaccatgctgtattggttactgtagccttgtaatatagtttgaagtcaggtagtgtgatgcttccagctttgtccattttgcttgggattgtcttggctatacgaggtcttctttgattccatataaaatttaaaatagtttttttctaattctgtgaagaatgtcagtgatagtttgatgggaatagtattgaatctctaaattacttcgggctgtttggccattttcacgacattgattcttcctatccatgaggatggaatgtttttccatttgtttgtgtcctctgttatttccttgagcagtggtttgtagttctccttaaagaggtccttcacatcccttcttagctgtgtttctaggtattttattctctttgtagtgattgtgaatcggagttcattcatgatttggctctctgcttgcttattgttggtgtaaaggaatgcttttgatttttgcagattggttttgtatcctgagactgcgctgaagttgcttatcagttcaagaagttttgaggctgacacgatagggttttctaaatataaaatcatgccatctgcagacagagacaacttgacttcctctcttcctagttgaatagcctttatttctttctcttgcctgattgccctggccaaaacttccagtactatgttgaggaggagtggtgagagagggcaactttgtcttataccagttttcaaagggaatgagtctagcttttgcccattgaagacgatattttatgtgggtttgtcataaatgttcttattattttgagatatattccatcaatacctagtttattgagagtttttaacatgaagggatgttgaattttatcataggcattttctacatctattgaggtaatcatgtgattttgtctttggttctgtttatgtgatggattacacttattgatttgcatatgttgaactagacttgcttccaagggatgaacccaacttgatcattgtggataagtttttccatatgctgctggatttggtttgctagtattttattgagaattttcccatccatgttcatcagggatattgtcctgatgttttctttttttcttgtgtctctttctgggtttggtatcaggatgatgctggcttcataaaatgagttagggaagagtcccttcttttcagttgtttggaatagtttcagaaggaatggtaccagctcctctttgtacctctggtagaattcagctgtgaattcgtctggtcctgggctttttttttttggttggtaggctattaattactgcctcaatttcacagcttgttactggtctattcagggatttgacttcttcctggtttagtcttggtagcatgtatgcgtccaggaatttatccatttcttctagattttctagtttgtttgcatagaggtgtttatagtattctctgatagtaatttttatttctgtggggtcagtagtgatatccctttatctttttttattgtgtctatttgattcttctccctcttctttattagcctagctagcagtctattttgttagttttttcaaaaaaaaagcagcttctggattcattgatttttttggagggtttttttgtgtctctatctccttcaagtcttctcttagttatttcttgttttctgctagcttttggattagtttgctcttgcctctctagctctttgaattgtgatgttagggtgttgatttgagatctctctagctttctgatgtgggcatttagtgctataagttttccttttaacactgctttcgctatgtcccagagattctgctacgttgtctctttgttctcattggtttcaaagaacttcttgatttctgccttaatttcattatgtacccaggggtcattcaggagcaggttttccagtttccatgaaatcgtgtggttttcagtgagtttcttgatactgagttctactttgattgtactgtgttctccaataactcttcctgcagggaagcctcacccaatgaggaaggataggcctgaagaaacactctggtggcagactgccacagcaggtgtgttgggctgtggggacaagtcttgagacaaagcctccctggctccagcaggggaaaagcacagcctggaactagagaaatgggtgctgcccttcccctgcccagggagcttagcttgttaggcagttgcgagtcccagtgctgactgctgcctctcccacaaggagctcaaaggacttagacagcaggcagtcacaactgtgctggttgcccctccccccaggagttcagcaggcttaggcagattccagctgagaggctgtaagaatctgcctgttccagggttggaacagtaggcctggtggcatgggttcgcaactggtatcttccaatctgtgggtagcacagtttcatggaaaaagcagtttccctggttgggtagtgtgctcaatcaacacctcccttggctggggggagggggttccccatctccctgtggctctcaggtggcctgccacaccacactgttcttccttctctctgtgagtcacaccagccttctaatcaattttgatgagagaacctggataccttggttgctggtaaagaattcacatgcttattatgttttttttttttcgatggcagccttagaacactgctgcttctagtcagccatcttggcctctcccctatgatacatgttaagcatccctaatttgaaaacccaacatttgaaatgctccaaaatctcaaactttttgagtactgatgtgatgccgcaaatgaaaaattttacacctgaccttatgtgatgggtcacagtcaaaacagagtcaaaaccatttcatgcaaaaaattattgaaaatattatataaaattatctccaggccatgtgtataaggtgtatatgaaacataagtgaattttgggtttggacttgggtgccacccctgagttatctcatcataaatgcaaatattccaaaatccaaaagtatccaagattcaaaacattactggtcccaagcatttcaaataagggatactcaatctgtataaaagagatgtcatctatagaaacattttaccttgccttttatcagtagatgaattatgtttttataaattgtggaaattcagaatatacaagtcaccctcgatatccatgagttccatattcatagattcaaccaacctcagattgcaaatattcagggaaaaaaatttacaaagttcttaaaaatttgaatttggcccacagcaagtactatgttgaatccacatgaatgaagtaatgtgtaggcattatattaggtattataagtatctagggatgatttaaagtctctgggaggatgtatatagttatatgtaagttctgtatcattttatacctggaacttgagtatccttggatttaggtatccttggtaggacctggaaccaatccttcatagatactaagggatggctgtattacagttgcccaacttgtgttttatgcttatttttaaatcccctccctttcccataaactttaaggctaatttcaatatgtaaacacaaaagtgcattaaacaataaattttttttactggttgtttaatgtgcgtgtggttttagtgaggaatcaggtataacacagtacccatccaggtgctaacatgttatggagagaatgttggcataaaattactaggcatccttcttggataaaattcactttattctaaaattatgacctttctatacttttcatggtaaaatatggtttcttctatggtactggttatagatggaagatagggtgttctttaatatctttttagacagtctccctctgtcacccaggctggagtgcaatggcatgatcttagctcactgcaacctcgacctccgaggttcaagtgattctcctgtctcagcctcctgagcagctgggactacaagtgtgtgccatcacacctggctagtttctgtatttttagtagagacagggtttcaccatgttggccaggccagtcttgaactcctgacctcaagttatctgcctgtcttggcctcccaaactgttgggattacaggtgtgagccactgcacccagccctgatgtcttttttaaaaatcagaatgtaaaatcaaaaagtttggaattactgatgtaataggaattacttaaaatcggctcctagccaaagtagtgtcaatggtatatgatccgtattacagaagtcactcgtgtatctcccaccttcatttggcacttaggttggtagattcagtgtattgaaacagcttaaacattacataattgcctagaaagggctaaaaatgatcttataagcatacaaatattacagcctactggagtcttcttttactagacacacatagatcactgcctatataaggagcatggctaatcatcttcttccctggatatttgccatttgatgtctgggaaatacaccatagtgttataattacttttttcctactactgctttatagtcatatttaacatttatgcattttccttctctttttaatgattacattttctttattgggtagcattaaagttttcctactgatgggtcagacaaactcatttttattatggtcaaaatcagttaattgttcaataccatctaacttgctaatgctatttccaagtatttagaaatatctatttttcataataactaggtttgagcctttgaatgtgttttaatttctcagaatttggaaagttaaatgttctcacatttatacttacagaggtcacataaatgatatttagtgagttcaaactattaattatagatacaaggttgaattcaagtgaacattttcctttgatctaggtctgtttagataaaatggtccatgattttagcaacttcagtgctaagtaatcagagcagcctagcagcagcaacagagacagaataatctccactgacagacgattttataaacagccagattcaccaggcctccctatttcagctatgagctcatagcagaaggctgaggttctaagatgtccaccatcttttctggctgataaatttcatgtaggaggaatattattgttccagatggtttttcagcgttgtgcacactagcctcatagactcccgctgtaattgaaaattggttttgctccaacaattgacaaaaaattagattaggttaactactttttgattttagattactgatacaaagtgctttcatgactatgacaaaataaattgaaattcagactaagtgacgtccctgtgtgtattttcacttagatatttttccctgaggtttttatagtatcattaaattacattcagatacagaatttgcatagaatcaggctcattgaaattttgatgatctttttcaatctgtaatattgctagtagtgtttttatggaaaactagctagatattttaagtcactgtaaagacgatgatataaaaagatttaaaagccatctattattaggttggtgcaaaagtaattgtggtttttgtcgtacttttaatgacaaatagtttgcttgcattgtgaaagcattcattgtttacttctaggttctcatgaaataagaaagtaattttcttgaaggtttgtttgatagtcctccatagattttttttaattaaaattttaagcatttggagaataaaacatatatttagcaggttataaatgagatcaattgaagtcaaactttgagctatagttatcatcagaacatatatggggagacacatgaaacctcagcttcccagttgaaatatccacgagacatctgactactaggaaagggatggggtcatgttacacaattctggtcccaggtgctcaacaggtgctttgcaatcacaaatggctggacattcattagtgctttcagtctgactcccagctaggccttggaacagagagtgtgtatacaatattggttgaagagtttggttaaaaagaaaagcaaagcccagtgttagaaaaagaggtgacatcatttggttcctataaggctattctgtgcctaccatatgcagacacgtttttaaagacatgtggtgccttagctctgctgcccaggccaggatgcaatggcatgatcatagttcactgcaacctcgaactcctgggctcaagccatcctcacacctcagcctctggagtagctggtactacaggcacatgccaccaacccagctaattttaaaaatattttcaaaggcagggtctcagtatgttacccaggctggtctcaaactcctgggctcaagtgcccttctcacctcagtctctgtataccgacatttttttactggtcactgaggagttttgaggatatatttccagctgtgaattagcgctgtggctcatttgagctaaggtgaaaacattcctgatattcaagaaaataaaacaaccctgttcccattctgtcctgttgatttttaacatcaaccctttggaggaatatcctcagattcatgttctgtccttttttgccctttctaactgtcccttagccttttctcatcatcgtaaattattacctgacattgacgggggatttccctaaaattgtagagaattttgtagaacgaagctgtgaaatcataaaagacagggttacaaagcctgagttcatgatcaaggactagtgaagacaaagaatcttgttacaaaatgagaaaaataaaaataatattggcctaagacttcaaaatgagaaaaataaagatagttattggcctaacattactttcttcctttagtttgaaaatgatgtccttcctgactttttgttattaaaatggacattcttttgtgaaatgaaggtgataataaatgatcattgatgtcactaattgataaaatcagaagtggttagccctaaattggggttccacctctgatttccacatgtgtgctttcatagatctaagaatgtgggaactactgatctaattcagctaattactcaaaccatgtatcccgtcaacagaaatgctaacaagtggtaatccagccttccctgaaaacccttcctgtgggttctcagccagatgggctacccattatgcttttggactcttctaattaatacaagtatcccctacattggatgtaagtcttctatactaattgctactttttaattttacccagaactgtatatgctatgtctaatgtaacattttcctaattgtgttccacagaacattaattctatggaactctatggaataattaatatctattaatagatattaccacaaaaaggggggagaactacagtcaaattattttggaaaacaatagttcaaactataggttatttcagtacttcagaaatgcatttttgggataatacacacacttttcttttttttgagacagggtttccccctctcgctcaggctagagtacagtggcatgatcatagctcactctaacctgaattcctgagcccaagcgatctttccgtctcagtctccccggtagatgggactacagcatgcaccaccacacttgcctaatttaaaaaaaaaaaatttatagagatgaggtctcactttgttgcccaggctgatcccaaactcctggcttcaagcaatcctcccatcttggcctcctaaattgctaggattacaggtgtgagctatggcgactgacctaacaaaatatttttgagtataattatatttgacgcaatcagggtaagttagctgtaagtatgaccacaagacaactaagttgattagtatagcataaggagttcatgggcagccatgttctatttgctaatctatgctggatatatttcagagggatatacagtcatccgagtttctgaaatttggcctatggaattaattttttttaagcagcgaatgctatttagggcagcagtaaatcattaaacaaacattatattcatttcctgttctacctttctttaacttttcttatctaaacatgtcaattgctttaacccttaatcagttacatgatttctataccctttaactttactctaggcatgcccttgttttgtccttgcttttgttgaaattatggtgataactgaacacaaaaatcagatttgttttgacctagtgtagtataggtgctatcttctttttctatttgtatatttctatcagcattaacagaagttcatttttattttgttgtgttctttttgtctagtacttcatgtggttatcaaataccaaattagaatcctgtaataagtgcatatctatattaagaatcaacttgttagagctggtccatcaacctgtcacattaagatctttttggaatttgttaattagctttcaaagaaatatacccactcaaatatctcaagtaaagacaggttactgtagggattaacactggaaatcacgaggacaaatatcttagtgacacagtgaaactcgcagcattgcagaaatagcagcacatccaagtgtcagaggttgtgctgggacaacctcttactgctgcatcactgggccacatgggaatgagaatgtggcttaggaactggaaacccattaagatgcagtgatgcccgagtgactgtcatctcgttgcttccccccactctcttcaaggagcaggactctattaatgtctcttctagttctctggcattaatctcattcgctgacatctgacttttgttgttgttgttgttgttgtttttgagacggagtttcactgttgttgcccaggttggagtgcgatggcacgatctcggctcaccacaacttctgacacccaggttcaagtgattttcctgcctcagcctcccgagtagctgggattacaggcatgtgccaccacgcctggctaattttgtatttttagtagagatgaggtttctccatgttggtcaggctggtctcaaactcctgacctcaggtgatccacccacctcggcctcccaaagtgttgggattacaggtgtgagccaccatgcccggcctgatgtctgactttctttgggacttccaattctgctcctgctaccactgcttaagtcttactgtatatttcaaattcaagagttggcctattcattacactgctgagtcttataccctttttcaatcaagcaatgcttctactattgcaactttaatctgccatatgccttatataatgggtttgatttttgagtataactgtatttgacccaatcaggataagttagccgtaattatgaccacaagacaactaagttgattagtatagcataaggagctcttaaaatgtggttcctaggctttgcagaatcagcatcacctggaaacgtgttaaaggcatcatcccaaccctactgcatcagaaattctgggatggcattcagcaatctgtattctctcaagccctccaggtaattctgatgcatgttcaagtttaagagcagatggtataaaattatcactctagagtctagatttatggtgtgagtgccaaaaataatggctttaggcataattgatatgtagatctttctgataatattaactaacagtttcagctgctttttaaagttgttttttgacaagagaagaacattataagcatgtaagatcatgcttttattcctatttgttgtggcatttaattgatataaacactggaccaattttttgtatacaagtttactataataagcctgtattcttttttttacttttttctttctttctttttttttttttttttttgagacagagtctctctctgtcaccccgactagagggcagtagtgctatctcagacactgcaacctccgcctcccaggttcaagcgattctcgtgcctcagcctcccgagtagctgggattacagatgcgtgtcatcacacctggctaagttttgtatttttatcatggtagagacagagtttcaccaagttggccagggtggtctcgaactcctggcctcatgtgatccatctgccttgccctcctaaagtgctgggattacaggcatgagctaccaaacccggtccaaacctggattcttcatgtttaaagtacttgaaaaggaatgtgtatccctgcctattttggttctcatatatattttttaatataacagctttatcgagatagaatttacacatcatacaatttacccattaaagctaagcaatttaatatcttttggtatattcacagagttttgcttttattgccacaattttaaaatattttcatcaccctaaaaagaaatactgaacccgttagcagtcattccttctttctcactctcaccccattccccttccccttctcccagtcctaaacaactactaatttactttctgtctctatggatttgcttattctggatatcttagataaattatatcatacatatcatacattatatagtcttctctttctgttttttccccttaacataatgttttcaagatttatacgtgtcataaaatatattagtacctaatttcttaatttccaaataatattccattgaatggatataccatactttactcatgcattcatcaatggagggacatttgggttgtctgtacattttggctagtatgaataatgcttctgtgaacactcatgtacaagtttttacatggacattgttttcatttctcttgggtatatacttagaaatagaatgattggttcacctggtaactcttgtgtttaactttttgaggaacttccaatctattttataaagtggctgtcccattctacattcccacctacagtgtttgggtgtttctgtttctccacatccttgtcatcacttattattatctgctttgggttacagtcatcctagtgggtctgtgtacaatctcactgtggttttgatatttacttccctggtgattaatgatgtggagcatttttcttatgcttatcggcaatttttttgaagaaatgctattcatattttttgctcatattttacttgggttattgtatttcattatggaattataaaagttcttcatatcttttagatgcaggcccttatcagatatatgatttcatagaagttttttgggatgaagatttaaaaggtcaaatatgattcctgtgaatggagagagaaattaatgagagataaaaatattaattttcttctcaatgaaacacagggtagcagtgggcattagtacgacaattcaacaccaaatctacctattatatatgcaggatatttaattgagatttttgcttgaaatttgttgagaaggaagccagtgcagagttctgaaggaaagagagtttccataaagaatagatagctgaatattgaagagttcacacaggactggaactaaatataagttattcaacctgtgaacaatgatcttaattattggtgacacagtttctcaggaatgatggaacaataagcaaaatgcactcatcttatacgtgtgagagaggaatggaaatgaagatggagaagacttgcctccattaagctggaatgcgatgagtaggagagaggaggctggtgaggagatggaattagggtcaaggaagcagagggtcaaatctttgaaagatttgagcatgtttgaaggaatggaaggaaagtgtgtggggagggaccaatcaattgaacataaaagagaagggtagggcagaatctcagtgaggtaggcagggaagaatacagaactcacagggagctgtataataatggccattgggtcacctcttagagttcctgaaccttgctcagatgtgggatctaaacacacaggttatacctttactgttcatgtgggcctgttgacctcaatgaggtttctaatcttcattaaattccctcttctaatatatttatctaaattttctatctaatcatcagggttgggtcaattcattcatgaagaaatgttccttattatggaatactctgtattgctgagttatttttgcagtgacattctgaagtttgaggcaagcttttaattcaaaaattctcctgatatcccttataattcagtattttagtggcttaaatatacctccagtcatactacaattccaggtggcatataaaagtgggaaatggttacaaacattaatcacttagccgaagcaaatttaattaaacaatagtctaaacatttctttctaaattatgagcatccatcagatgatattccttttgtttctgtggtttatatatgaagctttcttattgatgcgatttcactatctgtagattaaatgtatggaaatcagacttttaactcagcagaaatcaggagacccagctttaagtcctggctctgcagctaactagctctgtgtccttggtcaagtcacattctttctgaatactttgcttcttcattgtgaaatcacaagatcaaaatgttaagtgtatagtcctttccagctttgttattttgtgaatctttctgttagtttggagttgaactttctctcattgtttactaacccagatccccaagtgaaaaaaaaaatgcagcatcctgatttaaaggtataatgttccataatgtcttatgttctcatggctgatttcttcagctgaccacaagtcttcaaaagagaaatcgtggtgtttccttcctgtccatggattccttcacatataactaacattgatctagagctgcttgtggagctgtcccagtcacaggccttctgaacagcatttttgcgcttgttaggacctaggcttcctgcttggtgtggaccctgattatgattactacactcaaccccacagcccagctctgctagagggtcccggcaatccggtattttcttttctaaagtctcctatccaggtctgagaactataggttttttttttttttttttttttttttaaggagagagagaagttagggggacagggggctatatactaggcactgtgttaggtgatctgtaatataattccaataaatgtttataccttttctggctctggcagctgggtaatcacaacattatatatgggaaaactaaggctaatgcaggtgaaataatttacccaagtaagcggagggaaatggtctgaacctctgacagctaacatccaaagtgttggcccttagctactctgattttgtgcatctatagtaactttgggtggaagagtactttttctttttttttttgtaaccctgggtgcctggaaaggtaggaaggaagtggggagacttgaagaatatgagaaaggaaagattggtaaccatatctttggagagcacattcatttcatttcagggtatctattctaatggaaatcatattttcccattgttaataataaatgatcatgaaggcagttgttattctttgagttgcttgtataatgatgcaagaacactgttaatcagtattttaattaggtttatagcattaaagttgtttttatatttctctatgtaaagtttccatgagtttcacatagttaacatcattggtttctggatatctaattcattttcagcactgataataggccatgttgtattagtttggaaatgtattatctatgatatgtattatatcctcttggcagctacagcattgtgttaaaatgaagcatcgcctgtaagccagatgtgtgcccttgtcattgcctcatttgaaatactgcattatgaagaaattgatgcaatgctcacaaatctataaggattattttgcatgtgtttgattaaaatgtagggagcaaaccattactttacaatacagaggttagaagttcagcatgtagtgagtgtacacttttgcccaaaagataaaaagatgatcaagactgaaactccagcttcacatagctcacagtctggtgaaagagatagatataagactgggctttcaaaaccataccataggaattaacttcattgactttattctatttacctacagggtctgaagccatacatcgtaagccaagtcagtgcagcctttaatcaaaatcattttatcatgtagcacttaggattaaaaaaatcaccacaaaattatagaatgagaaaaacttggcataatagcaactcctcaggaaaagacctagggattttatttgttcataaagttaatatacacctaaagtgtggtgagcctctatacctattacaaaaggtagaatgaatagaagtctggggcaagaacaaatgggcaagggggaagacttcatctgtgtgctatagtagttagatcacatgtagagtagggggctcatttctaaccactactttacagagaagactgacaaaatgatgcttgtctataaaaagtaaataaaaatagaactgcatctcataaggatgtttgagtttaaaaatgttagttaactttaagaccaattggagtctgtgatgatgatggtatcattaaggacaatgtttacttcattatctcatttaatgttctgacaatccagtgaaataggcgtgcttatgatcacccattcacagataatgacatgcacacaaagaagtcactgcacttcctgagatcacatgactcgggacagctcaagcccatgttcttaatgacagtgctgtgctacatcaaacataagcagttgccggtccttgacagtgttatcctaggccttcaacactgtgtgaggaaggaaagtgacttcatagcttcatcgagtataaggatacagaactagtcattggctaaatttggcagatgctgaaaaaatggcaggaggagctatcttaggtatatttcgaaatcaggggaagctcttatctttggtgtgctccttttattttcttttctctatagagatggaaatttccagttatctaggtactaaggattgtcaaaagcattcattgctgtcttactgtcttaaaattctttttttcttttttcttttttttttttttaagttggaatctcactcactctgttggccaggctggagtgctcactgtaatctctgcttccagggttcaagctattctcctgcctcagcctcctgagtagctggaattacaggcatgcaccaccaagtccagctaattttcatattgttagtagagatgggggtttactaggttggccaggctggtcttgaactcctggactcaagggattggcccacctcagcctcccaaagtgctgggattacaggcatgagccactgctcctggcctgtcttaaaattcttaacttaaaataatattaaagagcattttgttatttcttatactagttccagtctagactcttgctttttcttcttcttaagggacagaaatagaaggtttcattcagaactcaaagtgaacatcctagggcaggactgtgcaactccttcaaagaagaatgattcctgaaagcttttattactttccctggaacagcagttgtctgtgacaattacctaatttgaggcaaatgaatgacaattcctttccattcttcaaaagcaacattgcaaaagaaagctggagggaagtctagagagaaaattcttattgatattttacaaatataatatgtttcatttgttacaattcatataaactgccttcttgtaaagatgcacccagatcttagttgagcttacgtaaattttttaaaagtcaccatttcctataatataacttatataatgctatattatgcaattgtaactaacatgtgttgaacactcagtatgtgacaggcagtgttccaagtactttacaccccaccaacctggggagttaacaatgacaaatattctctctttatagacataataaatgcacagaatgagtaaccgtccaaggtcacgcaggtagtgagtgtctaaaatgtgacttgaaactgaacattctttttccaggttccaggttatgtgtacacacataatcaggtttctagatggccttttgttatccaatttgttatgcatgaaagaagcaaaattgttcattatgtggggagtctgtgaggcagtcactgcacattggctcacttgatatccaccctgctcccattctaaaatgtcttcctgcactctaaaggctggaaactagaaagccacatttttaagagtcctttactgctagacttctacctgtgctctaggttctgccaagcagattcagacgtctaagccttggaatgtgtgaaaatgaggtacgggcatggcagcaaagacatgtgatgggtacttttgtgcatgctggtctggtctttggcattatagctgttgagcagtgggcagcagcagcagcagcaaggtttcctctagaacactcttagggtatggttggaagcttctgtaactgtctactatcccgtaataaaattcttgctacttaagctagctagattacattctctgcaaacaagatccctagtggatgcagagggcttcaagcctataaagggatattggttcaggagggtctctgacctttggtgcccatccagtgctggaaaattgaactagaaggctcattttaagtttaaaatttttctgatttttaagacagaagactctgaatagggtagagaggagatccttcatgcatttgcttaagcaagtttttctatagaaattatctcctccctcctgagttagccatatgacaaaaagcattgcatttctgggagaaaatgtgcctcttgtactgccttgaagaataactaaaccaaaataattaaggagagcccaaatgaacattgcctgttatgtgaatccaatcaattctggaaaagcaataatggaatggggagttctctgatctctcttgtctttgtttttcttctcctgccctcctccaacccctaagtcaaggggaaaatgggaagggcactggaccttgaaggtggatatggtgatgtgggaagcctccctggaagggaacagtcattgagaagggcaggatgttttggaaacaggagtctgcaagtttctctggtgtaaagggaagtgtggagaagcaggggaaaataagcatggggacaggagctaagaaagagctaaggagatagtcttccatcatgtggataggctgatgattttttagcagacttttaaaaaaggcttttttaagaagattaatatgaaatcagtaagttagatgattggaggtgggaatgaaacagcaggagaaatagtgatgaagctgcttcagtaagccagcaatggcaaataaacacctgaaataaaaaactggaaacagaaaggacaagagttagcaaagatgcactggcctaacttaagaaattgttatgtaagctgggtacaaaaaaagagtttttaaaaaatgagagtgagcattagtgccatgcctcttacatataaataagaatacagacatgttaaactatagaacttgaagattaattatccttgaagcataattccaaatacaatgttggaaaaagattgcaaatatcagggaatgcaggtttgcacagaccagtcattctttttagttgtttgttagtggaaaaattatttatttcacaattgaaataactagcaccaaatatctaaaagctggtgggtttaccacagaaactctctctctctccatctagacacaattatgttttccaggttgcactaggagaaacctcatgctacgttctcatgggtctgaaaaaaggaggtcattcttttgagattgttgggtgtttctctgaggttctttatccagttgttacttctgtttttattttgcttataaatctttataaaagtgacattggaatacttaccttttaatggaaaactgcaagggtcacggcagagctcaagattactttttcttttcccacatggaaaattttaaaaatacaaaaagtattttaagtctagggttgcatctctcatagtatttaatttcaaatagatcattggaggacacatggtatagaccagtcatacaagtgcattcgattttccaggtaataaaagtacccagaaggtgttcattatgctccaactcttgagtagtatgcatcacatcagtactaagctggtgacttaaaggactctaaatctgtttacagtaacaacttatttttctcaaggtaatttattttgcacttttagccatcctaggacacattaaggaccaggaaccaagtttaaaattctcttacagcctaaaatagttatagcaatgtctactgtataaagctcatatgctttccaggggtaaatcccttggggaaatattacttttattgtagaaccaatattagaaagattgtggctttccaggccataacaaattagaagcaagaaattgcaaagggaaggaaaaggtgacagtgacaaatacagtgagtgcatcaagaagtaaaagctaggtgtttcactttaagaggatgaagagaaacagaatccttatttccctagacttggaaaaattatttgaagacctagttgtaaataaaatttgtggctaaccctatagcaagtgctggaacaatgatgtccccatccaatacctgtgcatttggatccagcattcaaagacctgcagcccttgcctttggcctaatactgctcttatgccatttgttagccccaaggtctcacaggactttcagttcttttttttttttttctgagacagtgtcttgcactgtcacctgggctggagtgcaatggcatgatctctgctcacggcaacctctgcctccctggttcaagcgattctcctgcctcagcctcccgagtagctgggattacaggtgcccaccaccacacctggctaattttttgtatttttagtagagacggggtttcactatgttggccaggctgttctcaaactcctgaccttgtgatccgcccgcctcggcctcccaaagtgctgggattacaggcgtgagccaccttgcccagcctttcagttctttaagttgagcttcaatagcacaggacctaagaaattctaccattttactatcttgcaccttgaagctcgtatgttcctgctttgatggcttaggccaataagctaggctggaaagctgatagtataaaattatttgagcttcagtagacgtcctctgtgctcaaagagatctttctgttctctcccactttagggtagtttcttccagggatagcctcaaaacttaggtgtctgagaattatataatgacctctaaaatcagagccatgggaactgagtattcagtttagaccccttctttaccctcatccttctaataagaagaatcatagcactctagagcttttagtgagataaatatctttccaaacctcaaaaactcctgagaacaatactgtattataacccagagtaataattaatttttgtaatgatgacattgagtcattatgaaaaggttaagtcatccaacataaagtttaatcaagcaatgcctgctacatgcaaaaaagcaaggaagaattgcatacattttgaaaaactgcccatgaaaatgttttaactttataaggaaagataactttaggctatttggtaagttaaattctgtgaaacgcccatgtgctgtcagtgctggttaaatgaggcatgtctgtatttgactgtgttttctcataagacaataagttattaattaataaacatgaatactatatccctaccatgcctatgaggcctgtgtctatagagcctaaattagtttatacttaacactttaaaatcctttttcagtaattcatggaataatccatatgcttggaagacttgtgagaagctgatcatacccattttcccagttagtttttaaagtagagatctgacctaaagaactgagcttacctcccaaagagaagtataaattcaacctcaataaaactgatatttcatatttgatgatgtatgccttcagatattaactggaaagacaaatttttgggggtatatatggattagtttcatttgctcttggattttaaatttatccatcatgggctgagtgcggtggctcatgcctgtaattctagcactttaggaggccgaggtgggtggatcacttgaggtcaggagttcgagaccagcctgacccacatgttgaaaccctgtccctactaaaaatacaaaaattagctggaagtggtggcaggtgcctgtagtcccagctacttgggagggtgaggcagaagaattgcttgaacccgggaggtagaggttgcagtgagttgagatcgcaccactgcactccagccagggtgacagggcaggactctgtctcaaaaaaaaattatccattgtggatgaaagtagcaatttcatgatttttacttaattataatttttacttcagcaggattgtttagtatttttatttttaatgttataataagtaatatacattcatgtttaaaaatctataataagaaaactaaggttttatagatttatttattccacaaatattatttgaatgtctgctttgtgccagcctagggacactactgggacaccttaatggacaaaaaacatcagcctttctagagtctgtctcttggagaggaggagaaggggagtgtatggaataatagcttacacttatataatgctttctgtgtgccaagcactgttctaaacactttccatatattaattcagttagttcctcataacaccgttaagagatgcaaactgttattatcgcctactttatgcataaggaaactgagatacagagaggttaagcaatttttccaacgtcacacagaaagtatcagaacaacgcttcaaacccaggcaacttggctttagttgcaggtgttcataagtattgcacatacagtatcattacgttactattctgcagaattttaaaaatcataacagtatgagcagaataaacaattcagtagaaaattttagttactgaaaaacagatgttaatttggtaatggtaataatagtaaaataatttataatttctatcccagaaaacctaaattcttctgtaagtcaatatgtatagattacccaagtagactcacacataagactctccaatatagtttggtcttaagtgaatgattcactggaaattttaatttgctctttggaagcccccctcccccagatactctcattagtaaactaccaaccctgtgcctgtaggactcaagtttttgcacaagaagagaaattcagtgttattaaattaaaggcaacatttgcttatgtttgtcatttatcttttgtggggttcgcctttaaaaaacatagaaacttaaatgatatgaagtcttcaaaataattggaattggagaaagtgagtggaagcagagataaaacaagattgaccgtgagttgataattattaaagatgtgtgatgacttgataattattgaatcatgaggattcattaggttatctgtctatgcttgtatttgccattttttcacaactaaaagttttagaaagatacagaaattatatttacaaaaaatactttaacattttgctgtagatctaattcagccagggttaatatccaatgtgaaattttgggcatgagttgctaagaatttacgttgatggtattatgcatgtggtagtataaaataataaatcatctttattaaaatgatgcctgtgttccatgaccatgacatacactccttgacttgagtcatgagggaaaaatgtgttctttctttaaaatatttttgagtaatgaatgctgaaatgtaacaaataaagacacatgctccatttaaaatgagatttcaagtctgtgtccctttagtttttttatataccacaacaaatgtttttttcaaaccacagtttgatgtcctatgaaggataaatttatttgtgcattcttttgagctctgcaaacttagaattttttttaaatcttagcatacagatttaaaatctctttttgttgttgttgttgttagtgtttttccatacagtattcatttatttctgatggctaaagccattctttacataagagaaacatttaaaatatggaaaattttaaagaaaaaaaggcatctgcagatctgtaatccagaagtaccaatcaaaacactgagggcaggggcaccttcacaccataccctggcactgccccagagaattagggagacaccagctgggattgttatgttctgtcctaaagacctctcatcctcagcaaataattccttgctcaaagcatgacacaaaagcatcatcagagctgcaggacgtttgaaagaaccaggtgatgagcatgaacctatgtgcatctgtggtcaatcgcagtttgctcttggtactctctgctggcaagtgagaccttaggacttacaaataacccaatggatgttcaacccttgtggtgactgactgatttttcccattgcttagaaagtttcttgtacataggaaatcctcaccccacatatgtgtttgctttgtgcaaaggaccaaaggatggtcctatttactctagtggaggacaatggaagaggactgcgtttgagagggaaggattcatgagctcagttttggaaacgttgaatttgagctgcctttaacacatctaagtaaagatgtcaagtaggcagttggagaagataaaatttaagttaggttggtgaagagacaagagaattttttttccaggtgagttagagcatacacaaggtcacagaggtagagacatgagggaatattatattgacaacaaaatatagtaaggtagtgccaagtatggaaaacctgttgcttatgatatgcagtgatgatattattgcatatgatatgcagtgatgatattattgctttatcagcataaaaaattggtaatgggtgggaatttcatattctttaaccaagaagcttcagaatgagattttctataattttcctgtaacctagttatcaccctaaaccagctagttatgtcatagacaataatatctaaaagacagggagcaaataggaaagtaatttcctaggaacagtaaatatagctatgatatttcttcacaggataggggtcatcacccaatagatgtaccaactcaatgacattgaatctaaataaaaacagcttgctggctctttttgttgttgttctttagattttcttgccatacgcagcttcaaaacaattacccaagctccttttagaaccatattgctccccacacgggggatctggagaacctgtgactgttttccatccttctccaacttctccacttaacttgagattgttttcctttctgagtcacagctccatatggtttctgtttccttcctcttacatagcaagctgattacctgtaatcttttcattgctacagtctgtacctttaactctaattaatctcacaaatgtatgacaaagagaaattagtagaagcagtatgggcgaatattagcttatccttattactagagaagtaagtcaacacaaatttcctaatggtaaattgataacactgtctttgcatgtcataaaccatgtgagatagttattcattagtttactacagtgtgcctggactcagataatcccaaaacacagtaacgagtcataatctagccaccaatttatatcagtgctttgaagtttttattcaaactgctaatttacataatgaataaaagtagaaatcacatgtgatctatttttaacagtctatgttaaaagtctttccattgctataagaaacagtcgatagaaaaaaacatattatgtctaaaaagttaaaaatctccaaccacttaaatgctattaaaataatcttatgaattcttctttatttccccttccttcttcttgatggtttttgtgagtaatgaaatacataacataaggtggattgaaaggtgctatatttcagatatgtaaggagtactttatagtttaagaatataggaatttcaaaaatgtaacttttctagtaaattttatgtacatattataaataattctataatgatcttcatatatatgattttggtatcaaattttactaagtacttgatataacttgtataatacatacttatcattaggatttgatattcctatatatttatactatcagaaacacaattaaaacattgttagccaaggaaaaggtgatacttctacattttaaagacaattttagctatttctgtttaacatacattttaagataataatgggacacaaattttagggaaatagtagaaaattatttttaaaatggaatctctacctgaaaaggcagaccataactgttgtacagatatactatccactcagtgattaaataatcaatgacagagcattttcagctgcaacattttattctaagagttgggggcaggaaacacattttcagctattgacacacagccaccccaaaatcatgacaacatgttgccctttttgaaagatgaaatctttaaaattagaggactttttaaagggtatatttaatagatatgctatacaactgttagaatggtaaaaaaaaaaaaaagataaaacaatttcttacaaaattaaccacatgcttgccatataacccagcaacctcactcttaggtaattacctaagaaaacttaaaaccaatatccacaccaacacctgtgctatgatgttgataatcattatcattaaaaactataaatatcattgtgcattctgaatatcatttatattcataatcattaaaaactggaaaccacctgaatgtcctccaactggtaagtggataaactgatatgatacagccaaatgatggaatactactcagcaataaagagtgggacctattgattttaacaatatcatggatgactcttaaatatattttgtcaacttaaagatgctagacccaggaagctacatatttgacttcacttattttagggatggagagcaatttggtggttgccaaggtttgagggagaggacaatagttgaccaaaagaggctgcacagatgaactctggtgtaatgggactgtttcacatgctacttgggtggcagaaatatgactctatacatttctcgaagtccacagaactgtgcatcgtgagtgtgaactttagatatgcaaataaattttcaaaaggatcaacctaaggatctcaggatggaatgcagactgagaaagaaatctaacgtttacaaatgtatgttataacctcactaaaagtagtggggggaaaagtaattgacctgaataactttagaaaacattgacattgttttcactggaaactgaaaagctaaaaacaaaaggaactgtgcatagcgataccttctggcagttctgaaaccatgttatgtgttttgatgtatgtgtatgttttagatcatgggagccagatttatcactatcagataaaagctaaaatcactaccagataaaagctaaaataagcaaagggggcagtctagaatgaatcctgtggtgttgaattagagttggagccatcaatatgcacaagataaagattttcatgctgctgataaagacatacttgagactgggaagaaaaagaagtttagttggacttacagttccacatggctggggaggcctcagaatcatcatgggaggtgaaaggcacttcttacatggcagcagcaagagacaatgaggaagtagcaaagcggaaaccccagataaacccattagatctcatgagacttattcactatcacaagaatagcatgggaaagactggcccccataattcaatcacctcctcctgggtccttcccacaacatgtgagaattctggaagctacaattcaagttgagatttggtggggacacagccaaaccatatcagatatggatacataaaagtatagatatgtgtgtatacatcgtttagtacagatacatctatttcctaggtctgtctaccaagagggccaagaagcaatgatacactattggtaaagagcagacccaatgcctagattgtactttctaaataccactctccaataaaaggactcagcattctttgggaaaatggctaattctagggctgggcagggaagatacaagacagaccttgagtgtcttctagtgtcaaaaaatgaggaagtgctcaaaaaaagaaaagaatggggcatgtcacaggggcacaggggccaacctaaatgagttcccaatggccaagactggaaccattaaagcagcaaaataaatagaatagtgctagtttacaacccaaagcataaaacaaatgtccatgagttcctacttatataaatacatacatacatacatacatacatacataaatacataaataaatagagggagaacagataaatcttccactttgaacaattccaaatactatatgtagatataaccccctccaggaggtggagcttaattccactgtgctggaaagtgggtcatatttagtgtctcacttccaaagaatagtgtttggaaagggagaaagagtaactttacagtagagaaacctgacacacaccgcctgagccaagtgatcaaagttaacgttgctggtgatacgggacatccatctcatgtaccccctgataggatgtgcggaggagggtgcctcatgtttgtgacagtgttccccaaacacatagtcctagtctaattatgagaaaaaaaattatgaaacaaagactgaaggacattctacaaaatacttgacaaatattattaaaactgtcaaggtaatacaaaaataaggaaagactgagaaactctcacagaccagaggagactaaggggacatgacaactaaatgcagtatggttccctggaatggaccctcagacagtaaggagacagtggaaaaactggtgaataatgtctgtagtttttattaggttggtgcaaaagtaattgtgctttttgccattacttttaatggtaaaaaccgctattacttttgcaccaataatagtaatatgccaaggttaatgtcttagttttgacaaatataccatggttatgtaaagtgttaatgttaggagaaactagatgaagggtacacagaaactctctatactgtatttgaaacagttctttaaatctaaaattatttaaaaataaaattttatttaaaaacaaatgaatgctgtgtatgtataatgacttggaacaattccaagatatattattaagtgcaaggaaaaacccccagcaatttgcagaccaatatgtataatatgctactatttatattaaaatatgtatgtgtaaattattcatattgcattgagtatcctggaaagtttgtccaaaaacttggtgatactgattgccttgaggttttctgggaagaagagtggcaaggagatttacttggatatcttgcactttgttgcaccatttaagttttggtacttgtgcatgcatttcttattgaaaaaataaactaatgatatgtatataaattttaaagcccagctaatctcttagggcttaagggtagtaagtaaaccctaggaaggtggggtaaggctgaggagaggaaggtcacacctttgaatcttaaataacaactatagcgtacatgggtcggaaggagccttacttttttactgaataaacttttctatcttctgatttaaaaagtacaattaactttttaaaaagctcagttagtggtggcattctagtcatacttctctgaagagatttttttctaaatctttattacttatagtctccgtgggattttttaagagttcagcagaagatgattatactcttgggaattttgatgaaataaataaagtattgattagttcctgtttggggatttaaatctacagatttcttttttctgcccttgaaaaaaatctagctaataaggttttacctcaacttttttttccccataaatcaacaatttcttttaaaagtcaacatgacccaagtaggagaatgttttaatatgttcaacttggccttataagttagatatcgagttgtaccttgcattagttttttgcagctgccacaacaaagtacaacagagtggcttaaacaacaaaaatgtattgtctcacagttctggagaccacaagccaaaatcaagatgtctgtaaggttggatccttctgaaggctgaggcagaatctctttaagctccttttcctagcttccagcagtttgctggcaatctctggcattctgtgccttgtagattaatcactccgatctctgccttctccttcacatggccttctctgtgtgtgtgtgtctgtgtccaaattctgcttttataaggacaccagtcatattggattagggcttacctaatgaactaattttaacttggttccctctgtaaagatcctatttccaaataaagtttgtatcactaattctcttcattggctgagctgtggtctagactgtcagtaattgcatttccgtggtcttcctttattcttaaacttagctgtacatcagagtcacctggggaactttgaaaaatactgatgcagcagtctcactctttagagatttagatttatttggtacagagtgcagcctgggcatcagagtgtttaaaagcattttcccagatgattcctgtttgcaacaggattgagagctgctgctgcaagccccatgcactcaaggagaaagaacgagtcagttgccacatgagcatattctgccttgggcaaggaatgggaaatgagtgagtcagtgatcacaaccctttctatttttgaatactgaataggtataaaactaattagcctcttttccttctggtgtgtgtaaggttcaagcacacaggaatattaagggaaattaaatggctctcagcaaatttagttggtccagatgccttctttaactctactatctttaagtttccctcttcccttcttgggaatgtgttcaagggggtttgagtagcagcaattgctcaggtgccacccaccccacctctggtgaatcagttagttttcattcatcagggcctacgcttgaaataatacagacatctgagagtataaacatagctatttgctattcttctttctgctgataaatcactgcttcactcactgagtcttattgttctctaaaaataatcctttcacatgcacatctggggatttttttctcatcttccctaaaatttctgtttaatccctccccaacaaagtcatctcaaccaaattggaatactaaatcttttactttttcactactgtctttatttatttgtactttccataatgattttggtgcccaaaaggccacttgaaaatactgaaatgttgtgaagtttaagtggaagtaactaccacttagacactaagcctactaaatgatctgagttacatttccccatctctgacacagacacattaattccataattgtcccagtgcacttcattgtgttcttgtcaggattagaagaataaagatagtaaaaaggacttgggaaatataaaatactctattttctcagttttattgtattcagtgatacagctgtgacaatagcaatcctagcatttcatcatcactatttgattgagctcccagctgtttacctggccaggagcaatcaaaatagaaatgagttcttatagcttgttttggattttatagtctgatgctagctacctcatccaatatattatattttgaagctcattacaaaaaaatgggtgctacagtgatggatgtgaatagttaacaaatatcatttggaatagaatttcactatccccaaagaaccctctctgaagtattatatgtgacattcagactgtgattagaaaccctcttttgaccagaataacccagagtcatacagggatgggattctaggaaatgtaattcccactttaaccaaacagatgtaacacaatctagcttaaacaggtgctactatcatctgtgttttacaaatgagaggcagggcacaaagaagtcaagtaaattactcaaggccacacagctaattagtggtaaagtcaggtttgaactcagacagtctgattccagattgcaagcttcttacccctgagttttgctgtctctatgataagataaagggttctgtagaaaatctcagtgcatttttccttgcatcaagaatccttgtttctgattaattaaagaaaacttatcatcaggctgttacataaagcaattatatgtgttgtggcccttctgttctactttttgttaataaccctaacttattttcattttttcacagaaattatttgtgttttgccctttcaaaattcactttttttcctgaatcatttcttgattataagccttccaactattttgattgttgtttcactatgtgactcttagcagttgcatgtgttgcactagtttaatgatcgttcaggtttatgttctttgtatatattctgacatcattaaagtgttcatgctccatatttccaagcatactgcaacatccttaagtcaggagtattctttatatcaccaccaagcagtgcatagtagatgctcaaaagtattttttgttaaatgacaaatcttcctgtagcaaatcaactccattgggttttgttattctggtttaatgtctaccctcctaaaaatactcccaaaagaggatgaaacacaatgaatatttttagactggaagattcccaggattttccaacactagtaaaattattccttccaatcagtttcctcttttttcaaaggtattaaaatgctgataataatatttttaaacttttattttttaattaacataaattggtcttatattatgattttatagctagagttggcagattacttgtgactgaaatactgaattataacatccaatttagactgggaaaataaataagacttaaatttgttgtgttataaaatgaaatgtctgtattaagtatctccataatgagatttcattctgaatcacacttagagacagagtatctaattgcaatctgtaaataaaacatgctccaaaatatcacaattctgctgggtagattatgacagatagatacaactaggtatgtgttttggaggagtaaattattatttttactttttaatttagtcaacatggtttattagctgctactcaaaaatttcagtctgttagtacatattatggtgaagagtaagttgaagaaaatggagaattaaagacaaatgaaaagtaaaacatttccaaagagagttttgtttgaaactacatgacaaatgttttttcaaatttctttatcaccaatttttcaatcatgtaccttccaaattctagaccatccggctgtatcattggccacagtccttgaatgtcatcacgcatctggccatttctccttcaagcaaagtgaacaaccaggtgtactgctcaaagttctgcccacgagaaagatgtcccttaccactctacttcagggatgtcccagaaaaaaagctgtagtggtgcagctgtctgttccctttcaggtggtactggcatatcacgttgaaccatttgcagaccatgcctatggtcttatcttcctctaattaagcgttcggtgtctactaaggcctggtaactgtttctcaaaaacagagtagttatctacgtgtgatgccagggctctgaatttttaagggcctgcactgtgattcacctgtagggatctgacaaaggcctggcagctctgaaattttaagggcctgcactgtaattcacctgtaggggtctgacaaaggcctggcagctttttcggtcactcagtagattagttggagtaacacacacaaatgaggaatatgttatcttgaaaagccaagagacctcttttttggttgtaggaggggccagatgcaacaacttatccttcatctcagaagagatatcacagcatgcccccacaccactggacccctagaaatttcacctaagtagaaagcctctgaatttttgtcagttttatttcccaccctggcatgcggtaagtctaagtagttgctacttcttgctcagtaggtctgatcagcataatgtcatcaatgtaatgaaccagcataatatcttatgaaggggaaaaattgaccaagattcctgcaaactatggttttatagcctgaggattggagagttgatatatctctgaaataggacagtgaaggtgtattggtggcctttccagctaaaagcaaacggcttctggtaggccttattgacagggatggagaaaaaggcatttgccagatggatagctgtataccaggtactaggggatgtgttaatttcctcaagcaacaaaatcacatctggcacaacagctgcaattggagtaggcacgtagtttagcttaagataatccactgtcattctccaagatccatctgtcttctccacagatcacacagatgaattgaatagtaatatgatggaaatcaccacccctgcatccttcaggtccttgatgatggcactaatctttgcagtccctccaagaatggagtattgccattggtttactagttttctaggtacagacagttctagtggcttccacttggtcttttgccataatgatcctgacttcacaggttaggaaaccaatgtgaggattctgccagctgctgagtatatttatttcagttatgtattctggaactaggaaaataaccacaagataggttcagggacttactggacccactgtgagacgtctttgaactaaaacttcattggtcacctgatatccataagccactactttggtgacccacagtgatgtttgggtctcctgaaattaatgttagctcaaaaccagtgtccagtatttctccaaaggtctgattatttcttttcctcaatgcaagtttactgtagtaaaaggctataggtcactttggaaaagcctgggaaaaagaattacagcatgaatttttgagagtatgctggaatccttcctcaaggagacccaacttccccttcattgaaagggtcctatttctttctttctttcttttcttttttttctttttgagacagaatctcgctctgtcgcccagactggagtgcagtggcacaatctcagctcaccacaagctccgcctcccaggttcacaccattctcctgcctcagcctccagagtagctgggactacaggcgtccaccaccacgcctggctaaatttttgtatttttagtacagacggggtttcaccgtgttagccaggatggtctcgatctcctgaccttgtgatccacccgtctcggcctcccgaaggggtcctgattctttaaagtggctcaagtctgggaattgattgagggaatatgactctgtttttatgattcaggttaggcttttgttcacttgaccaagacttttctgcttataccaatgaagtaagaatttagtaggcttcctatttcttttcttcgagaaacatcatgatcaactagctaataccacaggtctacaagactcagcgtattctgattgctgctttggcacttctgtccatcagggaaaccctgcccaccttgcctgtgacagttgagtgctgccacttggcctctgccacactgcagttcagttattcccattgaattaagttttcccaaatcaatgggtgtagttcccacagtaaggtctggtctacagagaagagcaattgtggagctcttcaagaatgatggggcctcccacacaaatttatttctcatgcttgtggtaaaatgtatatcttctggattctaccagtttagataggtagatcacaaataacaagcctaccctaacattccaatctccttgagcctttgaattttttcctctgtaataaaccaagtcaggtctggcatttccaacttgttcactgttgaccaccttttggttcatgtttcagccatccaaataaactgctggagtctagatcaataagtttggccttttccaactttatgttcctttcaccattatcccacacccttagtatccattcccacacatgttccctggatttttgtctgtgtacattagaaaactcaaatatttcttttggaatgtagcacagctcttcatgggtcacactttgaacctcacctttaggggcctgttgggtcttaaatcttgttatagatctgcaaacaaagagatgtgagagggggaggttctaaggagatctagcattgtcttgcatgtgaggcctcagaggataccatttcagtttcttcaggcaatgcagggttaatcccctcagacaaagtggtatagggttttcagatgggggtggaaagccctctaccacttgaggttgttgggggacaaatcaattcacctgggggtagggatgctgctaccactgggtgtggagatgctgggagtaaggaagccacttctgctgggagtggggaggccacttctgctgcatggagaagcttcttctactgaacagggggagacttcttctacgggtaaagaagacttaccagaatgtagggcctcaatgtccccaacttcatcagagttttcctacatatctccatcccaacttacaggatcccattgttttttcaactaataccctcattttaacagtagagaacctgtgagactaggagttcaacttgtgttataattcagccagctgcaagatgagattctgcatttgatttttgtcaatcttagccctatggctacaggagtaacaggtttccttcagaacacacatagaagacgttaggtcatttctaccacataaaaactgggaattggaacctcttagctcattctttttttttttcaccactttgtccagaaacattaggagtgaacagccaaacttactatgtttgttacttttccaaaagtatcagaaggtattatatgcagtcgctcagctccttgcttattttttttttgagacagagtctcactctgttgcccaggctggagtgcaatggcacaatcttggctcactgcaagctccacctcccaggttcatgcctttgtcctgcctcagcctcctgagtagctgggactacaggttcccaccaccacgcttggctaattttttgtatttttagtagagacggggtttcaccacgttaacctggatggtctcgatcacctgacctagggatccacccgcgtcagcctcccaaagtgctgggattgctccttggttcttataagtgatggattgagtttccaatgcaaatatttgtgtatttctgttgccagatcaaacatgtagtatcagtgctttcttcacttctgaagaggaagtcattaaaatatttacctcaaatcagattagagagccaattcagaaaccacatatatatatatatatatatatatatatatatatatatatatatatatatatatatatatagtgtgtgtgtgtgtgtgtgtgtgtgtgtgtgtgtgtgtataggctcatgtgattatggaggctggaaagtcctacaatctgccatccacaaggtgcaaatccaggaaagctggtggcatagttcaaaggcctaagaactagagagctgatggtatagattccagtccaagtctgaagacctgataactgggagcataatcattcactcctttctttatctcttctgtgaaaggtgaatttgaaacttgtcccatcaagaaatgaagtctgattccccttcccttgaataggggcagactttgtgatttgcttcagcccacaaaatccagcagaaataactttgtgcaagttcagagcctagcccaccagagttgttacatgcttctactcttttggaaccctatccagccaccatgtgaacaatcataggctaacttgctagaggatgagagagtatatcagccagaattgagtcaacccaggtatcccagccatgatgatgtaacagagtatagcaaagatcaacaaaaccaacttgcaactgactacagatgatgaaggaggccaatttagacaaacaaacaaacaaaaacccaaaaccaccaagatgagttcagccgaaattgtttatccacagaataataagctaagtaagtggttattgctttaaaccactaagttttgggttgttttgttatgcagtgatagataactgatacaccaaaggagttctttaacagaacaaaagactaatcaacattatattaaataactctatcttatatactgtatataattaactctaaaaagcatgaatagtctgaaatcattctcttattcctccaaagaaactaataagcatctgcaggctgtgtggctagaacatacttgggattctcctgtctgtatcttaccccgacctaatcttgtcatagggtggcttggcttactgtttgcttttgcatttgtatgagtacctggagcacagtctgtactcattgatccccaaaatggctgttacttctggccctctaatataactgctgagttgattcagaaacatgtaaattaaaagttgacttaatagaagttcacttattttttaattaaaaaattaagatgtaatacccattctctgttttacttattcatatatatatataactatgttttgaaaagtgcctgtctccctgcaaatacctgcacactgacacttatagcagctttcttcatagttgccaaaactatgtcctttcagtagatgaagcaatgaaaaactggtgcattcagacaatggaatattactcagtgctgaaaagaaatgagctatcaagccatgaacagttattaagaaatcttaaatgcgtattactaaatgaaagaagctaatccaaaaaggctacatactgtatgatttcaactacatgacactctggagaaggcaaaattatggagacaataaaaagatcagcagttgccagggattactcaggagagagggatgaataggtagagtacagaggatttttaagggcagtaaaactactctgaatgatactataatggtggatacctgtcattatacatgtgtcagaactctagaatgtatatcaagagtaaatcctcatggaaactatgggctttgggtgataatagcacgtccatataaatttatcacttgtaacaatgtactattagtttggtgcaaaagtaattgcggttcttgctgttaaaagtaatagcaaaactgcaattacttctgcactaactaaatactctggctgtgcgagagtgggagcagggggtatatgaaaactctgtagtttctactcagagttgctgttaccctaaaaattctctaaaatataaagactattactaaaagtatctggactatggattatgtattaaactaaatgtttccctctctttttttgtggaaacatttcagaattgttgaagtatattaatgtatacttatgtatgtacatctgtgacaggctaacacatgacaagatttaaatctttgaaactgatactatcttgagctacttaattcaccatcagtgtaataatgctgggatttgtctgaagggtgagtgagttctcctttgaatctgattgattttccccagaggggcattagaattcagaatgcatttctaatcagtttgctgtacctaacttattagaattgctgtttgattagtgcccactgcaaatcaatataacatgaagggtgtccattttaataagcagaaagactactctaagaaacagatttatcaaagaatttcttaatctgaagtgccagttgaggtcatctactaattgaataccttcattttatagacacaggcactgaaattctcaagagttaaacagtttccccaagatcacatagctgggtaatgattgggccagtactgttatttattacttgataacatctttcagcagtacaaactgtctgaaacatgtgatggaggaaggagagcatgccacagcaactgtacgtgtacaatttggataattcattgacctgggaattgccagtactaaccctgaatgtgctcaattttgagtttttcaattacatttcctcatggaggaaggggtttattttggccttctgtacaattcttgctcacccttcaaaattcagtttaagcatcatattgtttggaaagccttcactagtgtactcaggcactattgaccagattccccactacgttttgtgctacccatcagttacagccacagttctcaaccaaggggtgcttttgctctctaggagaaatagaggaatgtctggaaatatttctaattgtcatggcttgaggtagtacctagtgggtgcaggccagtgatgctgctgaacatcctgcaatgcacaggacggcccatgctcatcaaagaatcatcgatccccaaatagcgttgctcttgagaacccctgaattatagttattgttttagatacttgccaaagccaagaatggttcttctctctggaatagttacttttagttcttttaaactaaacaatgagatgaacattttaggacatcaagagacacacattaattcaaaggtgtgttttttttttcccactgctcttgcaatttttaaaacctaaaactgtgttcaacagtattcagatatgacttacattggcatcagttctttgatggtgagacttctctttcttctcctcctccccctgcttaagttcacttactttgtaaggatttagatgcacaatatttcacttacattttcaaggggagggaataagggatggctgtattactttatctcccctcttccaaaatagaattattggcttccaataagagcaaactaatatctcactggtggcaaattcagtgggcaggtccctttctcttcactaatgtcaactttatacataccaacaaatttgttttatacattctttcaattgttgctgctctttgggcaagatgcacgtgggtgtaatcgtgactgccggatctgtcctgcagatcctggccgacagatgaaatgactactccagacacaggtatgcagtgtaagagcagctaggtgactgcctggctctagtggccagagaacagcagcaagaagctggagctgcttgcttttattcagtggaggcacagtgccaaaaactggagccaacacaacctgtaggtaattaacatttattgttcccgtttcagggaacgtcaggcacgcggatgatcaaaggtgagttcctggtcaacacaagtaaacaagcctgtttaagaaaaattcccccatactcccttgtatctactccttgccttctgccttagagttatagaatagctgccttcagctattctcccctggggctctgcagaagcttcctacctttcagaaggtttgtgtcctttacctatagtttctcccaccactctgactgattccccacacatgacttagctaaggaaaatagcagtcacagtaggataaccccattagcttctcggaagaaaagaccgaccatatattctgtggtgtggtgtttgtggggccaaagggaggatggagaggaggcgaacttggcctgtcaagagggatttagctggtcattgtggctggtgcccataatctcagtgactctggaggctgagacagcagtatcacctgaggacaggagtttgaaaccaacctgggaaacagcaaaactctgtccaaacaaagaagcaaacaaaaaacaggaagggaggagggatttaacaaaagggatttaacaattatcatatacaagaaataccagacattttaaatgtactgaacacacaaagccaatgaaattgtaaaaaataatgaacaaaaaccttaaaacatttagtgtaactttaaagctcaaaggaatgacatccatggaaattaattcacaactcctagagaatgtttaagaatatttgtgatttactcactagctttattttagcgggatgatatagttgcactgcatgaaaggcttagttacagttgggcttaatgatagaaaaagaattagtttgactttcttttctggagtacataaaaataagtacatatggcctttaaaatgagttttgtgaattaaatgatttatttttatacttgatttttctccttagagaatcattttgcaaatgttttaccttggagagtatatgacaaggcctaatgccactaaatatcaaaatgaagacttttttgatttattgggattcatttttgaaaatgcttacaggaattcacacacacacacaaacacacacacacacacataagaacttttttaaagaaactaccaacaaaatctcaatctgaaaactgacaatggatagataatttcctattatttcaataacaatctgaggttagaaggccaaaacaaatttgagtttgcatttgcacttggcctcatccatttctacgaggaaaagaatgtaggtacaccaaattttctgtagattgaattatagttttaatatccctttaagcatatttttggctttgatatttcatttgccagtaaagagattcttttgttgccaagcaaaagaattaaatgagtttgttttagcttggaagctaacactcctgtaacttacttgcttttctaatcaaatccagtgattattaagtatcttttatatgtgaagtggtgttagacgttggctattagtaactcttccttagaagaaatatgtaattccttcaatattcagtaaaccagttcattagtacaaactcaacctggaaccttctttcaaaagtagacctgagcctttagaaggcagtagacttttagaacattgaaagactttcaaggtaattcctgaaaatggatgctgagccaagtgaggatccaagtgcttataaacttagccaagagaatagtcaaaaatctctgatttgaaaacctaagatgtagctaagccaatataagatatgacttagaaaggagaaaatcattatatggttgacttactggtataagaaaaagaggagtgatggaatgtgtataacaagcaactttaaaattaatatcccagagaagacaacaataatttctaacgactctattttgtattaaactcaaagcttctgaggcttcatctgtttctgttgcatctatggttttatatgtgttccccagaaatgactcatttgttcagaaatgtttatattcatccaattattcacctttttattgatttaatacaccattattgagtttctgctaggtacctggtactatgctaagtgctgaggttataacagcaaataaaccctgcagtgtttttgccctgatgtaattaattacataaacaagtgtctaattatatttgagatgagtgtaataaagaaaaagcattttatgatatgggactgatttatagagaatttgatctagtgtacaggaaagagacaactgccctatgaaagtgacacttaagctgaaacttgcatgtgggcaaactctctagtttgggaaagtcctggtatcttcaaggaattaagagaccaaagagaaggctggatgataaggagtaggaagagagtggcatgacagatcatgcacagcatttcaggccaagttaaatatgttggcctttacccaacagatacccattttgtactgtgcagtgtacaaatggcacataatgtgcacatgatggcatataattggcaccatgaaggacacagaagtgaggaagacatagttggttcattcaggaagcctctggtatcgtggaggagacaagtaaaagatgccttttctctcatgtgatatttctggaagagagggtcgctaagctttcattttattccctgtccttcacacaatagatgacacctactttctgctcagcagtaaataatacatattgattgcatgatttttaataaacacctataatgtgatgataaggccttgcctttccaggtccctgatttctgtgcaagattttgactcttagaactttggccttttagaatctagagagcttgggactcaggctactgcctctgaacctttgtgattaaaccataccaccttagatatggtgggggccccacccattcaggactgagtgagtgctaggccactaaaagtaagctattgtattatatacagggtcttactagcagtgtgggaattgaacacttcggagccaaagtgctcaggatccagtcatgactctgtttctcataagcactgtgatgttttaattttcttatccccagcttctcagcaataaagtggagagaaaagcagaacctacttcacaggattattgtgaagattaaatgtgaaagttcttagtacattcctgatgcatgttaatattaaatactcaaaaatgttacctgcatttaaattattgttttgttaggtaattctcacaattcctgtgagatactagtgtttctaacatttgaccctcaatttttttttctgatcactttcactcttgactatatctggctgccccaggctttttgtgccaataggaggtttactcagttgtattcagtagcacaaaaatcaattcccctaatcccagtaggcatcctgtgcttcaaatggtaggatggggaaattgtgtctctgggcctgaaagcccatctctcaaactgggctgtaaatataaaagctatttaaagccaaatcttggaaacaatttctggacttctttaaaattgtcaccataataacagtgtgccaacttatagcattagaaacaaacagacctttgggctgtaaacaattcctacgtaagtattcttatcaattttcagaaccaaatttatgttggcacagaaagttccggaacaaccattatcatttttcaaggtggagtgagtacgcagggagtcaggattttagacccaaaactttattctcaaataaaattatgtttatgatcaagtcaggcgatatgcaccttaatttttattggctgcgagcagactgcattttatttcttccatgtatttgggataacttttctcttctggtagttttctatattttccaaaggttttataataaatttgtattatttatagaatcagaaaaattatttttccttaaaaaagatgtatatatcattacagggtaatgacgtgtacatgtatctcttctataatcctatttatttttatggtcctatgcacaatgtgttatagaaatttactgatacatgataccttgcatttttctgaaagctaatcttgatgaataccatatgaattttaattgcttgccagggaattcatttagttgtgtatgactgacttagaacattttttggcaaataaccaaggaaaatttgttttatacaaggctcaacattgccctcatttaattttttaaatatatgctttacttttgtagaaaaaaaaaatatatatagcattcatcatataggaatcctgtttttagtaagctcttctgtgatatttttttggctttgccctcaagtttggcctaacattgcttttgaacatagtcatttgctgtaagtcctaaatgtgtattcaagcacatataggtagctgaccctgagaattgtattgtgctctccatgtactctcagaattaacgatcccttgccatactcactgtgatgtgctaatgtatgtgctagtatttttggaaagacatcaatgtcttttgagcttcttcttaagactctaaaatctttgaaaatttaaggtatcctagacagaggtagtgattgctaaacatttgttaagatgaataagagctaagtaagacacattttcagtaacactgaaaagacttttagtaggttaagggtcaataattagatttttattttagcccccatactatctagaaaatattcttaattgtacgctttctagtcttcaaagtagatccagttctcagtgcttacagtagttatcctattgtaagtaaagaaataggattaatatatagctaatgctgtatctactttttttttttttttttgagacaaagtctcaatctgtcacccaggctggagtgcagtagtgcaatctcagcccactacaaactccacctcctgggttggagcaattcttctgcctcagcctccagagtagctgggattacaggcacctgccaccatgcccagctaactttttaaaatatttttagtagagacagggtttcaccatgttgaccatgctggtcttgagctccagaactcaagtgatccacccatcccagcctcccaaagtgctgggattacagacgtgagccactgcacgcagactgctatatcttcttttaatttaatgttttataatttttttgctagtactgtgcagtagttttctttcttaaccaataatatttttagtataaataaggatctaaggagctatgtaaaatttctgaacttgaactgatttgtgttatttgggactttatttcatggtattaatgctttcttggtgttggtttgtaaatgcactgccaatgatttatcagtgacggcagatagttccaacatgaccagtgctaagagaccatgatcagctcccagttgccacagttagagtggtgtctatcctgtgtaattccgagagggaagggaccatgttgaattggagagattggggaaagggaagctagtgtatatttattttctacactgtctcaggcattgtgacacgattattatatatgggatctcatttaacatgttcaaggtcatctagcaagtatgagaaagagctagaattcaaaatcaaatctatctctccagaagcagatagtcttcttatctatactacttaaattatttaataaacaatgtatttttagatctggaaagcttggtaaagcattgctcatgtagacggatgggtgggaatgggatgttaacaaggggaagcagtaaaaaatattccagtcacagtgacatggtgaaggatagagattagaatgtgtgtttgataaacacgaagtagtttggtttggccagaacaatctttggaagattggtaagagtacagactggaaaggaaggttagcaacatgttgtaaaggacttttcaaatgccaagataaggagtatggacttaattaggaaggcaccagggagctactgagggttttgtgtggaggagcaatatgattatagctgacagcagtcttaataaggcttaataaatagtacagtctataaccttaggccaactgctgagcagaagccaaacgctgtactgcagaattagcaaaccaattactgtgaggggtgatggcctgaatttaatctgagtcatccttcacaatggagtagaaactcctggcaatgtaaacaagtatgtgaagtgacaggtgacatgtctttttggagccgacttcacttatttgactccacagtggcatgctgttaaaatgccttaacagtgccataatttacttttcaccatttaacaaatctctcatccttgtaaatattcagtgtgtttttatggcttttctgcaggcctaaaatctattgccatctgtcttattagttgtaataatgttttgccattttttattggtattaataggctttgccaaaagggaagtcatcattatgttttctgccatttgatttaacagctgattttgactataagacaacattcaaatttagttctagcaactaagataattttttaaaatttagagagtaagctacataaaaacatattagtttcctttaccatttggtaattttaagactgtgtgtgtgtgtgtgtgtgtgtctgtgtgtgtactcacctacatgcatgcaagggcaggagactgagagtgagactgagagagagagagagacagagagacagagagggaattgcttccttctcgggaacagctcctggcaaaccaaaaagttacataattaagttacttataagacacactctttttaatacattttgatggttagttctactcacacttattgcttacatagtcataaatttttgcctctttgtctgcattccaatattattttgaacttatataatttatttattatagtaagccttcttcctttttccttttaactagattgtgtgtctctcaaagacatgtttatgcgtttgatgcatagcatggcatcttggctcatagtatattttcaaatatttattccatggagtttaagtattcctttcttagaactatcatgcttgggcttttgctcattccacaagtcttgagaatatcctaagtattttgccaggtaaacagaacagagtccctctcttagaaagcttacagccaaaggatcagaaaatgacaatgtagtctgtaagtgttattggtgtaggtaaacttgaggttagagaatggctaattagaggaggtgaccttttatctgagttgtaatgcaattaaaaaggaaaagtgtaaagatgagaaaacaggagctatagttataacaacatctacacagtcatgagtgtaagagagaatcatgggatcagatcacggctaattgtgtgactgaggggagtggtgagtaataaatctggtttaacacaaaaaatcagttacaaacagatttctatattgtcattttaaagctacaatttaaaattaattggttgctaaattcttgacaaaggggtcaattgctgtggctatccattggtatttctttgaaaaaataaaaggttgtctggtttaaaaataatattattttatttcattattttagaccttataagcacatttagaatctgtatggaattagagttctaatatatatgtatacatatacataatatataaaaataatagtactttcttttaaaatttgaattttcaatgagataatgcaagcaaagtgaataccatagtgcacagcaaatgtaagaattcaatttgtattattggtatgttttgtggagtgttctgtctgtattcatgggaaagatccagtgaggtatgaagcatatttggcctggtgagaatgcataaatctggccaatgctcccttgaaagctcgtcattctggtctaatattttttaaatatttgccacttggtccaaggcccttcttatttcaccattgcttatctctagattgaaacccaaagtagcagcttttgaaggttttatttcaaaataacttttttgcagcttaatcttttgtggttggtgagatggatggggccttgactcaggaattatcaagttttctcttaacttagaatgttaattaacgtgacaaagaaacaaggttgatgcataagaaggaagaatgagtactataaggagactttaggaatattgcacatcaaatatatttctgtgtgattaataaattttttaatgtattatgtttaacacacatatattgaattgtcaagttcacttctgccttatatcagctgtgtgatctcatctgaaaaatcactataatagtacctatgtcataagatcactagagaattatacaataatttatatgcatatttaacatgatagctggcagatattaaatattctattggtgttagctattggaactccactattatgcaaatgtgacatggttatgaggataaattgtgcaaataacagagaatgtacacttcttaaaactagatttatagatttatcactcagatctgagtaaggtttactatagtgtgttatgtatagtccttattctccagaactaattatttgttacttcagactgtgagtttgaggagattcattcatttcaagtgtgattagaaaatgcctaatagtctaaatttcaaaacatgtccttgaggccaataagatcatttattaaaatttctgtttctataataacataatgcatacactgtctacaaaaactcttacttttcacagaaaaatgtcttaagtttcccaatcagcccaattttgtgatgtaaacaggacccactaggagttccaacttttaccacattcatacagtgttactactatagtgcttttctacccataaagtatgaagtattgttcagtcagggtcccaaccggaaatagatggcactctcaaaactggtaatttgaggagagtttaataaagggattatttgcagaggtttggaccagagtatgggtgactgcaaggaaagtgcagtatcctcaggggactaggagcagcattggtgatggggtgggctttaccacttctaggcctgagtggccaaggacggtgagaagctgagggctttgtggagagggcttgaagtctcagacttctctcagggatgcagtagcctagtcagtatcaagtggtcagctatagtaaagggactcatcttaaatttcaacttttgacaaaagtgacagatcactcaaaaatgtatagaattttattaaaaggaagtagaaaaaagacattaaatcactgaagaggaagttcatttggagctgtgttattgtcaaagaatgaagactgcaaatttgggattttgtaaactttagttttttattttattttgtaaatgggctacttaatatatatataatatatgtctaaagataagctataaaagattcatttgcaagtatactaatatgtttgtctcctctcacctcctttctgtatatttcatggcattgccctgttcattgctgagcaaaaattcaaatgttacaatataaagtgactctgaatcccatcactcagagataaccactgtcaacattttagtgacttttcttctaacaaaatgtctgattttttttaatgatgctaaagctccttcctgttgtttgttggtcatttttttttaagagtgctttaaaatagatctcagtaatgggattcagtaaaatagtatatatccttgctatggaacataatgcagcagccattaaaaatcatgctattagtttatttatttaccgaagaggaattcatgttcacaagacaactgaaaaaaaatgagactgcaaaatagcagctacttagatgggttaatagatagttcagcgccactttgaacctacctccagacctccagatatgtatgcatgtgtgtatgtattctgttcatgtatccacaaagatgactataagaaaagtcaccaaaatgttgacagtggttatctctgagtgatgagattcagagtcattttacatttttgtatcattcaaattctttttagcaatgagcatatgttagttttcagaaaaaagttatttttaattttataaaaatgctcataaccaacgctcataaccattacacatatagcactattatcagaaaaatataataagcaaaatattccactcctatggttttcattgatggcatcactgactccattgaaatgtcaaattttctatttacacacatttgcatgtaatgttttgggaaatagaagcacaggaacactgtgagcaattgagagttgtgactgctgtgagtgctgtgggctagaacatgcatcttaccctgacgaagcatcttccttcctcagaactcacggtgacttaaaaggatgtgctcattctgcctcctaacattctggtgaggcaggtgcgttgcaggctatttcttatcctctatttacttacaaataaagaactttgaagcacagggtggtgtattggtttgttcaaggtcacatgatgagtctgtcagcagatctgcaaagaacatcccagttcctggagtctggatctagtctatagcctgttgttggctcaaaagctaaacaggtgatagatgagctcatcatatagctagaggtatgaggagtggaattgccaaagagcctgtgagacttgttatcctgcatcatgttccattccctttgtggggctgcggacggcctcccaacagggcagttagagcctaccaaagtccccagctctgtgttcctctggattgctggattgttgggagacaggcttttagtttctccctggttctttgtttcttatttgggcagtaactaattggattttcttagtcactggatgtttttctttgccagtccctctgcagtagtattagctgacagttttattttattttatggaattagatataactcgtaactccaaacactatggaaatcaacatgcgaattggactctgcattcaaacttttttcagaaaaggaaacaattcatcctggataaatgcatacacgttattttaacccttttttaaagggttgaaactgagcttttagaaagtcagtagcccagaatatttaacttcttagggcagaaaggaaggaaagcatttttatgtaaagaggaggaaaataacttgtgctcaaaaatacctttaagtataaacatgtatgaattttacagaataatctaaggggaaaggaaaaatatttattataggattatgagagaaatttaacatataagaaactgacactgaagcaaagctgacggttttaaattacttttctttgaaagttatagcatttgttaaattggttatgaattggaggtcatatatctttatttctttgtttgtagaattcatgttctaacatttatttttagttggaagtactgaagaatatatttttcttatgaatttcttttgtataaatttccttatgtatgagaaataaatatattattctttactaatatatttactctactagtagttttatttttaatttcagttccaattttacagttacttagggtttttgtcattaagtaaataagtgatgttttaaaatcgctttaaaacattgctatatgcaatctcttatgaaatcacaaactcccaaatctgtatactcattaagatagttttgtctgctggcatttcttgataaaatatttggtattaaatatataatatataatacctaaaatagcttaaagcattaagaagatatcacatcataattagtacaaccagttaaggtattaatattttaggaatgttctcaagtcaaagagaccatgctctgacaatgcattaaaatattgtgtgtgtgtgtgtgtgtgtgtgtgtgttagttactagcctttttttcagtttaccctaatttaatgctaataattgttaaagatatttaaagtctcagacaattcagaatgtaaaatctagctggtctttatttaatttctggatagatgacctacaatgaagacccacactataagggaaactgctactagagaagaaaattaacaaatgtaagcagagtcaagatcggctgtctctgagtgtttttgaggctgtaccccatcaataaaacctgtccttccaatatgtatgcatgtatttattaatgaattatatatgaactactgcaataacatactatgtacatagtaaaacatagttccaaaatagaattattaagataagcagaaattttaacatatttaataccactgccaaatagatgatttcttagaatacttggatttgtgtcccccggcccctacaacccacacacattctatagaacactagtaaagaatgctgctcttctctagacctcttgacataattctgagctgcataattggaagttaaaattggaagattaaaaattgtttgctaattgacaagtgtatcagttatcttattgccaaaatagtagaatgcatcaaactgccctagaacttaatagtttaaaaaaataagcatttataattcttcacatgtctataggttggctgccggttttctgggcccattgtaagcctgtggttagctgcagggtggagaggcagttttgctagtcttggctgggttctctcacatggctagctgtggactggtcacatggttctcacatgcccaactcaggattgcttcagttgagacaactggtctcccttccatatgcttctcacatacttgtctatcacattcctttagaagtctaggctggttatgttctcatggtgatctcaaagaggcaagactggaaacatgaagaaataaatgaataaataaacatgaagaaagaaactatatcaaatttgcttctatccattggccaaagcaagttatgtgatggagctcagcagtagactgggagaggccatgaattgtagtcattaatgccatcaatctacagcaataagaaaatctcttttccttaaatatacgcaagttgataatttctatatagctataagagtggctagtgctaattataccccagtgttctgattatttggctgtttggggtaattctctagccatagaggctagagaagttgcatctttgtaattcagttcattggaagtttaagttaaaatttaaaattgaatttttaagggggttcattatcactggcttgggtagtctgggctctaaggaagaagaagggaagaattgtgactatcataattatgcatccatttgttccacatgtggatagagcttactagttctacataggacatcgcagtggagaaaggaagtctcctttcggagcactggctgaaaattaaggaggaaacgtgctaaaattctgtaagtcagctaaagaattgataagctccactacaaagatacaaagtctgtgtcctgtagtatatattacacacatttattatttaaaagacatgtgatcccaatgggaaataagagcacctctcttcaaacgtgaaaaaaagttaattctgaatgataactttgtatctatttttgagataatataaatgtcctagattccgtgctgtgtcttagaaaaagacaataaatatttgcttattattcattatactaaataatatttgcttatttaaagcactataaaatagtaaaaaaagactaatagtaataatatcttcactttaatcacatttaataattttccatttgtttttcacttgtatcatttcacatgaagagccgtatgacttctcagagttcatacggacccttatagaaataactaccatttttagagcactcattttatgctcacaactctataaggcaggtattttaattaccccatatttgcagattcaaaaaagaagggctttaaaggtagactgcctaaggtcacagtcagttgtagagtcagaacttgaaatcttctctttgacatgaaagccaatgctcttcaccattacatttcactgcacttaatggatattaatattatagagaacttttaagaggtaaatggtctgaatagtgcctactaaagatatggtcaaaatggtctttgggattggccaggagagacaatcccctggctggccagcgtaaatatccagcattctcaaacattctagatacaataacattagttctcaagctgacccagcccactggaccacagccttggctctgactgtgttttcaactaagtcaccttctcattgtgatttgctcccataatgaatacacagactggcctcaggggagttttattacttatcataattgattaaattagcatctagttaagtaaatattaacagagaaaaacatttcaaaaaagactacaactcttatcactgtaagctcagtctttcaaaactatatagattatctccaaagtgcacacgatggataccctcagatgaaatatttgttcgaaaatgcagtcgtcaactatccttttgaccatcctactttatcagtgcagcagtcccaggtgttcactcttggaactgtcattcaaactaaatgactggggttcatttaaggagcgatttctgtatttctggaattatagctaggttatactctagaagcaatttgaaaaaaataaatgggctaaattctgacaggtaaattagctaatccaaagatggttctaaacagagtttattctctcagcctctgttctgctaattagtgtgccagaacagttgtttactcagtggatttgtgccattatttaaacttttgctaaggcaaaactagatcttaaaagtagagaaaaaattggcttggttttgatttgtgcacgtgggcagtatttaaaccactggagatgaagacaaaatgaaaaaccatacatctcttaagagttagctctcctttttctgagtaatgaatcttatcctccttcaggagcctctgctgagagaaatataatcccatcatatcactttagctaaaatatagggaaaatgtaaaatctcaaccttcttccaagcagtcttttaaatagaataatcatttctttcctaactagtcttgattttttgtttgtttttgtttttttgagacagagtctcgctgtgtggcctaggctggaatgcagtggcatgatctcagctgactgcaacctctgcctcccgagttcacgtgattcttctgccttagcctcccaagtagctgggactacagacgtttgccaccacactcagctaattttttgtatttttagtagaaatggggtttcactattttggccaggctggtctcaaactcctgaccttaagtgatccacccccctcagcctcccaaactgccgggattacaaacatgagccaccacacccagtctgattctttacagaaaaacttagaaaatacatgtaaataaaagggaaaatatcagaattatctgtaacttagtaatccaagtaaacttttaacattttatatgtattttcttaagatttttctgtaaattcaaatgggttcagattatcatctactttttcctactaaaatatatagtatggtaatttcccctgtcatgaaatattcttcaataatattatttttaatggctgcctagtaagtgggagcaaaacttccattatagattctattatgtatttaaccagtcattttggtcatacttagattgtttctaatttttcacttttagaagagcactacaatgaccatacatctgacaaaattttccaacatctaaaattatttcctcagtgtgaattcataatagtagaaattatggaccatggggtatgtaaaattataaatctccagtgaattttgtcaatttgtcctcttgcaaggtcttatctccactagcaaatttatgagattctactttccttggactctatttttgattactataatttatttttttaatttgaggagttaaaaaatggtgttatttttatttctatttattttcttattagtgaggataaatgcttttcttatgcatttttgtattcacatttcttccttttgatttgacatattttttaaaactctcctcaagattgagttatttagcgtattttgaactattgctttcatcattaatcaaaaaaataaattgaagactaatttgggattaagctatgaaagctgagtactaaatttcactctaatttgtagatatttagcagggttttttgtttggtttggttttttttttttttttttttttttttgagacaggatctcactcccatcgcccaggtaggaaggtaagagtgcagtggcatggtgaccatggctcattgcagcctaaacctcctgggctcaagggatcctcctgcctcttttttcttttcttttctttttttatagagctgaggtctcactatgttgcccaagctggtctggaacttctgggctcaagctgttctccctccttagcctcccaatgtgctgggattataagcatgggccaatgtgcccagtggtaaaactaaaaattaaacagattatttagtttttaatattaccttttatttcatacagtcttatagagaatataatttctctctgagaatgtattttgtgaaagtacaagatttgccaataagtgaagacgataaaaataatcagcaaagaaaagaaccagggatcagtaagtccgcatcattattggtcttgtttctttcaacgtctgggatggtaaaagggacacaccatctgcagtaccatggttatgtggaccatttctgtctctgaaatgttttgttttccagagtgagtttttttatcttggaattcttagcttccactctttaaaaactgtgccaaagactgggaaggaaaggaaagcaaatagagacacctctacagaagtgagttcttggtatcatcactgcacctaatgcaggaggtggagttgacgcaggtctttttattcattcattcaataaacatggggtaggttattggattgggtatgtggattgttactttaggaggctagggaaggttgtctccgatgagagaggaaagagcaagtgcaaacttcttgcagaggaggtatgtaaggaacagcaagggagctgcaacagagtgaatgaaggggagagccataggagctgaagtcagagacaaagtcaagggctggaccacaaaaggcctgagagacagacagttttccctgacttacagtggaggggctgtgggaccagatgcctgggactcctgcttactgtctatgtgaccatctctatacctcagctgctccctcatatgggataataatatttccccctctgacctattatgagaataaaatgtgttgatctgaggtacttagaacaggacctggcaccgtaagacttaatagttttttgttattgttattttaaaaattgatacctgcctctaaaggcctctaatttctggcatatccactctactttgcctctttttgatgccttgttacatttgttttttttttaaacaattgattgaaagatcataaccgaatctatagtacttatgtcttgaaaaacatttgtatttataatagctgttttctgttcttcaggaagtagagttataagtgatggagaaaagcttcagtgtggtcttagatttcttctggaatgaaagtgatatttttccattgggtcattgagtaatttctgacttcattctgtaggaatatgatcaatttaaaagtatatagtgattaagagtgaagaccctagatacaggttgtgtgggtttgaatttgagcttcacttagttgtgtgacctagggcaagtttttaaaactctttgtgcctcagtctctttataaaattaatatgatgatagtacctatctcacagtacaattttaggattaaatgaaagtgtatggtgtatgaacattatttgctaggctgcctgactagtagtaaacattcaataaatattggatactattattataatcagcgatttgtgacttagaagtatataagtgaactaaaattagaatcactgcatcaggaaatttgttagaaatatttttgaaattatcatttccttctcttctgctgttgctaagttaaaaatggtaagaaatggactcatcagatatttcctcccattgattttaattctgcttcatggctgcgcgttttgtatactgattcatgactgtattcactgaagcccaatcaaagactgcagggcaaagcttcttagaagacttcaaacaaccaggcttgcagttgtgaatgatatgggtctcagactcatctctcctcatgaatttatttatttatttatttattttgagatggagtcttgctctgtcgcccaggctggagtgcagtggcctgatctcggctcactgcaagcctcccaggttcatgtcattctcctgcctcagcctccctagtagctgggactacaggtgaccaccaccacgtccggcaaatttttttgtatttttagtagagacagggtttcatcatgttagccaggatggtctcgatctcctgacctcgtgatctgcccgcctcagcctcccaaagggctgggattacaggcatgaattgatttttaagagaataaaagagactgatagattctccaaagggctgagaaccaccactaggggcgtcactgtacattgtcgtcactgtatattgtcatcagttgctttaacttggcagctgctgttattgtgacatgattgtggctgttttccctctcttcctgaaatattagcataggaatattaattttcttaagtcttccattatctctatgaaaaatacttgattacttggggctatgtgaagactatgttctgacaggctaatctaatcctctaagaaagtgtgagaaatgtcttagatgaaaggctagtgataaatcaatatgtgatatctcaatgtagaataaacagtcggacacctgggggcacatggtcttagttgggggacagaggctgacatgtttctgcctttagcttagtgatgaaaatattagcatctgtagcattcataattatggatgcaaattaacaaaattttctccagtgctgtttaaatagaaatttctatgataatggaaatattctatacttgtgctgcctaataccgaggaacaaattattttattttattttaattatttaaaatttagttgctgtgggtggctggtggctaccctattggaagcatagttataagcaatggcttacatgagtactaggtttattttcctcacataagaagaaatctagaactgggaagcacagggataccatgggtgcctaaggatgttgtaaggaaatgagctccttccatgttcttcctcagcatccctgcctgacatttgactttcatcctcacggtcacaagatggctgtgccctggtgcatctcatctgtattttctacaggaagaaggggattgggtaaaaggtagacattttcagaaggctcttctgtgttttttccaaaaagacttttaccaacctctcattgacctagacttgttacatggccatccctgcctgcaagggaggctgggagtttaagtatttccctcagcaacttctgttgtagataaagcaaaaggaggaagaggttggaatggatatggaggccactggtctacagtttttaccatagcagacatttggctctttgtcctgtggaattccacaatcatgccacactcatgggcctggagctgccaatgtcttttttttttttttttaaacatctagttgacaaactgtaaatgacactagacttgggcttgaagactgtttagcacatagaatataggattagaactttgatatattggagtgatgatgagtattgcatttgaggaaaactgtctaatgactggatagtgtaaatggattttgaagtattaaaaacaacttagcacgtaccgaggaaataaagatataagagttagaaattgaaaaccaaaatctcaacatcagtaagcatctcattgttacagtatatacgagactcatggcctgatggaacaccagcccatgggtcaccctgggaacccccacaccaatgcttatcctctcaaccacaaacacagatttaaaacttccctttacagaacaggaaactgaagcttggagtcattacgctacttatctaaaacctcaactgctatgtgacagtcaggattcagatccgaagttggcggaggcagggaagccacggctttattgtcctgggctcgcgttctgcctcttcccctctctatgtgatctttctatgaccacatctgctcacgcttgttccccagcttgaaattcgttctcagtggctgctctgagttggccccccaatctgactctctgccctctagcctgcaatgagggagtggaggatgccggcccaagactatcatatgctcctccagagttaacagtttcttctaattgtctttagatcccagaacagcatctgacacacttaagaaatgcttactttaggccgggcatagtggctcacgtctgtaatcccagcactatgggaggctgaggtggttggatcacctgaggtcaggagttcaagaccagcttggctaatatagcgaaaacctgtctctactaaaattacaaaaattagccaggcatggtagtgtgtgcctgtaatcccagctacttgaggagcctgaggcaggagaatcacttgaacctggagatggaggttgcagtgagccgagatctcgccactgcactccagcctgggcgacagagcaagactctgtctcaaaaaaaaaaaaaaaaatgcttactttatcagataatgtgtgatatagatataagaattctcccagttttggaggggtattagaaaaatatacaaatgttattttttttttcctctttccaccagggatggttggtttgtttccagactgattttgcgtttctcagtttttctaagaaaatatgattgtaaaatttaggtcaaatttatgaatatcttccaatattttattcagtatatttaaaacttatacatgctcagtgtaaatatttttcagtaatctctgtaataatttctctttgaattgacagttatacaggctgatgttcccttaacatggaaactaagaatagaaggatttctgtagcctgtgtgtgtgtgtgtctgtgtgttgtgtgtagaactgtagtgctttcatttatataacaggttggtatctttatttctctttaagtcttttttgtaaagtcataatcccttgcaaaatgaatgtattttttaatcatccaaaggcccattacaaaaaattgaaaggaactttatgtgttatgtaaaccaatgggccaacttttagataatcttaaaagggaaatgatggaatggaattagctagcatttaaaaactacaattgtatagcacagatggaatgaatgttatgtttatcctgtgctttcttcaaatgtagattatactctttacctatctgatttcatttcagagctaagagaaagaatatttattaatatgttcaaaatgagctggttttaacagctgcctcaggaagaaaagttcattgattttataatcctgagaataaagacttcattacctaacactctcctaaacacctgctgggtgtaaaatgatgccctacctctattgaaatgaagcttctgcttattttgtagaaggtataaaactttgaaaactaagacagatccatagagtttgggatattttagaaccagtacttcagtttatcttcctatcatggtcttccagttgctggagaaaataatagagccttcttatgaatactaaactctctagtaccagtggatttcaaggatttcctggcccttcctcatctcaggggaaaataattttgcagtctgcttgctagttcctggtcagactgacaggacaaacccattttagtctatcttatggactacagtaatgcaactctgaatagttaagtgatttgctgtagtaaagtaaattatttgctactcctctcattgagatgtaaggtctaactcttcttcccttcccttgaatttgggctggcttagtgatgtgtttgactaaaagtatttgggagaattgatgctctaagacttttgaggctggatcataagaagcctttcagtttctacacacaacccaggggacacttgctgttggagccctgagctgacatagaagtccaactatcctgaggccaccgtcctgtaagatatgctgaagatatgctaagccagtgtataggggttgtagcccatagacttctgagccatcccagatgataacatgcaacagagatgaattgtccccactcatgtgagtctaaattgctgacctaaaaattcatgagatttaatgatgataatgatgatggtgatgatgatgatgaagatagtaataatgataaactgttgttttaaactggtgtggataactggaacacctgcaaaactgtaactcagagcttttgactctagtgcctgtgctcagtttcctccctgtaactgtcagctgcccatgtacctgtgatattgtattaaacttatgatttataggaattacaggaataaaacgaatgagttatatttctctcataagaaaacaaagctagaacgaatttaaaataactctgccatcatgcttcatttttcttcatatctcctaaccaaaatggcattatgttacgtatctattcgttcgtctgtcttctttctctcccaggatataaactctatgaggactttattttgctctttgcagctttaacagcacctatactagcatctggcatgattaggcactcacagtgtatttgttgaataaatgaatgaattaatgaaagatgattctcagagaaaataaagcataaatatcactgtatctgtttagagtattattcttctgggaaaatgtgaaaaccagaatattacaaaggtaataaagcaaacatttgataacctaaaaccccaatgtagcaaatgttaagatgatacatgttcacatcatagtttttgtcttaaagaaataaaatattagagttggaggttgaatttgtgtatatttttctatttccctcttcattgtcctaaagtcaacactgttatatatttgacttgtatattcttatgcttttactacatataattttatctacaaataatatatctacttggctctgccttcaaaatataatatatttccaatccattttcacctgcccttgctacttccctagtgcatccccgatcttttctcagaattactacatcttcctaaccgttctctgcttactctctcacagcatcagtgcaacactactccatcttttcttcacccagcagccagattgatccttcaaaaacaaacattggatcacgtatcctcccctctcctcactcttccatggtctccatcatacctgaaatacaacaccaatccttgccatgttcaaggccctgtttcatccaatgctgcagtgccagccctcctgttcctgccgtgctccaggcactcctggtgcactggcctctttgctgtttagagagcacaccgagcacatttcctcctctgggcctttgcgtttgctcgttctttcccttagcttatcctcccaccgtcttgtctcacgtgagttgcttacaacctgcatttgttttttgttcaaaagtcacctcccaatgaggatgggcagtaccaactgattaatagttgaactcccttcatgaacccataccaaggttttttttttctgcaaaacttactgctacctggtagaatttgcttatgtttgtatgtatgcatgcatgtaggatgcatttatctgttttctgtctattccctcgttagattataaactttgtaaggtcagggaccttctattattctattgttttggggcctagaacaataactgacataaagtaggtgcccccaaagtatgtgttgaatgaaaaaatatgggaatctagtgttttgcttttaaaactgtacataaagtttatcatactggatgcatcttgtggcaatttgcttttctcatgtcaaagtatgtccatattgagattgatctataactgcccaatgggttttccttgcctgctgcctagacagaactgatttatgaagacacgagaattgcaatggataaagagtaattcactcagagctggctgtgcgcgagaccggagttttattattgctcaaatcagtttccccatttggggatcagagtttttaaacataatttggtagataggggcttgggaagtggggagtgctgattggtcaggttggagattgaatcatagggggccaaagttaggttttcataatgtcttctgttcctgggtgtgatggcagaactgattgggccagattatcaatctgagtggtgtcagctgattcatccagttcagggtcagcaaaacatctcaagcagtgatcttaggttttacattagtgatgttacccccaggagcaatttggggaggttcggactcttggagccagaggctgcatgactcctaaattgtgatttcaaatcttgtcgctaatttgttagtcctgcaaaggcagattggaccccaggcaagaagtgggtctttttggaaaagggctgttatcaattttgtttcagagtcaaaccatgaactgaattccttcccaaacttagttccgtctatgcccaggaatgaataaggacagcttaagggttagaagcaaggtagagtcaattaggtctgatttctttcactgttataatgttctccgttacaattttgcaaaggcggattcagattgagctctttatctgtatatctaatctatctagtccagttattttaactgtggctcattatcccacacagtttattgatccatttcactattgctagattgtagttacttacagtttttcacttttctaagcaatgctgaaaggaacattcgtttaaagatagttaccttctttgttttttccttgtagatgtataacagaataagaatttggtttctttcacttaacaattacattcatgataatagtgattgcgtttaaattattttttgctttgatgattggtctaccagcaaatgttcccataaaaatctaaaagtcattttaggaggggaaacataatatcacattttttgaaagaacaagtttgatattatgtttatcctttaaatctcatacttttctgataaaataccctaattatgaatattttctcctaaaaaaaactagaaaataatgttacccatgattaaattatttgttctggtgttatatgcatgcatgtttgtgtgagcatgtatagcagtaagatcatttgaattactgtggccccagtggtaataggcaacactactcttccactaaatcatagagaaacctttcagagagttttgcattttgtttgtcaaagtttaagaaaaagctaattttgtgacagagttgtaagctttattaaactgaacagatgaggagaaagaaatgaaactattgaaaaactcattaagggttgtaattctagagtatagtatggacagtttccaaaagaatagtagcttttatgtgctctgaagaagcatactttatgggtgatgtcatgtgttttgactctgaagctatgaatgtcactaaaacagataagaaaaaaaattacttttccaggggtgataatttttccttgctcatagtcaaattattctgagagacaaagaagctgagttcactttacttaatttgtaatttgtaacagtttagacagaggttaatctaaactttacttctacatttatctgtgctaagaaaaattaaaaatttgctaatgttaaagttgaatggattcagaaaatacaatccattaattcagcaattctgtaattagtgcctactaggaatcagatgctattcctgatgctgggcatacaattatgaataaaatcattgaggtctctacttcctttgagcttactgttagtggaggatagagataataataaacgcgtttcaatgagagagcatcccatggtgagatgaccattgctatgaagcatataacacagggcggcatgactgaaggtgaatgggtaggggtggggaggaactgccttagctgtggtggccaggtgtcacctctaaggaagtaacagtcaagataagagctgaatgagggatcactgtgcagacatccggtgacagactctgcagtacaaggaacagcaaatgaacagtgctgattatgggaacatgtttgctgtgttggaggaagacaaaggtcagcgtggctgaggaagtgagggagggaatggttggtgaggttggcatgacaggaagggggccgtggagacttgataaggagtttcctaaagccgatttcgaagagctctccttggcagcaacaccttacttgccgaccttactgctcttgacagagtctctacttgaacatagaaaatgacagaattacctttgaatccgggcttgtcagtcattcagtcaggtcttctccctaatcaccctcaattgtgaggatctgcgatgctatgaaaggcacgtgcctgttccaataattaccagtacatctgtttaatcacttaaacatttaaagcctgagttattcatatgttcatgtgactttataagcacatcggggacttctgaatatgaatttatgtcccatgtaaagaaccagtacactctctctacatgatgggacggggtgaccatcaaactgtggaaagtgggtacgttttgacgtgaaataagagtgatactatttcactatagttttcctttactatctggtgttccagaacattccttcttcgccaccatagcatgtggccctatcaaagcccctctatcttctcaaggctcagcagtctcaggtatagtaaccattctttgtgtgacatatttcgtcacccttcagtgctctgatcactcactactttattggatgttgttggtcatacaaatatgaccaaaagtgatctaaccaatcaaaagtgggtcagatggatgaagagtaaagtagagctttatattctggatgctacatccattttcactatttaaggtcaccctagcttttttgaaatccacttcacattttttttcctttccaaggagaaatttaaaataatcatctcttttagtctaaaaacaaaaacagatactgtttataagcctttcttcataaaaaaaattagagctagtaattattgaaattgatagtagcaaaagccatagctaccatttcatgtctcctgtttatgtgccatacagtcacctagacccttgcatatgtcatttctggttggcatgaggcttctatcaagtatttattattattctcagtctacatataaaactggaattaagaagttatgtaatctcattcaaattttcacttctggtaattagcatatccaggtttcaaacaagatttgtttggctcaacagcccaaagttgtaatcacctcactctctagccccatttaaaatccaaatagccaccactgtactgtatcccaagagttttatgaatatgagctcaattactcctcaccacagcctaataaaaatgagtgttttgtgcctatgcaaaaaaaaaaaatgaagatgagaagttttcttcaggaccttacaatttcaagtgacagaaaacctaagttttaatggtttaatggttcatataaagtctaggggtgggcctggcttcagtcatgcctaagcctaaaggagataatctccctctcttcatctctttactgtatgtttctctctgtcagctaccttcacacatagccttccctgcagaagtagcagaatagcttccagcagctacaggctcacatcctctctggtcaccctagaagaccagccatgcctctctccctgtagttcctacagtttctggaattgagtgtcattttccttgattggcttgacctgaaatacatgctccccctggggcaggaagatcagctcaatgcaactcaaaccccaaaagaagagaagtggtacattgtaccttccccaaaaagaaaggggggtgactattggctgagcaaaacaaacaaacaaaaaaatctttctatgtgcctccagtgcaatagcagtaagtggcatagtcaggactcagatccagattcataaggctccaaaatactttctcttaccctttatgctgtcttttatctccatataattgtcttttaaaattcattgtgagactgtgaagctcctgtacttccgttaaaaaaattattaaggaagtgatgttcaaaagcatcagcatacttgtggttaatctcttttaaaatagcaagtctatcaatgtacaggtaaatactatttctagaagctagaaactctgaactttaggtaagaaaatataatgatttcgtgtctaatttcatagatatctttgcgttaagtaaaatgtccctcttcatatctccaaaataaaggatatttagcatagaatggaatttttcttaccttataagactgcactattttctgccttttacaccaatgcaactggtctttatcaacaactcacaatctttatttcattatctttgacctctgatttagaggacagtactctccccttgggagaaattaggaagcatataagcagaaagaaatcatgtaaacaatggaaagaggacactattaggaaccaagaaaccaggatcatgatcccaatttgacattggctccctgtgaataagggatggcaaatgggttctaactttctgagatgatctccaacaaccctcttatataatctctttaatggctgttttcatgctgaatgcaatagagtttttcatattagccaataaagcaaaactcattcactcagacaaaatgaattgagaatctatgacaaggtactgtggtagatacagtgaagctgcaagatgcctcctcctaggaatttgttgtcatcccctaaaatgcattgtctaatatgtgtatgacactgtgctagaagctgggactgtagagatgtaaagaaaactactgggggcttatacactagctggagagatgtaagcaaaaagaaagataaacacaacaaggcagcatatttgatgtgtgatgtgccatgtgaacaggacaaacacccactttagaaattcagcttctaatgaccagtgcagatctttagggactgttcacacgtacattgtaatatgtgtggatctctttgtgtccatgggtatcagcatagaggtaaatgtaggagatcaaggtagggacacaaggactagattgtcaaccaattatattcaaatccagagtcatctaaataaagaaagagattgggaagcccaccacaaaccagagaaatggttatatctacctatgttaaaatgcaaaacaggagtcactagtttgtattgacatatgctgtaaatgaaaaacacaccctgaatttcccagatttaatatgaaaaaaatgcaaaatatctcaatcatttctatactgactacatgttgaaatgatactattttggatatactgaactaaataaaacataattaaagttacttattttttaatgtggcttccagaacatttaaaattacatatatggcttatatgatatggctattggatggcactgggtttcctgctttggaactgtgcaaatcatttaactgctctgatattcatttttatcatctgtaaaatggggatgaaagtagtgctgttctcacagatttgttcttagtgttaaatcaaataatacttaataagtacttaccagtgcccagcttacagttaggattcaataaatgagagcagtatgttcatgatacagacataacatgttggtgcaggacgatatagcttgtccaataagtgtggaattagattagcactactccgcttcccataatttactagccttatgaccttgggccagttacttaacctctaagtacctcagcccccacctgcatatgaattgggtttattaagagatgcatccccattgctgttcttgggataattaaatgagataatccatgaaaggtgcttagaaccttcctggagcaaaatgatggaaaattatatttgtattgttgttactgcaattgttcatattcagaagatatttgcttctttaaaaattgtatttctatttgtgtttgttactgctatggaccgaatttctgcgtctctttaaaattcatgtgttgaaaccttaatcccaaatgaaatgacatttggagttgggggcctttgagaggcaataaggattagattagatcaagagagtaaagccccggtgatgggattaagtgcccttataaggagttgaagagaccagagctttctcgctaccatgtgaggacatagcaagaaggtatctctctggaaaccaggaagagagccctcgccaaaaacctgaccacactgttacactctgatcccagatttctagcctccagaactgtgagaaaaaaaaagtttgttttttaacacagccagtctatcgtagtttgttagagcagcccaaaataaaacagttgttttagtttaaaatttttaaaatttagttcaatttgtgtttttcctgatatttgctttcctttttttctgatattttgttttaaattcagaaattctaaaccactgtgtgttatgaattcccatgtagctaaaggcatgtgctggcttttaaaagtcactgcccaccccacctcaatcaccttcttatttgacatacaaacattgtggattttatcttgccctgctacctgctaggagatcgagcagagcatttgttttcttactactgaatccttaatacttagcaacatgccaccaagtattcaccaaagggttcaataaattcattgaatgaatgagaaacccgatataaatacttacttgaagaataataatgaaatcaagttttaatatagttctaattaggttctgcatttaaagctcttatgtgaataaaatccttgagaatttgtgaattttttaaatcattgactagattctggatagctgaagttaatggataagtgaggttttactgtggctgatattcggaggcatgaagaaaatttcactgaattgaccttttatttcatcttcaactaaatggaaaaaagtctgctccatattatagagagaactgagagtggtgctcctcagcggtgggactgcgttggtaattttcaaggtggacagcagttttagaaactctaggatgttatatagataattgtagtcttataatttattgatttattcccacacccacaccctaccccaaaaagctatggtctaataggctctgctttgaagaaaagagtgcaatattttctggacagttgtgctcagtgctgccatatggacgactgcacaatttgtcctcaatcctcatgtcacaggacaatcggctcaatctctaatgaaaatgtgatgttttttctatatatactgaaaagtactgctgatttcagtagtagagaaattatatggtatattattacatggtaaactatttggtatgtagttaaagaataaagaaaagatacttccattcctttctagttctgggtgatagaataatttccaactcatcaaaatttcattgttaaaccttactatagccctaggcatgcatctaaaacatatcaagccactgttgaatagattactagccacagtttccactctcattttttcttttcaggaaggcataggatttggtttgtaattattatatccttagatacagaaaattaaaaaataatatttaagagattattcagcagttgggatttttaagtaataatttagctttagtctttgaaaacatactgaaatataaaacatcaccaaattaaaattaaaataccagtatagcatgttaacctagatgataggagtgttttatcaccaatgtgtattcctaggttaaatgtataaaaataattggtacttccccattcgtaccatattcccagtattagtattagccattgcttaatttttaatagctgagcttggatttataaacttctgtttaaaattttcattgttttttaaaaagatagtatcatctgctaggatttttatggttttgtgttttacatttaagtctttaatccatcttgggttaatttttgtgtaaggtgaaggaaggggtccagtttcagttttctgcatatggctagccagttttcccagcactgttcactgaatagatcctttccccattgcttgtttttgtcaggtttgtcgaagatcagatggttgtagatgtatggtattattatttctgaggtctctgttcaggtccattggtctatatgtgtgttatggtaccagtaccatgctattttggttactgtagccttgtagtatagtttgaagtcaggtggcatgatgcctccagctttgctctttttgcttaggattttcttggctatatggggttctttgattccatgtgaaatttaaaatagttttttctaattctgtgaagaacgtcaatggtagtttgatgggaatagtattgaatctctaaattactttgggcagtatggccattttcacgacattgatttttcctatccatgaggatggagtgtttttccatttgtttgtgtcctctcttacttccttgagaactggtttgtagttctccttgaagaggtccttcacatcccttgctagctgtattcctaggtattttattctctttgcagtgattgtgaatgggagttcattcatgatttggctctctgcctgccaattgttggtgtaaaggaatgcttgtgattttcacacattgattttgtatcctgagactttgctgaagttgcttatcagttcaagaagtctttggggtgagatgatggggttttcaaaatataaagacatgtcgtctgcaaacagtaacaacttgacttcctctcttcctatttgaatagcctttatttctttctcttgcctgattgccctggccaaaacttccaatactatgttgaataggagtggtgagagagggcatccctgtgtactggttttcaaagggaatgcttccagctgttgcccattcaatatgatattggctgtgtgtttgtcatcagtagctcttattattttgagatatgtgccataaatacctagtttcttgagagtttttaccatgaagtggtgttgaattttatcgaagcctttttctgcatctattgagataatcatgtgattttgtctttggttctgtttatgtgatggattacgtttattgatttgcatatgttgaaccagccttgcatcctagggatgaagccaagacttgatcatggtgggtaagttttttgatgtgctgctggattcagtttgccagtattttattgataattttcgcatcgatattcatcagggataatggcctgaagttttctttttttcttgtgtctcttcccggttttggtgtcaggacggtactggcttcatgaaatgagttaggggagagtccctccttttcgattgtttggaatagtttcagaaggaatggtaccagctcctctttgtacctctgatagaattcagctgtgaatccgtctggtcctgggcttttttttcgttggtaggctattaattactacctcaatttcatagcttattactgatctattcagggattcgacttcttcctggtttagtcttgatagggtgtatgcgtccaggaatttatccatttcttctagattttctagtttatttgcatagaagtgtttatagtattctctgatggtaatttgtatttctgtggggtcagtggtgatatccccgttatcattttttattgtgtctatttgattcttctcatcttccctcttagtctagctatcggtctatctattttgttaattttttcaaagaaacacctcctgcattaagattttttggagggtttttcatgtctctatcttcttcttttctgatcttagttatttcttgtcttctgctagcttttggattagtttgcttttgcctctctagctcttttatttgtgactttagggtgttgatctgagatcattttagctttctgatgtgggcatttggtgctataaatctccctcttaacagtgctttatctgtgtcccagagattctggtacgttgtatctttgttctcattggtttcaaagaacttcatttctgccttaatttcgttatttacttaggagtcattcaggaacacgttgttcaatttccatgaaattttgtggttttgagtgagtttcttaatcctgagttctaatttcatggcactgttgtactgagagactgtttattataatttcaggtttttttttgcattttgctgaggatcattttacttccaactataaggttgattttagaataagtgccatgtggtgctgagaacaatgtatactctgttgatttggggtagagagttctgtagatgtctactaagtctacttgatccagagctgaattcaagttctgaatatccttgttaattttctgtctcgttgatctgactgatactgacagtggggcattaaagactcctactattattgtgtgggagtctaagtctctttataggtctctaagaacttgttttataaatctgggtgttcctgtactgggtgcatataatttagtataattagcttttcttgttgaattgttccctttaccatgttataatgcccttctttgtcttttttgatctttgttggtttaaagtctgttttataagagactaggattgcaacccctgcttatttctttgctttccaaggcaattccattcaggacataggcatgggcaaagacttcatgacaaaaatgccaaaagcaattgcaacaaaagccaaaattgacaaatggggtctcattaagctaaagagcttctgctcagcaaaagaaactatcatcagagttcacaggcaacctacagaatgggagaaaatttttgaaatctagccatctgacaaaggtctgatatccaaaatttaaaaggaacttaaacatatttacaagaaaaaaacaaacaactccatcaaaactggataaagaatatgaacagacacactcaaaagaagacatttacatggtcaacaaacgtatgaaaaaaagctcaatatgactgatcatcagagaaatgcaaatcaaaaccacgatgagataccatctcatgccagtcagaattgattattaaaaatctagaaacaatagattctaatgaggctgtggagaaataggaatgcttttacactgttggtgagaatgtaaattagttcaaccattgtggaagacagtatggcaattcctcaaggatctagaaccagaaataacatttgttccagcaatcccattactgggtatatacccaaaggaatataaatcattcttctataaagattcatgcacacatgtttattgcagcactatttacaatatcaaagacatggaaccaacccaaatgtccatcaatgatagactggataaagaaaatgtggtacatatacaccatggaatactatgcagccatgaaaaggaatgagatcatgtcctttgcagggacatggatgaagctggaagccatcatcctcagcaaactaacacaggaacagcgaaccaaacaccgcatgttctcattcataagtgggagttaaacaatgagaacacaaggacacagggagggtaacaacacccaccagggattgttgggggtggggggtgaggggcaggaacttagaggacggatcaataggtgcagcaaaccaccatggcacacgtatacctatgtaacaaacctgcacgttctgcacatgtatcccattttttaaagaagatatattaaaaaggatagtatcatctgaaaaatttagttacaaaattcttgtagaaaatgtatatgtacacacacacataccccccatatatatatacaccacacagatattagcattatgataatttaatataaatcacagtatttaagaacaaatatgaatagtttagatatgaccctgggcaataggcattaggaattcaaggagagttcttcttctagtgtttctaaatcctttgtctaatgagtctaccaacagagccatttatttacagggaattaaatggaaactgctaaagcactcctgataatctccacctgctgtcctattattaaagagccttggagtacagtgaagtagacaaacacactcatcttacgtattttatttctagtataacctcatggactagtgatacgtttgcagtcatttaagaggctttatgtagcatgaaataccaaagaagagtgaaatctgaatcattataaaacaaaccacaatacagaggtgaaaagtaccatgagtcttagcagctttattgtaagagtccattcaaacattagcattttcacagtgccaggtgaatccatctgcaggatactgaagtatactgtctggtgcctgcagtttgagaactgctcattattaactgggtcatgattcaggacagcaccccagatgcaccacttccagcttgtgctaaaagacgactagcctcattaccatgcctgtctcctatgcacgctctcacttacttaccaagtcatcatttttaccatcatttccaaccatgtccatcatctgttgcctattttagaccttatttactttttaagtatactctagatgtccacttaatcagattctatgtgaatgtaaatgttaggggcagaaatgaaaggacattcatactaattaattcgcagcttagcactattcgtactgcgaggctttagaaagaatttctaggcatggcaaatcatatcttcctactcctcttcaagtgcaagaaaaatgcagctcctcctggagaacagtggcaaaaatgaaatgtttgtggagccaggctatgtcctttcttaaaaacaagttgactttaatttcgcctgggttggacatgctgattaacagaaacagtaacaagaccagggccttacaatgtttttcagaccctactatctgcagagggaagcaagaagaaccctttcttactaggctatcaaatagagattggctttgtgaaagttttcttttccagtccaggcagatgaatgagagtgaaaaatatgagggtgatgagaagtggtttgtctccccaaccctgataccctctagaaatctgcaaggtggacacttgtgttcaaatgtggttcattaacaaataaacttgtagtctaagaacattgctgtaactcacttctacttttctttacaagttaaggtgtggaaataccctggggctatcctgtttcattacttctctgaatccacagggaacttctccacttagaaatcaaatttttgaggccgggtgccgtggctcacgcctgtaatcccagcactttgggaggctgaggcgagcagatcacaaggtcaggagtccgagaccagcctgaccaacatggtgaaaccctttctctactaaaaatgcaaaaattagccaggcgtggtggtgtgtgcctataatcccaacttctcaggaggctgaggcaagaaaattgcttgaacctgggaggcggaggttgcagcaagctgagatagcatcactgcactccaggctgggcaacagagcaagactccatctcaaaaaaaaaaaaactaaaaaatcaaatttttggccagccacagtgactcatgcctgctattacagctctttggaaggttgaggtgggaggattgcttagggccaggagttcaagaccagcctgggcaacatagcaggacttcatctttactgaaaaatacaaaaagtagccaggcatggtggtatgtgtctgtactctcagctactctggaggctgaaacaggaagatcacttgagaggctgagtctgcagtgagccaagatggtgccactgaactccaatcttggcaacagagcaaggccttgtctcaaaaaccaaaccaaaacagaaaaaacaaagaaaggaaactgaatttttgtgatgacctctggtggaagaaaacttaataagcttttatcccaccttcaacatattccttaaaagacacatagttcattctttctggtagttctatttgttataatgttgtgtaatttatagctgaagaccatgtttacaaattttgtgtatcatcatacatatctcttatttctaaaataaattaaaagtcaaacgttactttgagggcatctcaaatttttgaggctaatcagtttggtaacttttggtaactgaggctaatctctattagaatgcttcacaagaaatcattaatctactttatctgatttttcttttaatataaagggaaaatggtctgatgatataaaaagatctgaaagcaatgtatgaaggggagggaagtatggtaaagtgctgaagaagtcagtgtctgggttcttacaggacaaaattcaaatctcatctctgccacttactagttatgtaaccgtgggcaagttcctcaaccttggtaattttctattgtttattctgatcgatggaaatacgaatagcacctcccttagagtccactgtgagattaacgaagtcatgcatttaaatcacttaccataatgcctagcacattgtaagaacacaatgaattacagtgatagcaatgtcaatatcaatatacttgtgttccttggttaaaagtctgataatgggcactatctctaaatcgcttctgtgttttccttgtagcatacaaagaaaaatacacttccagaagatctttctcacatacatatctgaagagtcatcgtatttaataacctccttcgttgtacacaccgaacggcatattctttgggtgataacagcttgctgtgtgggatttgggtctctttttgccttagatgttggtctgatactagccccaccccccaacagccgggctcctggcggaggtagtgggtggagctaacgagacatctagtacggggctcacaggtaacagaactctgatcagatccgccccggctcccacacagctataaggttgcctgcctgcctgcacagaaatgacgaaggacaaaaacagcccagggtaggtgggatctatcagcctccatctgttgttacttcctgtgttatgaagaaaacgtttcctagttccattataaaatagctctctgatttctgtgcaagtgagaaatcaaatctttgtgtttatgggaccaaacagatggatttctgttgccatttggttcctggcgaagtgggaccgtgaacaaggcagactgccgaaaacataggtactaaagaaagggaaaacccttctgatatgtttgctgtgcagtattcattgcatacgatccctttcaaagtcatagttcttcgtatttttaaatgctgtttttcctaatttcagctcggcaccacctatcgtttatgaacacagttttattgtttggtgtaagcggttttaaatggcttagagagataatcataatttgtattctcaattaaaatatattaagcacatatatttcagtatgttgtattcagcttaaatatattatttaaaataatctaaaattacttgaaaaaaacaaaatcatgaaaaatgttgtctatattattctgtgaataatagtttcaaccacttaatattttaaactaataatagcataggtctagcaacaaaaaataattattggaaattcttactttcagttgttaccggcatagacctcattacaggaataggcctcattgcccttggtagatgaccaggtgctcttttagaaaatcagttaaaacaaaagtgcagaaatctaccacccccagaagcaaactacctttactcatgaattctcattattcctgactgtaagaatgcattttctttttcgttatttctgtcaggtatagataacatcattgatgttgttaacatcatttaaatttcaagattatattatgctcttatataattaaagctattttgttctctggtataaagtttataggtgggcaggtaagaaaaacacaatttttgaaagttgagtacttaaccagattacttaattagcaccctcttctgcctggcttgacatttatagttaatcatgaatttgcatcttggaagccagaaaacaacaattatctggaaacttaatttaaaaaatataaattttgcctgacttatattttaggggttgaaattgccttgttaagaattaacctccctcagctgatgttacccctctgatcacttttgactcttcgtttaattataagtaaataacttgcagtgcttcttgcctcccttccatcaatatttaaacaaggaaaagcattcatagctgtgagccaaatgcagctagctacatagaatatggtttagtcacagaaccaatagaattaccagaaacctcagcaagttattcctttagaagtagtcccagatacaacaccacttctactcaaagccaaagttattgttgaatgtaggctacacactgttctgtatgctttgcctgtgttaacggcatcatcacaaccactcctgcaaagtttgtattgttataattcccattgtaactgatagcatactgagataagaaaagagtaagcaaattatccagctccacgcagctagtaaatgatgatggtagagtccacagaagcttggtaatagatttcttaaaaattaaaataaatccaatcccaaattacttgtttaaaattccttttacatttccttcattagatattcaaattacaaaatatgtacatattgatacaaataaaagaaaaatcttaatgatgccacattaagaggatttcttttacttttttgtcttttaatttttttttgctgtcccttggagtcagtaggggccacatcccctttctaatcctactctctgggcatggagagcactttcacatttttcttcatgcttgccacatgtatgctgtctcacaggcatgcacacttttaaacaaaaataacaatataaacattactctgaaacttgatatttcatgaagtcatatatcatagtgcttactccaggccagtaaagttgtagttgagctttgcattgatgcataatatttcatgtgatgaatgaatcataatttattcatgcaatgatggatgttcagataagagaatgatcaattccttgagtgttttaaatagacacctgacagaaagagtgaaatgagctaggtgcttttaccaaagctaaggtctgcttatgaagacgttcctcataacgctgcaatttcttagtgattaagtgatcaaaattatgtctggatgcctcccaagtacacatttcttaaattactccatatcacctgaaagaatgtggtgaatcttttcatgtttgtccgtgtgctattttcagtttagattctttgtagcaaagtggaaggaattgggtacatttaatattaaatttttgttgttggaaagggaaaaaaacactaaattattgcagttctaaattatggtttgaaaaggaaaagcaaaagctatcaaaatacgaagcaggaaaagagaggcagctctgaaatcaacacattgcctaggacattctccctaagagtctgctcttcttggctgatgcagcagcagtgcactgtacacaacaaactgccagtcccaaactccttgtagtgccaactagcattccaagtaaaacagagcagaccttttaaagccacctaagtatctcttgagcataggagtatgattccttaaatgctcttatactttcattttacagagctctgaaagagggtgctttttttttttttaagttttagttttaaggcaaagcaaagctttggcaccgattgataatttgcctgtgcacctcagaaaagtaattcctttcttaagaacaaacagcttatctagtcattcccctaacttttcttgcttctagaactgaagcaaatttgctaattttgtagtattctgtaaagcagcaaactgtgatattcagtgaagttctcactgcaaattgggaaccgagaaaggatataacacatcctttgcactcctatagaacctatcaaggctaaagatgttgagcctgactctcttaacagctccagtgtctgaaataaatattctaatgtctaaatgaaattgtgctcattccctcagggtttagtgtaaaacaatatgctcttgaggtgaggacaagaaggccgtcacctgagcatgtgagttttcatgttgatactctgaacattccattctagactacctggaatcaaggaccacatctgagtgtgttatacttgcaaacagtttggcttattatcattgcaattggaaatcttacaagcatatatactggctctaatatatattttatttatacagatgaattatgcccatttaaaaacaaaaaagttatctgtagaatacattatagttttcattcttatacatggatcagaatagagttaagaatgtgttcttttagctttgccattttaagcaattttgtatatacataatcattcacttggaagccagttcagtttcaatttatataatgattgtttttaatttagaataacaggaaattttcttttttctttcaaatattagttttgataatgttgaagtatgctggttgaaaactttatgattttgaaatagcgcagagacaggcattacgttgcttgatatagtataagattttgattgttttctagaacatcgtctctgttgagattagcaatagaagttttaagtattctgcatatatttccaatttggttcaacatacatttctttagcttttattttttgcatgtcccttgactttttttaaaataagaatattcaaaaatgaataaaacatgattcctgctctccagaattttacaggttagtgggtgagactgagagttacatgcttaaaaacaaatgtgtgtaacagcaggaacgctgctactgctcaaacagtaggaagttaaaaacacgagaacgtgagatgatttggggagcgggagcatatttgactaaatgtccactgtgtgctcagtttggggtcccagaggctagccgacatattgtatgcaggacacatggaacatagtctagctcctaactccatctgcatttggtttctgtctggtaagctcatgtgtaattacagactcaggacaaagaggtggttaattcttcaatggtaaattaaatatgatacaagatggaaaccgaactccacaaatatccagaagagaagcatgatattagctgaaatttttattccattgcattttcttaaatctgtgaaatccatgtaagtctgaacttaaagacagcactatcttttaatttagcctataaaaatttcagcaaaccaaaatgtttgttaaaataaccattaaccacatatatatccaaatattcattatatatataaaatttctttaaaatatcatgctcagaaatagagtaagttttaattaacaggaaaattgtttcatatcttgttatctttaccaaaaattaaaaatcaccaccaacaacattctgtatctatggataccttttctttctgttacgtcaaagtgcatcatggaattattctgaaaatagggccacctgctctatttgatattggacttttaaagaaacaaaagtttaacttggtcaccaatttactgttcctggaattgtactttatgagaacatttcaaattaattgcatccttaaactggggtcacatttgaaatcttgtcctttgctttttgttgtttgttttgaaacttgttgaaaattcttcccaggattctttctatgtggaatccaatttacagtacattttaagggcctttttaaaaaacataaaatgaaacataggcaatcctttagtggatctgtcctgttttaggactaaattgatatcttttaatagatgtaaggccttttggattatctgccccgaacttctcccactattgataggcatcttgtactaagccatagccatatattgaaaattgccccaaatgtgctctgctctttctcacctctttgtttttgcacaagcttacctctgcccaggatgccctttcttgcatcgtagaagaatgtacaatgacttccttgtactacttcctcaagtgcctggtcagatgtgactgccccttggagatcttttccatctccagtggtgctgtgcacttcgagctcacccagttggctttactgcacataatcacattggtgtcatcacatcacccatggatctctctctccctcacctgggaagactcttctttgtattccctgggcttagcatggtgccttgccctaagtgttgggctaaccaaaggtaaagtacatggaccactttgaaaatgaaaaatatgtttgatgatagaatagctctcaaatgctttagtatatttccatcaatgtgaaggcagttgaaattgtctgctggatttctttgatcatgaactatgagcagtaggaatcatgttgattaaattctcttttttctttctctgcctgtgaccatgccttaattcaggcactcattatctctcacacaaactatttcaagacttttctaactattcctcctaccaccagttccttttcctgccttctctcctatatgccactgctagagctaacttccctcaaaatgtttctgattgcatcactcctattcttaaactctcatggtggcatccaattataatacatagtccaggcctttcagccataattcaggacctgagcctgtaagcactgtaagatgtgagacattgtcatgttttcctcactgttatccccccagcatatagcatagtacttggcatagcctaggtgcacaatgcacatgggctgagtagcccatttcatcaaatctaagatggtgtgatcagaaaacacaccattattttacacactgctaagaaaaaaacctgccaattaaactaaggcacaaagcattcttattctttgaatttttattttattcttattgaaaaaccatttttatacttcaggaaaaaagattttattatatgtcactctaatgcataaataaaagggaaacataagaaaaatacattggttaaagtaattattacaactttacattttaagtttgacctttatgaatctctttctacctgcaaatcattgagatttgtgtttttccacacagtattctccatttcatcaggagtattagagttgaagcatttcttaaaagagtgattttaggcaagtgggttgcctgacctcaggagtttgagaccagcctgggcaacatggtgaaatcctgtctctactaaaatacaaaaaattagccaggcgtggtgacatgcacctgtagtcccagctactcgggaggctgaggcaggagaattgcttgaagctgggaaggggaagttgcagtgagccaagatggcgccactgcactccagcctgggagacagagtgagactctgtctcaaaaaaaaaaaaaagaaaaattatatatgtatatatataaaatttaaaaagtaattttatttcaagttgctgacacctactttgcaagttttgatgtccatgtataggtagtgacaacatcaaaactgctaccaacccaacagcatcttcatttcagaggtgttaaaatgttaaaaaataataataactaaagtccgtctcagaattgatgatattaattgtcttattcgtggaatcaatatatggtatttttagtctgtccccaacatactcttccagtttcctcttcccactactcaatccctcacacttttactccagactatgagattttgtgaactggggcagatgcttttttgactctgtgttgttgcattcattccaatgtaattgccatcttcaagcctttcttacttccccagatggacggggtctcttccgccttgccaccctctgagcattttgtgtatacttatttgaatacttctgacaatttttagtatgcatgttgaaagataagaactaacactatagtacttttgtctgtacccttgctgcttgcacacagctattatttgataaaacttgattaaatatggtttgatatatttccttccttttatttgcttatggagtggtttagagttccagagttgtccagggaggacttctgttactattgcttttatatgacttggtgcccttggtcaagcatcatttaacaaaggatttgttattttgagttagtcagaatatttaagttttgtgttggccaaggcccatgtcttacaaaataaacaaataaaaagctcactaacccaatatttttgtgcatttcatcaggattgaacaatctatttgataaatgacaatttatatcttcacaatttttacactaaaatcatcccagagaccggaacctaaataagacaactaaaagcaattatagaactttcaggagcaagtgtaaagtctcagttgaaatactgtctattgataaaaacattagccaaggtcaaatgcatgtcctttaaaactgtcttctcatttcattactgagtgttaaaattaagagtctgtgtctgaattcctgatgttagtcatgagtcattctatttatagatgttaatgtaattctcaaagagttgccaacaaaggaacaggtgatgaccccctagagcagtgttactgaaaatattgtcagtccaatcagtcacctggcatactgggcagaaatgcagttacctggggtcagagtcatacctttggactcttttgactcccaggattctgagtaattcttaaagaaaaggaagtttgaaagtttgtatttttagattatgatccattgaatctgataccatgaaagatatatttagtgttttcccaatagacctagattaatacccaaattccaatagagctcttgcttctggactgtacaattcaatgctgtttagtcacataattcaaaaactttaaaaaatattttctataacatttttataactagtttttcactattaaattctgtaaacttaatgacatttcacttcaatctatacaggaagttaataacttttcctttgaatagatagaagaaagaaataaaaagagatcattttgtattgtatgctttccagcggaaatgatctatgatatagaattaaataaaaaactttttaaaacaattctgagtcactgcaagcactcagagagatgtgagtcaccataggtcacccagaggatgaagatatagctgggaacagaacgaagatactgtctttctgtcccttacccacttgcctgcttcctccaacaattcaaattcattcattgagtcatatgaccgtctcatagtgttgttgtttcctgaatagctttttattaaggattttctgggcttctagtatactccgcagaagcagaattaacattatttatcttaaaaaagcattggattatttacgaaataaaaacaaaacttgaaaaaatgatcaaataatggattttgatacatctagcaccattgccttgttttatttttattgataaaataagtatgttggaagttatttaatgccatcaatgtaatttgaagaagaaacaaatggaatctatcttgatgagcaactattgtgggttttttttctccacaccatgatttcacctacatgttttctttgcagcttgcataatctatagaatatccatccatgataacataacaatacattggcagctatttgattaccttttgagcgttgttaatccctctgcccagctcttctttgaactggtcatgaaatgaaacattaagtcccatgtcaaccaaaggaatgatagatggatggagactcaggaatccaggagaccaaataaagaaacatgtgtgtgcatgtgtttgtgtgtgttgtatgtgtgtgtgttctttctgaaaattccagttgcatttattatttgcattgtacataataacacatcatcaaattgacctttaattaagtggctaagccatctgagtggcattattgtttagacagttctcatcaaaatttttagtagttctccatttcttgagctagaatttattagttgaatgcctacttatctattaaagacatttgataaatacctccaatgtgccagtcagtgtgccaatcactgtgctaggtactgggattcactggtgtgcacaataattactttggattaggtcaccttttattaaaagattaatgctgttgtcccagaagtgggttagttagttgtcttgggataggtttctgataaaaagatgattttggtccctttccctgtgctctctaatgttttctttacattctaccttctgtcatgggatgatgcagcaggaaggtcctcacaagttgctggcaccttgatattggactttctagtctccagaactttgagaaataaatgtatttcctctttaaattacccagactgtgttattctcttatagcagcaaaagccagactaagacagaaaattggtaccaagaggtggggctgtgccatcataactacctgaaaatgtggaggcacctttggaactgtgtgacaaatagaggctggaagaattcagaggagcaggctagaaaaggctagattactgtaaatggagcattaaggacaattctgatgaaggcatagaagacaggagctatagggaaacctaaatcttcttagggattatttaagtggttggtctcagaatgttggtagaaatatagacagtaaatgccattctgatgagctcccaattagaaatgtagaataaggtattgggaactgaaggaaaggccatccttcttacaaaatggcaaagaagttggctgaattgtgtccgtgcctgaggactatatggaagacagaattgaagagcaataaactaggatatctggtggaagaaaatttttaagtaaaattttgacagagctgtgtagctgcttttaactagttatagtaaaatgcgagtggagagaaatgatttaaagactgagtttatagctaaaaaataagaacagaaaaatttggaaaactctcagcctggctgcataaagaataaaaaagcatgttcaggagagaattctaagggtctgaccaagcaactgatcactaaagagattaatatggatagaaggaagccaagttctatttatcaagataatgagtgaatgaccccaaaggcatttcaaagatttttgaggcaagctaggaacttgagggccagatttccagagaggttcccttaaaagctcaatatttgctgcccaggtctgccatgggactctgctccctgcattctggtgcagtgctctttggctgccccaactgtggctcagttgggcctagatgtggctcaacctgctgctctggaaggtacaagctgtaaaccctggtgggtgtccacatggtgctaattctacagacatgcagattacaagagctgtggaagtttggctccctccaccaagatttcaaggactgttgtggatagcctagtggcccaggaagagatttctcacaggagtagagttactgcagagagcccccattaaagcaatacctagtggagccatgagagtggggccacttccaagatctcagaactgtagagctaccagcttgcagcatcagcctgggagaactggaggcatgagactctaacctaggagagctgctgggtggactgagcccagcagtcccacaggggtgggactgcctgaggccttaggagcccaatgcctgcctcagtatgcccaggttaattctggaactatgaggcaatgttgttttccctattaggttttggacttacttgggactagttagccctttcttcttgcttagtcctcccttttaaaatgagaatgtatacccaatacctgtcctaccattgttttttggaagcatgtaatttgcagacttcataggctcattgctagagagaaatttatctaaggatgaattatgccttgagtctcagccatatctgatttagatgagactctggactttgggcttttgagttgatgctggaatgagttaagacttttgggactgctgggatggaatgaatgtattttgcactgttagaaggacataaatttggtgagcctggagtagaattctgtggtgtgaacatagcccccaaagttcatgtgttggaaacttaatccccagtgcaacagtgttgggagatagggcctagtaagaggtggttatatcacctcttattaaagaattaatgctgttattggggagtgggctagttattgcgttattgggtgcctgatgaaagggtaagtttggcccccttccctgccctctcttatgttttcttccccttctgccttctgccgtggtatgacacagcaagaaggccctcataagatgctggcactgtgattattggacttcccagcctccagaactgtgaggaataaatttatttttttattaaatatccagtctgtatttttccattatagcaatacaaagcagacaaagacaagcgcattacctatacataaagccagcatactcttatctgaaaaaaaaaataattacttccttctaactatctagcttctagcacaggttaggaaaaatcttctttattcctgtccccatctacaataagctaaccattatctgttctatgcaggagctcttcattagaaggaaggcagtcctaaatcttgaaaagcccaggacatagcatatctgttgttccttttgcttaatatgtctgtcatgatatagcctcatttataaatttcttgtgtttcctattgcatcagctgccacactgtgtacttattcactaatttcgtaaaagacactccttatactaaaggctgtcagaaagatgatacatggttaactctcatttttcatcaggtgccacaagccagcacatgttacaatcaagggaagatggagcatccatacgtttctcttcctctggctatagagttgactgttgactgtcaactcctcacagtcacttattcattaattcatttacttgttttaaaataaaatgttttttgagtgcctgctttgtggaagcactgtgctaggtacaagagatgcaatagttgacaaggcagggatggtcctagccttaggaatttcagtttgtcacttgctactcacgttaaatttacttttaacaccattgctctcaatcactgacttctaagttgacagttacccaaagaatagatcactgagaatctctttacacctagaaatatctgtaaagacttacattacaccatcggagtctgccctatcctttaaaagctgcctttgtcagtttccatgcacaggattaagtgccttcatctttttatatatgagaaacatgactcgcaatcttatattctgcttccaattatctgaggactgcacagaagacaatgatgtggattctaatgagacacaaagacctgtgttctacttcctactattccattgcttggtactttgaaagtatttgcaccaagtaaagtgatgccttggtttcagaagcagctctaatggtggctaggggcttaaaagtctctaaaagtggctgtgcctcatgcctgggcaaaaccaggttcactgctggtgaaacaatttgtagaatattgtcattttataaaagtaagttaataagcattcatctgatggtatgtttcaaaaattctgggcatgttctccttaacatgtctcgttaaggaaaagactttctgtaaggcaaaatcgttccctgtactgagaatgtactagccatgtacactggtctaagacagatgactgatggatgagccaaaatcatagactaatatgaaaaggatgttttacagctatttatatacatatgtaattacgtataattggatgatatatttctatattagaagttatatataaagtgcaagtaagttaatgggcacgtgtatattaaattaaaatctatattagttatatattttatatttatatatttaagacatgaagagctgaacaagcagatgtttagcctgaaggaaagaacactagggggacataatagcaaagcacgtgtatttgtgaatctgtttattcaagagcagttagatttgtcctgtatggcctcaaaagcaaattagggctagtggtttgagattacgggaatggattttagctcactatgaagaaaaattttctcaaattcagatctggctagagtaagagtagtctcccctgggagacggtgagttctctttccttagatgtacttaaatataaaataattctagagagaaattcaccaggttcagtggctcatgcctataatcccagcactttaggaggctgaggtaggtggatcacttgaggtcaggagttcgagaccagcctggccaacatggtgaaaccccatctctacaaaaatacaaaaattagccaggcatggtggcgtgtacctgtaatcccagctactcaggaggcaggagaatcacttgaacccaggaggtgaaggttacagtgagcagagatcacgccactgcattccagcctgggcaatagagtgagactgtctcaaaaataaaaacaaataaataaaggaattttggagaggaatcaagcattgggaatgcagtttaaatacatggcctttaaaactattttaagcctggaaatacaggattcctgctgattctcagtttctttatttgtaaattgacaataatattacctgtcttgtcacctgcagattgttttgcagatcggaacagataatatgcgcagtgtcacaaaaatataaggaatgagtgtttctattgcaccaaaggaaattactcattaatgagtgtgaatcagatgtgactaataccacaggttattcattatcatctataagaaacattcaaattaaaacacctaaagatgcaacatgaacttgcatttttgaaactatgtttagagaaaaggatcctgactcactttaaagggacttggattactagtgaatttatttccattttgtgtttaattttagtcatttgtattaatgtcttctttttctaatatgtttaagatgatgggtgaccttacagactggtttttgttggtttattggtctgttggtctgttttgtatgtcttacattaaagaaattatggaaaaggataataatctgtcccagaaaatcctacctctgcaaataatatggcagaattaaaaccatttagagaacttaagttagatttcccagatttatgtattcacattcctataatagtttttattaaactttaaaagttacaaggtttacctgattgttatgcttcaggcagcgcacagatgtatacatgagatattatgttgttcctcttaattgctctttctgcattgaatatgttagtttgttttttcacctctgtttaaatcattacccattcatatactctacaattcctgggtgaactttgggaaaacactttgcttctctgaatgaatagcaaatgcaacacaagaccttggataagctatttaaaagtcaaataagagcctctgaagaatgaatcagtcagcagaaacattatcatggtgaaaacatttcctacttttctcagcatcatcatttattttgttttcctaaaactaattaatatattcaaaagtcaacaaaattttacttattaataatgtgcaataaacagaaacatttgccagaaagcactgcatcaggagttagaagacttggttctgatagttgctaattttgtgaccttgggagatgcattcacttccctgaaccacattttttctcatgtgttcaagagaacaaataatgatcaacccaccatatcttgaggaaggatcagtggggacaatatagataagtacacttaaattatttctgtagttcagtaatagtaagtgaaaccacctacattctttccaataataataatacctaacatttttataattctttattacacctcattgtttattatttccattttataggtgagagatctgaggttcagagggtttaaaatgatctatcaataccagtaaatggttgacccataagtcacctccactcttttgagtgaatacctgtttccctaagcccatattttatacactttggagaaacagaacagcaagccaaggagaacacagaaaaaattatggggagagaggctggttgtcagccttaataaagctcgatgctctccttacttaaatgactgtttcatgtgaccttcaactacaatagtattctaagtggagttaggaagagatttaatgggaggggggtttattgaatccattttcaatgtaatgcataaacatttagtttttctctgttaagtcaggtatcaatcgaaggcagtatttctcaacatgttaataattgtgcatgcctctcaaataagaagagttcttagacatgtttttcataatctccccttaataaaatgttaataacacaaatatacttcatgtctgtttatgttctttggccctttggagttccagaatcattatgctaagattttttcaccccaagacctaattttgtatgatgagaatacatgatggaaggctgagcaatgtatctctgcttagagaagtggcatagatgttgggagcacagcgaggctgtatcagtctgtcttgattcaaatcctagtttagccacttacctgctgtgtaaccttgctaaattacatatctgatctttgtctaaacgagcctatccgtgaagtagggattgtaagagcagcagcatcatattgttactcatataaagtgcttaggacaacactggcatttaggaagagctcaataaatgcttttttgctatattatggaatcctgatttagaaataggaaaacctgagctctaagcctgacttatctgtgtagcacagagtcaattattgctcagagcctcagtttcttcatagatacataactgatttcactcaaaactacagatcgttccaattgcagaatgtagttatagggtctcatctatttatctctacggttaagtgaacttacctatttttttctgttacttatttattaattttattttagcctacgaatttctaaaaatctctgattatattctcatagttttgtcttattgtagcctagtgacctgaacccagaatcttcatagaaaggtactgtattccacaaatatttcctttggaataataatagcagttaatgctttaaaaacattttcaagcccaatattgcactaatcctcaaaacatcttgtgatggagatatttttattcttattttgtgatgagaaaactgataccatagttaatggagtgaagtcaagctatgaggaaggaaatccaagttgtctattcctagaccgaaaatattaattaattagatatgtgcatctgtgagaagaggcttattgcccccgtgacaattttttggcattaaaaaatgcaaaaattgaaacaaagacataaagaagaaactattcatttcctgacttctattatggtatttttttttctcttcctccttgagtgcaggagctttcgacgtgacaaatgtcagcctatcgcagctatccttaggagatatccccaggttgcttggcactagtgcagtagaagtagcagtgagacagactcttggcagtcagtccatctgccttttctgttattgacttcatagttgttgagtggcaggtcttacttatcctgtagctggaagaaatattttttaaaaaacattcatttatttgatgagtatttattgagcacgaagcatatctcgggcttcattacgcaataaccatggactgtcatctcttatctgttccttgttctgtatcactgaggatgggcctcttctctgctgtcactacatttatactcattcattcattcaatgagcatttattgagtagttactatatgctaggtactagggataaagtagtaaggaaaacagtttgatcaaagttcctgccctcattccaggaggaaaggggagataagcaaggtaccttaatatatagagtatgttaaataattttcagtattaaggagaaaaataaaaaatggaagggggatgtaaaatgttgggtggggtgacattttaaatgattggccatggaaagcctcaatgtgaaggtgatttgggatcgatactggaaggaagtgagggagttagctgtggatgtctgcgagatgagcattcccagtggaaggaaagtaggtacaaaggcctgaagtgggggcatgcctgatgtgcttgaaggacaatgtgattaaagtggtgttatcaaggtggcaggaggggtggaggagtaataggagttgagttcagagaggcaataagaggtcaaaccatgtacagccttgtagttcattgcagagactttcgctttaacactgattgatatgggaagccactagaggtactgaacagaagagtgatgtgatcagatttacatgttaacatgatcattttagatgcagttttaagagtagactaaggcaaagcagagagaccaggtaagagatgctgttgacttgggctagagtaatggtagtgggaggatgagaagtcgtcaaattattgataaattttgaaagtataccctgcaagatttgatgagggaccagttgtggagtgtaagaaaaagagaaagaacaggaatgataccagggtttttgttttcagtaactagaagactagagctgtcattagcaatatgagaaacatcatgacctgtcaacatcctttctcttatatcactagatttagagtggataacttcaccaatttgaacataatggcaggatactattatagtactttatccaagagagaattctgagattggtttctattcttgagtattccatgaactagccgtatgatgtatgattcaaccacttactgtaagtctcaaatttattcatttgcaaatgagactgactcagacattatcttctctaagaagccttctttaatatcattgtccaaagagtattcatcaatgtctctactgacctacttctataccttgtataaacttctaatagtccacatattttgtgcttgatatatctgttttccttactataccatttggtcctcaattgagtcttataagtttttgcatcctgtgtacagcaacacatgatagacacttaaaatcttactttagatgatttctgaatttaatgaaaagatgaacatttgtcattgtttcatgaaattcagtgttcatagtataattttagaaaatattatagaagtaggaaggaaatattaatattattgttttgaaatatggattataccacccagagtcactttttttgtggggagagtgtggcagacaagagggacttctttttcaatgccaattcttttatccctaatagtttacattaaactagtgtagtttgatcatgctcgtgattattcttcagaagttaaacctttaacttagaaatcacatggttatctttggatttttttgctctcaattcaaaaatttacatcttataaacttaatttataagaatgtaatgtatttccaatccagtttacatttattgacttcccccccagaagaaatacatttttataataagtataaatgtagaaatagaataatgatgaaaggctcaaggcctgccactaagaaaatctacagtttgcatcatgtaatttagttatactggaaaacacataccacagtgttgcgtcatggaagagcctcaacagatgtcatttttctgtatacagacaatatcctcataatggatattgaatacatgtaaatatatgcaaaatacaaccctgattaagcatattaaaatataacttatactattgatggctaatagatatttttatttgatattgtacagctgataaatgatgatacttattgattacttacaacatacctgatatagtacttggtatttcatatttgcatctttattccacaacactataaactaaggagtatcctttccaatttttagttaaagaaagttgctgctagtgataatttcaagttttcagcccaagtctgttcccaaagcctgacatttttttcacttccaaactaccttccagagtatttcatccactgttgagagatgagatgaccaagacgtctcaaggtcaggtcaccagctgaaatccacttttcacttacttccttcattctgtctagtttagcaaacaacaagcaattattatcatgttcatgaagagtgggcttttttgtactaatattttcagggctagtcttggtgatggaagctgtattctgtgactatattgactgaacttgaatacttgctaacaaatatagtagtgggattcatcgggtctcaaagttgcttttaccctatttgcaagttagcctgtcactgcttcatggatgaccacaaagagctttattcctggtggcttgataggcagcatgaccctcagcctaagtccttgcttctggcctccatatctcacagggatgatcttgatggaagctatacttacaaaagaatattgagctttagaaatccactcattttattgtaagcagtaagcaaacctgctctttgtctggaagggtgacattatctcattaatcaagattgttcctggcaaatacactctgagaagtggccagggaaagaaaagccaaggccttacttacatgctttgcactcctaatgagatgtgtaggagcacaagacatccatggaggatatctctccccactggattcttgtatttctgaacttcaagaatctaatctttcttagagacaatgttgacaaattagtaaaaccataatttcaagtatccaaattgtaccaatggaagatagtaacgttttgctaattatttctttgtgtttagatattaatcccaaatggcctgggtgattaaattaggttaaagtatgagggaaaagtatgtttagagctagaaagagagtgacagagatggagatggatggataaatttttgatccattagtctgtggtggtaatgattatgggaatgagacaggaagacaggaagataagtagcattgtgtatttattcattctttatctatttaatgataaatgtttgtccaacaccagcccccattctaggtcttggagagaacagccatggacaagaccaacaaggtcttcaccctcaaggagcttacattttaatgagtatagtaaggaaacaaacatgcaaacagtaaataggatcagaaagtgacaagtgctatgaagaaaactaaacaatttttgagtttactttagttaccatgttcccagaagacttctctgaggtgccaacatttgagcgagtatgtgattattagaagatagctatacatatactacatccacacacacacacaaaaaacaacaacacttcaggatgagtaagtattctgggccaaaggaatacatagtcaaagactgtaaagcagaagtaagctgggtatgtttgaaggagaacaagtatgtcaacgtggtggaaagagagtgaacaagggtaagattaagagaccatggagaaaaaatattagtcaaggggatggtcaggtagtatctttggggaagtcatggtaaggaattttgtttgtcactgaaagttttaaattatgatgtgatatatttggatttatggttaatatgggctacactggctccttatggcttggattgtggaacggattgcagttggacaagaaagaacacagagagtctaataatgtttgcagaacttgagccaagagaaagtacattttagggattacttcgtcatgagagacaaaaatatattgaagttagttgaaacagcaaagaatttatcgtaaggaagatagctcatgaaaatcaagggcagaaaggtagtcagtcgccataagaaactgactacatattccttttgcctagaatacttactcatcctgaagtgttgttgtggtcattgtttgtttgtgtgttgttgttgttgttgttgttgttgtgtgtgtgtgtagtatatgtatagctatcttctaataattacatattcattcaaatgttaacacctcagagaagtcttctgtgaacatgataaccaaagtcaacagaaagctatcaggaaccaagggattcattcgtattcatactctctttctcgtcctctttccctccctcccttcttgcctatagactttctctgctttggtaatctatggccaaccagaagttcttcagctccactttacgtaatttcccagtttgaatgcatgagaatggttacatatcttctctgaatctatgttcaaatttcactgaagaaactcttcacttgatttgccctgggccatatgtctacttctgatccaattggtcagaaatgagctgagctagaatacttaaattgggatggcaggagctgtgagagcacagttatacatacaagagcatgtacagtattggcttatagctcaattaatttctgcctcagctatagaaatataaaggaacaaatgtgttggctgttagtagacttgaatgcttggctagggttgacagaaagtaacaggttttgagtaagcagcacaatttagtcaagtaaatgggcagcttgtgattaacagtgtcagtatcatgagttgtataaattagggatcctcaaggtctcccttggtgttcccacatgtagaaaggttaaaacaaaagtgatattcaaaaacaggcaacagatatatcttacgatatgttggtaaagcctgaaataggcatctggagtgacaagggtaaaatcaggttgcagtaataaagaagttggtcagacaggtctgtagacctcattgaagaaggtgagtttaagcaaaggtgcaaatgaagtgaaacaaaggcatgaatgaaagacacaaatgaatctgcgaaacaggtatctgtgggggaagcattttaggcagggcaagtaggtagaacaaaaccccttaggtaggaatatacttgatcagtttggggagcagcaaagaagccagagtggctacagtgcaatgagttagtgaaagaatagtaagaaagaaagtcagtgaggtaatggagttggaggaagtatctcgtgattggcctgtaggctccctggactttggttatttttcagagcaaaggatagtcattgcaggactttgagcagaagacatcatctgtaaatactaaattttctcatataaacctattaaaagtacatacatcctatgaagtttgtatattaaaaaccagaagatgcactaccagaaaaatataatggaaaccattcttccagttatttccgtattttgaatgtagagctaagttttggtggcagattggaggtgagtgtgaataaaagaaggaaatcaagaataagtccgagtattttggcctgagcaactgaaaaaatggacttgccaccaaccaagatgggaaagactggggggtagaatagttggagggaaataaaagtttagtttggacatgtgaaccttgtgatgtcctttaggtgtccaaatggagatgccaataggtttttgagaattttggagagatctggtctggagatagaagtttggaaattgtttgcatataaatggtatttaaagccatggcttcactgaggcagtaagtgtagatagaaaagagaaggccaaagattgctctggggcatccaacattaataggtcagggagaagaggtggatctagcaaaagagactgagaagaagtgatcagtgaggtatgaaaagacatatgagtgtgacatcttagacattaagtgaaggaagggtatgaaggaagagggactgataaactgtgccatctgctaaggtaagcactgataactgaccattaggtttagcaatggtgattgctgaccattggaggtcattgctgaccttgatgtgggcagttttggtggtatggtaaagtgaaaacttgaccagggtggatttaaaagagaatgaaagagaattagagacaataaatatgagtccatgcttttgaggtgttttttggcaaaggaggcacagaaatgggactgtagtggctggggaagtgggatcaaaagaaagtatttatgagagtaaaaacagcatgtttatatgctgatattaacagtttagtagaaagggaagggtggattatagaggagagaggggaaattattagagcaatgggcttgaatagatgataagaaatattatctagtacataagtagacgattaataattttaatattaataattagcaataatttatctgggaaagtgtttctctattaattgcttagagagtttttcatcactgctcaaaaaccttttgtagcagcccattgcctattcaatccagcctaggaacctcagcccagcaggcaagatggttgtactctgacctcagtgtaccttactggcttcatttccttcagttctccctcctgtgcctaagttaaagaactttcacattaatctttgtttctttgtgtattgcatgcgatagactaggttattcagtaaccatagacctggtgctgaagctacaatacagctagattgcattctagattgttcccaatgttgttcccatgttcaaggatctcatgtatataaggcagcataccaagctagtgcttctgattttaaagtaataagagatttttttaaaatttgctctgaaggcaattctgaaagataagtttcaaaaatatttgaaacaacaacataatcactggggcattttcacgctacgtgcttttttttggtctttaccattttattttgaaataattttagacttagaggaaagttacaaaagtagtcacagcattgacgtatgtcctttaccctgcttcacctagtgttaatatcttacattaccatagttcaattattgaaatctggaaattgttatcgatgaaatactgttaattaatttaccaaccctaagtaattccattagtttttccactactgtcttttgtgtggattaggatctgattcaggatcagtttgttgttatgtctctttagtatcccctaatctgtgtcagtctttccttatcatccatgacgttcccattttcaaagagtaagggtcagttattttaaagaacgtttgagtgatgtttccacatcacgggattcaggatatgtaggagaatactctctggaatatatgagccaggatgcatttgtgcaaaaagtagtaatatgttataggcaaacaatataatcttaaagaccacattttaacagtttggggctggtttttttccccagtttaaatctactgaggatttcctattcacaaataaaaaggtgactcagtaaatcaagcaaaaaatgcttgagagtatgaagtaaaaacatactgttacgtgcttcaggaaatacaaggaaatatatgacataatcctttacttcaaatactgtacagtcaggctatggtgacaagacatagagaatatgttcattgttaatgaatttcttcactattaaaatgtatatgcacaaaagtttaaatgaaaagcattttaacagacaaatttactgctacagtaaaaggtatgtctacatgcagacaacttgctatcccatgcttaggtaaaggaagagacttatgcaattaaattacattattctgtcatccgtgtcactccagtcttttttctttctaatgttaatatccacacttgccctccatgtaaatatcagtgtccagtggttctatttctcaggaatttctctttgttaagccagagtaatcagtagtctcactccctatggtcttttagtctggactacaggtgactaaatttttacagctgttcttcttaaccttatactcttgagttttttgttttgttggttgtttttccctaacagtaagccatgttgcaaacttcctaaccagtttctccatcattctttttttccccagcattacccaaattatacattacttgtatgtagtataaaatctgcctttcactgcctttcagttgagtttaccataaaacgtttgactaggaaggatataaaaatttgtttacactatttggaaaaggagagaaaattctctgaatggggtaagtggattcttggttggaagctcatgttggataaaatgaccactcaagtgtttttttcagctctaagtcaggatggaacttaatggcacagcacaaatcggctgttgccacaactgggcaactggaaaatgccttttgatgatggtgattaaataaaggtcaaagaatatcactgcatcctaatggtagtcatcacacaacatcagcctttctcctggtgcctttgaaaatgtcacttgaaaagtctaaaaaatgctatgtgttttgtttaggcagaaaatgccctcattaagtacctcatgttttcgttagaaaaatcaaagaaatgttagggttctgagtactagattgtaggtttaaaagaaaattaaatgtaaccttttgttatgtaaaataataaactcctaaagtaaccataaaggctttatttttacacaaagcgtatgtctgttttctaaaaggctctaaaaagagccatgtgatatgatctcaaatctataggatgaaaaaacccacgttactgaagtagtagttaaccgtgaataatttctagtggaaagtgaagatttcttaagagagttattttcattttttaaggtatgaacttgagcatttgcggtcttgtcagggacagtagttttagttttgcctactcagtactcttaagaaaaatcagatacggagcctcattttctttcatattctgtctattcctctttttttttttgccaccattataagtactatagcccttatcaatggaaggcagaaaggatgtccaatttaaaagcaaaagtttacttagttgtactatgctatcatgaatctagttatatattatatatattatatataatatatgtattgtatatttatacacacacacacacacacacacacacacacacacacacacacagtatttcatgtaaatttcatgctaatgttcccttaggactgacaatatgtggactacgtaatctaaagttttgtttttttttttaatttaccaggtaaattgacatccccatgtgacaggggtaaatcttatttctcaaagtatgcttggaagtcatgagctttcgaatgtctgatcatgaacagcagcatactactggatgtgtagcttccagtgtctaggagggtttatggtaatctaaagaagcacattttaaagagatgcctatgtacattcaagtatgagaagtatttctttagattacagtgttttgggatacaaacactggaggtgaattacctgagagtaatatataaactccaataatctcaagaaggtatgtcaagggtagacaaatgatagctgcaattctaaatctggcctattgactatttttgtatggccttcaacctaagaatagtttgtactttgtaaaaagttgaaaaaaaaacaaaagaatattttgtgacacatgaaaactacataaaatttaaatttctgtgttcataaatgaagttttattagaacacagccatactcatttgtgtattatcaatggctgcttttgtgctacgtcagcagaggtgagtagttgtgacagagaccccatggtctgcaaagctgaaaatatttactatctatccctttccagaaaagcttttccaacccttgagcaagatgattttattcaattacttagattctctgtgcttcagtttcttcatctgcaaaatgaagataataaactgtacctatttcatagaatttttataagagaatgaagaggcagtatagtgtaatgatcacagacatagattctggaacccaaactgtctgagtttaaatcttggtcctctgtttaatagcttttggcctaggcaagttacataacatttctgtgcctgtttccttatctacaaaataaggaaaatatagtactagtacctacctcataggatttctgtaaaatcaaatgagttaacataggtgactcttgtacagttgacccttgaacagtgtaggagttagcggtgccaatctcccacacagtcaaaatccatgtaagacttttgactccccttaaaacttaactaatagcctactgctggccagaagccttacttataacataaatagtccattaccacatattttgtacattatatgtattatatactgtattcttacaataaagtaagctaaatgaaagaaaaatgtttacgaatatctaaaaaagagaaaatatatttaatatttattaagtggaagtggatcaacctaaaggtcttcatccttgtcttcacattgagtaggctgaggaggaggaggaagaggtggggttggttttactgtctcatgcgtggcagaggcagaagaggtggaggaggtggaaggggaggcaggagaggcaggcatacttggtataactttctggaaatatatcatagtttctgtctgatgttttttactttttcagtctctaaaaatgtttctgtactgtactgtaccaatccttcttccactgtttgctttagtttcagtgcccatatcttatgagtccattttgaaaatgaatcaaagaagtcttgaataattggaacccttctgccagattttctaatgtcagtttgttttctggcattgcttttcttatgccttcttcctcattgtctggcactggttcgaaagcactcatctccatcaagttgtcttctgttaattcctgtcttgtggtattgattagctctttcatttcttcaagattcatcccatgaaaccctttatttctcacctttctttttttgccatatccacaatctctttcatgagttctttgattggctctgtcataaattctatagagttgtgcacaccctctgaacacagtttaatccaggatgaatttcttgctttgggctttatggctttcacagctttttctataacaatgatggtagcttcaatggtgcagtccttccggattttcttgacattctctttatcagttttctcttgcataacactgacaactctttccatagagtactgtgtgtaatgaaatttaaaggtccttatgaccttctgatctagaggctgaattagagatgttgtgtttgggagcaagtagagcatcttcagttgaactcatggaggtctgggtggccaggagcattttccgataccaaaagaacttttaaaaagcagtccctttctggcaagatacttcttgaattcaataactcaaagcgttgatgaacccaatcaagataaagggttatcgttgtccagaccttcctgttgtgcagccaaaagactggtagctgatgtctatcatttcccttcaaggttcagaggttagcagctttatagataaaggcagtcctgattataaacctgactgcatttccacaaaatggtagagttagcctaacccttcctgcctttaatcctggtgctcacttctctttctcactaataaatgtcctttgtggcatttttccccccagaatagggcactttcatctgcactaaaaaaactgttcaggcagatatcctttctctagtgattttcttaatggcgtctgggaacttgtctgctgcctgttggtcagcagaagctgtttctcctgttgtcctgacattttaaagccaaacctcttgctaaaattatcaaactgtcctttcccggcacctcagttctccaactttagattcttcaccctccttttcctttaatttgtcatataatggcttttctttttctggaatcctatttgagtctgtagctatgcctttcttatagcaatattgtgcccacatgaaagcctcgaggcattttgcaaagtgcagtgtttctgtgtttgccaacagagctgcagccacgactacacaaattttcttttctcttttcacaatggtccctatgctggattcacttatcctgaaatggtgggcaacccagctgcagacctcaatctacagtacatatcaagcaattaaacttctccttgtaatgtcatgacttttctctgcttcttgggagcacttcagcatcactaattacactttatatgggtcctgtggtgttattcacagtttacggtattgtaccaaacatgatgaaaagtacactagaaccatgagaaatcactttttccctgtgacatgtaatttactggagagacagactgctcacacagagacgattaccatctcatggtgttttaaggcatactcaatacttgcaacacttgagctcaccacaataacaacaggaggtgggtacaaaattattatagtagtacagtacatacatgtattactgttaattttatgcagttatgattgaatactgcatctttatgtttgtttacttttctctagactttgaatggctctgtgtagggtcttcaagtgtgtaagttttaataaatttcaacttttataatagatggtgtatattttatggtaataaatgataaaatagactagtatctaaacatattttatgcatttgtgacatacctttttatttttttcaatatttctaggttacaaagttcatctacaagtttttttaaattatcacaaatctccaaaatattttccagtacatttattttttaaaattcacatgtacctggattctcacagttcaaatccatgttgttcaaaggtcatctgtagtgtctggctttaatagtgtaatttttttattattggtgatagtattgtgattgttttcatctacctcacaagattattataagaattaaatgtgataattcatgtgaaacttagggctcaataaatattagctgttattgtttgttattgatgagacacatttccagctgtaatgtacaggtgtatctgtgattctcatgttgactggggattggatggctgtcagaataaaagggagtaaaagggaagtaaatttaaaggccttccatatgattgatacaatatttattcctacatttaaaatcatcggtgacactgaccttaacttgacagtaattattaactagtgctagtgtccttattgaccttgttatataaatagttgagaatagtttattatcagtgtgcgaattttatgtaactggtcattctacaaagattgagtgtgactgaaggagtccttaactttttgtgtttatatcattatttcacaaagcacactatccttaatatattaaaaaaaataaactgataagccttctagccaaattgccgtgaattcaaaattactggagtcaaagtagattactttttattgtattatatattttaggccatctcaaatcaccagaagttgacaaagattacattttaattcacacttgcaaagtagaataaaagggcaataaaaaaatctcatggttgaattcttttgtgtcagaatagtaagtaaggaagttcttggcaaagagagtaactatataaaaaaggatgaagtgaagtgcttggctggtagagaattttttgtttagagataaatactggacttagttaaatccagaaaaacagaatattttaggatgacagttgggtaagttagagtgagatgtcaatgcctttgaggtaatcattaaatttaacataatacgtatgattaattctaaaaaataatttgtactattatttaatttttcctactgcttgcttttcattataaacccattatgaactttagcagtaagaaaaggttttcctgcaagcaagatttaaaaattagaataggtttctaagaaaaattggacagtgtgtatatacgtatatgtgattgtgtgtgtatactttgttataaagtaggaaattaaatttaactacatttaaatagtctatgatagtttgtttcttatccaattctcttccagtcccatacttttgataattcatagatatcctccattaaatactatagcaattcaatacccagaggagaaaaagtgtgacttcctcagaggagaaaaagtgtgacttttcaataggttgtttcacttttacaattccatcctaactaaatactacattaacataaaaaactacaacaacaataattagctttttggatctaaatattggcctaaatatttagaataatacagtgttagtatctgtcttatattgtctgtttctctaggattgtgcctgtttaaactacttttggaaattagtaccaacctaatgctgttaataattatgcatgccatcatgtcatgatacctaatggaatcataagttaaagtctttcattcaattcccattaacatagtctatgcactgtctcatctacctaataagtctttattgccttctgtagtataactttggattttctctactgctaataggaaacaattacttccactaaattcacttacactgttgcattgtataattccagagagcactattgcatcattgctccccaccccaatccccctggtactgtgcagtacacagcctgcctgaccatccacagcagccatgacattgctttctttgcacaagcacagaggaatacaatttgaggtatttatgtttactatttagagacagacaattaattgacataggatttacataaactagcattttcataaagatccagaatttgataacatgacttagttaatataaatttaatcaatattcacatctgttttattctttggcagttcatagttattcctaaagtggaagcggcacttgggaatataaagatttggactttataatttactctccaaaagattatagagtttttactttgatttaaggaacaaacgtgaaagactttactggaatgtaaatagttttggcatatttacagtgcaatgttttcagttgtgaagttggttagttatgtaggcgggagctgtaggagttgtgatagtcagtatattacaagcattttgcaactccctgatttctctatgtttttaacaactatggtagcaatgcctcaaatttctgggatcctctgttaccccacagtggttccaaaagaactgattactttttcattaatcctcaagctatatgtgataaataattgggaggatggaaagatgatggaaaagaggaaaaaccttgaaagatcaactgattttgttaataccacacaccaatatgcagacccagctctgatctcttttttttctgcattgtgatatttgtccaattatcttgcttctaaaattcaaacctattatagccatttcattttctgcattttttctcatttcagtgtaaaggccttgtgggagaaggttttactttagtctttaacttggcatatggaaaaatattaactgctatgtgtataataattctcctttttttccttaaaatgctatttcctttgtactactaatgtactttgattggttgactggatattgagtgttaaactatagaagtatttcagaccacttgagtgatagctttgcttcattctttcgtgtgtttctatatggttttataaactagataatgctacacaataagggtttactgtgagccctcagtaaacccttattttgtagcatagcaaaatgtgctccaacaatgggggaggtatctggctttatgcatcccttccgccaatcaccagccatgtaaatttatacagtcacataagatttctgagccttaaattcctcatagaaataaaaaatacctgccttgcctatctcacaaaagtttgtgtggatcaaattatttaatgtacatgaaaaaactctttagaccaataaaatgtcatatgaatccaaggaagagaatgattgaatacttctcaaatgaattaaggtgacagttatcatataaaaacttcattgcttcaggtcactgagtaaaaataaattggtaactctgactcctacgtaactatccccagcactgttaggacagtgtatggcttaccaagtaaataaagaaaaccaggtaatagctagaactaagcaagaataatgaggtggataacagtagcctctcatttctttgaaaaatttatgttgtgctgatcataagacaggcaagtgctttagtaaaacatactcagatcttagaatcttaaatagttgggccgttgtcacacataagacccttaatgttacagactggagattgaatgggaaggccttaccatgaagctgtataacatggttttctgctacctacttaattcggcatgttaaatttaaacaaataagcttttagaaaatcatactaaagagtttcaacaataaagagaggctgactctcagaaatataagacaaccagatacagaaggcttttcaatattgattttttaaacataagaaaactttctaaggccatattaaatggttctccaataaagtgttttaatagctccagtaagaacatctgactggctgctttctatgtgagcaggacttgattgaaattgaggaaaagatgaagcatctttaagctagagagcccggagggtaaattattaaaatgagctatggagaattggggagagcttgcactcaaatttagtttttgagaaggaaaagtacaaatcattctatacatggaccaactcaattttgccacctgttactttaaaattttaacctgttttactttgaaaacaatgctaaaacataacttgatggactcatagtttgattcctactaggtcgatattgtgtctcagaattaaattgtccattaatttttattgtattctgtagcatcttccacctaatagtgatgcaaatgaattatgggtagatgaagtaattctaattttcctatatacttataattctcttgggcttccatgagcagaatatgtaagataatacatttgagatactgttatcagaaaattggggataggagagtacacatgaaaaaatgacatgtacatagtattcaaggatgccttcattcattcattaaacagacatttattgggtgccaaatctgagacagaccccttgctggtttgcatttaaatatatcgtgggtatttaatgaggaaaaaggtatgaaattgccaaaacaacttagagtaagtaacatcaagctgccctcatggcctttctatacttccgcatcttggtggaggaagtattagtgataggggctgtgaagggctgtggtatgggcatgcctgctccaagcccccagattatctggcagaaaagaacgaagagcaagaattaaaagccctccccaagggatccattcaagtaaatgttttagcaatgagtgagtgagatgatgaggcagtgtgggatattgggaagaacaagagttaggaactgggggaaaaaaaaaaaaggctcaaatcccatccatggcccctgcaaagctctgtgatgttgagagagttacatcgattttctgaacgactatttcttcattatgaaatggagtttaaaaaatacctactactcaagcttgcacacagtgtcccgcatagtttttggcccatggtaagtaattaataaatatgatgtaattaataaatatgactttccttattactgtattgacacaacaatatcagtagtatagtttgatgagcatcagatatccatagacttaaataacagacaaaatacatctccttcatctatcttattaactgtagaatttcttttcactcattttgattcaaattaagtatggaccatctgttccaggcttcaaaaactctttcaaatgagcagtggttttacacatgtcatgatgtgtaaaaatttagatcaatttttttagtaatgagtacagagtgtcttaccagatatcatttcctaaacacttagttgtatgagctttaagttactatgaagataaaataatcttcacagttaatgacaccgaacatgtgaaagtgctttgaaaattgtcaggcaatatcctaggtcacttggtcatctgactccataggaaaatatggcagcaacagcttgctctaaccattaggggaaaagaaatacaatataccaataggtatattggtatattggatattgtaaagcaaatatcatgcttcacagtagtcagctgagaatgattcacaggcaagctttgacttgaggttatgggcatttctatacaaaagaaagtgtcagtcagtagagagttagtagcaatgaaaagacaaaatggcaactttgtgagggacgcttgacctctagtgccatctggagtgggggacagggtggatatgaccatttaaacatgattgaatttagaaagtatttcctgataatgtcattattaggaaatactttaatgtagccattaaaaccatccacttaactgggctcggtggcatgtacctgtaatcccagctgtttgggaagctgaggcaggaggattgcttgagcctagaagtttgaggcaagcctgagtgagacctcatctcaaagcaaacaaaaaatccacttaaccccatctgcaccaagaagtttccgattataatatagttatgaattattagtttgcatatggtccaatgaagtatctggtccacttgaaaacatttctatttataaattaatgacttggcattgtgatcttaatgtattagtcttatggtaatttgattatatgcagattttctcccatggatgaacaaccaaatttccaagcccacagagttgaggaacagattctgagaaatagtgatgtcattataagctaagggagactatctggggaaccaacctcccccagataaccttgctgaaaaccttctcattcaaaatgaagctattatatcctagactcaaataaaatgattgaatgtacatttgattttgaagaactcagcccaagggaatttgaatcacttgttagtctctcactctgtttgtaaaaatgtatgactaggaaatctagattcccttgggtatggtgatgatttctgaggtacaacactaatgacatgatccaaggaagaaaaaaaatgataagctgaactttattaaaatagaaaaatgtctgctctgtgaaagacattgtcaagagaatcaaaagatgagccaaagactgggagaaaatatttgcaaaagacatacctggtagaggacctttatccaagatatgcaaaatgctcttaaaactcaagtataaggaaaaaataggacaactatagttaacaattattgtttatttcaaaataacaaaaagagtagaattgcaatgtttctaccataaagaaatgataaatgcttgaggtgatggatagcccagttgccctgaattgatcattacacattgtatatgtgtaccaaaatatcacatgcgctccataaacatgtattaatacaactattatgtattcataataattaaaatcttttaagaaagcaaacaaaagaaataaaataaaccaattaaaaatgggtcaaagatcttaacaccacactaaataaaatatacagatggcaaataagcatatgaaaagacgcttcatatcatatgtcatcaaggaaatgcaaattaaaataatactgagataccactacacacctattagaatggccaaagtccagaacactgacactaccaaatgctgacaaggatgtgtgacaacaggaactctcattcattgctaatggaaatgcaaaatggtacagccactttgggggacagtttggtgtttttttaaaaacaaaaacaaaaacaaaaaaaaactaaacatatacttaccacatgacccagcaatcacactccttggtatttatccaaatgaattctcacagaaacctacctactgatatttaaagcagctatatttataattatcaaaatttggaagcaaccaagatatccttcagtagataaatggataaataaactgtaatacagccaaacaatggaatattactcagcactaataaaagagctctcgagccatgaaaagatagggaggaaacttaaattcatattgctaaagaagccaatctgaaaagactacctactgtatgattgaaactatatgacatttgaaaaaggtaaaactatggatacaacaaaaaaatccattgttaccaggggttcaaaggagagagagataaacaggtagagcatggataatttttagggtagtgaaaatactctgtatgatactacaatgttggatacacatcactatacattcttccaaacccatagatgttcaagagcaagagtgaatcctaatgtaaactatggactttgcattattatgatgtgttagtataagtttatcaagtgtaacaaatgtaacattcttatctccccctaaatgttcagcctctttagtagaagagccatgcctcacttagtttttgttttgtaggacctagagcagagcactcaataaatgttttttagttcatttatcaaatagttattccattgattaatcaagcaaaagaaaactgttcacctatttcagagtgttagtctcagccatttgttttatacatttcaaagaaatgttacttaccatatggtccagcaatctcattactaggtatataggcaaaggatgcgaaatcagtatgtcaaagagatatctgcacttacatatttaatatggcactatttacaatagctaagatatgatctatcaatggatgaatggatggagaaaatgaggtatatatacatgatggaatacaattcagcctttaaaaagaaggaaatcctgctatttgggataacatggatgaacctggaggacattatgttaagtgaaataagccaggcacaaaaagacaaatttgcacagtgtcactgatatgtggaacctaaaaaagttgatctcataggagcagagaaaagaatggtggttaccaacagctgggacagagggggtgggggtggagtttgaggagatattgttcaaaggatacaaattttttattagacaggaggagtaagttcaagagatctattgtacaacatggtgactataattaataatatactgtattcttaaaaatgctaagagagtagattatatgtgttctattacaaaatcacgagatatgtgaagtaatacatgtgttaattctcctgatttagccattccacaaggtatagttgttttaaaacatcatgtagtacatggtaattatgtaaaattttatctgtgattttttaaaaaataaaataaaacatttttaaaagaaatgttacattacaacctctaattgcttccacttttacatttagctaatttcacaagctgcacgccatgtttcaaattggttttcttctagcaaattgtgcatgtgtgtattctctcagatatgaccttccaggttttagagtccactatgtcaagaagtaagacatattaaggaatctgatcttggtaaaaatttccagagtctacctacttgtcttttctaaatttgtttaatcagatggaataaattagagaaaaatactggtcgttttgtgaatttttaacaattcctttgtcttttttgcagtatttcaattacataagtagtaaaatttgtgtttatatgttaagttgcctgaaactgtggaaaatagacctatttttatttatattaagagtttttgagatttcttgtttcaattttcatttatattcctgtttaatttacatgcataaaatgactcttttcgtcttgtcatttgttatttaggaagaagtaaaatttgtgggtttccagtatagtacagcagttaaattcatatgcagagtaacttactgaaatgacaaggtagatgttattgtattataataagttataataattatatggtaataataccttcaacatcaatgtagtttttaacctgaaaaattttgaagttcaacgaaacaacagctttgggtaatagtgggtaaatatcccaaatattgtgaggccttccttgaatattaatccagacacttttttttttttttttttttgagacagtgtctcactctgtcacccaggctggagagcagtggcaggatctcagctcactgcaaacttcacctcccgggttcaagcgattctcctgcttcagcctctggagtagctgggattacaggtgtgtgctaccacgcccagctaatttttgtatttttagtagagacggggtttcaccatgttggccaggctagtctcgaactcctgacctcaggtgatctgcccgcctcggcctcccaaagttctgggattacagatgtgagccaccactccctgatctaaaccaggtatttcttttttttttttttttatgctgtttattttttaatttttatggatacataacaattgtacatatttatgggatacatgtgatattttgttttttttattatactttaaattttagggtacatgtgcacattgtgcaggttagttacatatgtatacatgtgccatgctggtgcgctgcacccactaactcgtcatctagcattaggtatatctcccgatgctatccctccccaccccccaaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttctggctgcatagtattccatggtgtatatgtgccacattttcttaatccagtctatcattgttggacatttgggttggttccaagtctttgctattgtgaataatgccgcaataaacatacgtatgcatgtgtctttagagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagttttcctatttctccacatcctctccagcacctcttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctttttagtttaattagatcccatttgtcaattttgtcttttgttgccattgcttttggtgttttagacatgaagtccttgcccatggctatgtcctgaatggtaatgcctagattttattctagggattttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagttatgtggcattatttctgagggctctgttctgttccattgatctatatctctgttttggtaccagtaccatgctgttttggttactgtagccttgtagtatagtttgaagtcaggtagtgtgatacctccagctttgttcttttggcttagtattgacttggggatgcgggctcttttttggttccatatgaactttaaagtagttttttccaattctgtgaagaaagtcattggtagcttgatagggatggcattgaatctgtaaattaccttgggcagtatggccattttcacgatattgattcttcctacccatgagcatggaatgttcttccatttctttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttaaccaggtatttctaatgctgctgtgtgatttggcagagacgggataagccctgagagagcacaccccagcagtaccctcacttgggtgagtttgagcaattgccaggaaagctcagcattgtaagttttcccaggagatagatttcctttaataactatgatatgtgccaaaaatacaaacatttgatattagtgtatctgacatatatcatatcttatatgtagtagatactaagtaaatatttattggttgcttgattttgccattttgaggactgtattgatatgtttggaatattaaataaattagtgatgatatagacaacacaaaatatttatatgtattaagggaattgttctgatatggtttttaaaaaaatttcaaaaactatttcattttttgaaatagtcttctgtacttatcatgtttagttttatgaaaaatacttgcattctgttggcttgagttttgtgggctttattaacaagggattcttagtccttttatgtgctgtgattttgggaaaataatttaaccttttctactgcatatatttctcacctatcacataacttttttcctgtacataaggtgatcatataatttttgtccagattgaaatagttcagagagaatgaagtattattaaaaattataccaggacaactggcttaaattaaaccatcccaggcaaattggaatgtgggatcacccaaccatagccccattttcattaaataccacaaatctttattgagtactgttatttccaagacattgtgtttcagaccacagatttttaaaaaggaatacctttccccttcaccagccatcttcgccaccagccagcagtgttctgctttgatgtagtattttatttgtttttctttcaacaatacgttacctgcttaaagtatttgaaagccactgatggattagagtgcaggaatatggtcagtgtcatgagagagatttaaaatgctatgataaacagaggtaaaggaaagcatgtcttgtggaaggtaggaggatgcggtatttgattgattgattgattgattgattgatttttgagatggagtctcactctgctgcctaggctggagtgcagcagcatgatcttggctcactgcaacctccgtctcccaggttcaagctattctcctgcctcagcctccctagtagctgggactacaggcctgcgccaccacacccagctaattttgtgtgtgcatatttttagggaagatggggtttcaccatattggccagactgatctcgaacccccaatctcaaatgatcctcctgcctcggtctcccaaagtgctgagattacaggaatgagccactgaacccagctggatgcactattttaaaagagtgctttttaggatgatccttgagggatggtgagaaggactgaagatggaaatgtaagtgggcaagcaccccggggaaatatctctggccaagagtaagccttctattctgtcaccttggcttggaaagcacaagagaaggataagatggatttggcgtgtttagcgtgtgtggaggggggagctgtaggagataatgccctatagcattatggagggttggtgagccaatctgagggatatatacatttatatatttatatgatttatttgttattaaacaaatgatagtgctcagccccttcgcttgtcctgggtgtcctatctgcctttatactgactagtgtaatctcaatctggggttatcattcatttccctctgctcttttcagatctgcttcctcgacgctccgctcaatatgcaggcatcctgatttctactgacttgcaatgtgatagtcacagactttctcttgtctgcctcctttctgggaggagttatctctgccaatcttacttagatactggccttgctttcctttctttttcattttcttctgacttctaatttatctttgttcttccatgagtattcctctcaacagtttttagttgacattttatttcatttaacacacctgtaattaatatgtatgtgcagacaaacatattcatttgcctacagacaaacacatacatatacccatacaccagtgtgagcatgttgtttttccttgtttttaagtaacctttattttcacattttaactaatctgaaatagaactcttttaaccaatacataccattaatgtggtgatatatctcatcttcctaatccccataaaaacttcctatatgatctgtggcattttagaagtgtgcaaatattggtagtgtgaaatttctagttttcaagcctgtgaaagcaagcagtggctagttgaattatgtgtcacacactttgatacacttctgccgggtgaggaccagcaatatggtggttagaagaaccacctccaggggcacatggtctgctcctaatgtgtgtgacttctggcaattgtgtcaacctcatgtgcttcatttctttcctgtaaaatgaagctaggaatgagaaattcataggtatcaattgaggtggtttacgtgagtgtttagatcaatgcttaacacatgctaagttatctttgtcacctttagtatgttacctctcaatttaacaatgaaaaataaatgaaaaaaacaaaagtgatataaaatgctatctggctatattttattggacacaccagaggttctcaaactttctgggtttatccttatctcagaattttgtatggggcccccaaactaaaataaatacctaacattttgtgtatgaaataattaggtccagacaactgaaagataacttttgcctgatgtccatctgatatcaatgtgttttctttgaaaatttaaaattcccctgataccctgaggtgcctgggtcacagtttgggaatgacagaggaactcatttgttcagctcttactttctgactgctatttaactcatccaactttcagcaagtgctatgtgttgctaattcatgacttccctgtctccaaaacattttgatctctttagatagttagctcagaaggccctcagatgaaaactttaaaaagaaagctaaaacttcgggtaaagtgttgttttgtgtccaatagcctcagagaatctaaagcaaaatgggaggaaaataagagactaaattctcagtgtgttcactatatcagttacagttgcccttaaaacctgggaatacctgcttttatggttctctgaggttctttggcaggcgtaccaagtaggagctacttgaaggtcacctgcacaatgatgtgtgtaaaaggaatgtcttatgtttaccattcccccctccaggctctggaaacagacagcaatataacattaacattgtctgcttactgtctttcagatcctttacaagcttttaagttactgtctacaggtatttggggtataagaagctgattaggtctttgggataagaagctatgcctcatacaccttaaactctcaggccaattaacctctcaaatagtatatgttccatattaatgcttaccaaattgtgttaagacttcaacgaactttcaccagtccagaatcctaaataggagggtctgtgtttatgaagatctgggggatagacagggacacaagcctttatatatgaactgatgttaaaaaatattttttttctaaaatgcattgtggattttcccacattctggaaagctgtagttatatgtacagaagtacctggagtagaccttcaggctaggagacttttttttaaaaaaattgaactagtattcatagtaaatttttctaaaatgcattataaattattatacattcttaaatgctacagctacagctatatgggtagctaactggtggggaccttttgggttaagcaatgttgcaactatattacaatttagagaaaagctattttagcctgcagaaccatattgcttgacatgcagatgttagcatgctgcctctgtcgggttccagtatgcatttgtcatatacctgtattccctgcaggtgtcttctcattcctccttgttttcctttgagtgtcctccttttatctcttaccttttcccttcttaactcattttacacactttgttaccaccatagccaagaccatggtctatggaccatctgaaaccagacgggcctgggagcctatttaaaatgcactcccaccaaatcagaacctctgaggatgggccccaggaataagcagtgtaattaacttcccgtttgattctttcatgcttatattaactaacaatgtcgggccacactgaattctccatttgaaaaaaatacgtttttgctcttttgggactctctacacatgaatgtgtttctctcccttcctgagatttcactatcttcccaagccatgcttatgtcttctgggggcttaggatcggctaattgaatatcaaggttatacttgtttacattctacatttatatttatggttattataagagaggatattgaaagaaaaatggagctgggaatgaaggctaatttagtattacattaccaaaatagctctgtgaagcagtgtaagctaaaggtaaggacacactcttagaaggctgctttctgaactgggtatcaaagtagctctgcaagtttacatggtcttgactaatatattcaaccaccctaagcctcagttatttctttataaaaaggagatgatgatacctaccttgcatagtcattatgagatttataccagaaaatgtttgaaagagtttaaatctctgaaaattgtaagcatgttattattactaaacccattttacagatgagtcaaccgaggacagaggaagtaagagaacatgctgcagttcatagctcataaaccacaggaccagaaggcacctttcacccctacctgcccccttctacaggctttttcttgccagataattcattgccctctaggagctgaggattctgtagcatcaagtttttgcagtattaagattttagctctttttgtttcagtttttgtagcatttgatgaaaacttaaagctgattatattgtgtgtggtctcactaaaaacagtggcttttccctattttttaaagaaaaatttatatttgacgacctttcaccacacacacagtaggtgtgcactgtaaggaatgaaaggagccctgaaaatgatcccagttcccttaaagcctgaagacaggtgtctgtaagtcctaaccctccccaactcccatcagtatcctgacttatccacctgcatctacagtatgtagttggcttatgaatattgactgggactaaatgaataaatattgaatacctactatgtgcaactatatagtcacttataacagtgcttctcatttatatataaacaaatcttctgggaagtgatcaaaatgtaaagtccagttcagtaggtgtagaatgggacctgagactgcacttctaacaagctgttagatgacagcagagctgctggtctgtggacgaggtgattctggtgcacatttaagtttgagacacgctgtggtgtcccattctgccttttaaatctctgtgtaatactttttggcatttcttcattgttcatttgttatttattacttacatcccccagtagaatttaagttatatgagagcacagacgtttctaccttgatcatcactgtgttcccagcacctggaatagtgccagacacgtgtaggtactcacagtagggtagtggagctgatagccgatttgcccctgcacaccactgctcagtaatatttgtgattcagtacatgagtaaatgaatataggtattggtaatatgcatagatatataatagttatctattatttaatatacatagatatataatatttatatattgtttacataatccacataacattttgaggaatctattatcaaccacagtttgtaaatatgcaataatatgtgtctatttagtattacgggcaaatacaataaaacttactgaaatcaggtaactattgaaagtgttaggaatgaagagctagagcttgcactcatcctggaagaagacaggcaattctataaatagagagagaaaaggagaagagggtattccgtgtagatggaatgtagtgggataattttctgaggttttattcttaagttttattcctcttgacatctccatatttctgatcaattatccagttccctagttttcctgttgtagggaattttgagtgcaaaaagcagaagttactagaagtttgttctttctacgttttgtaaattccaaaatttgctgaaattatgctgtgtatcctggggtaagatagaagagagatggcttcttttgcagacagctagtggaaagagaaattttcccaagacagcaaagaattcggtctgagtgagaggatgataacttcaaatattaatcctttctgcaccacaatccccttcagcagtttgatgaggatgtcaaaggaagcattatattaaaaattgtttataaaatactttagagattggaataagtaacttgtgtgtttgtttattaattcataaaatattaatatctagcagcagatcaagtaattaaccttcatatagtgatgagcacagatttttaactataaaattatataaaaatctgctttttattcactgtagatttatagttactactaatactattgtggttcattatctgcatttataataaaaaataaatattaaattttcagttagaggttaattaaaaaacggacattattattttcctactcaagtccatggacccctgaggatggaccccaggttcagaagaagggcttgtacatcactttgaggcagtgcatatcagtcaggatagtctaggtcagtggttctcaaagtctaatccctggaccaataatatcagtatcatctgggaacttatcaggaatataaattctcagttccaatccgagtgttactgaaccagaaactctgggagcaggaccaagtaatgtatgttttcataagctctccaggtgattctgatacatgctcaagttttagaagcactaagctaaattatacttttgtaaacaaacaattaaaaaaaacagcctcaaatctcagtagtgtaaaatacatggtttattttccatttgatcttcattttcatcacagatagtatggacttattctgctccatgtctcctcaatccaggaacctggttgacagaacagccatcatctccaacattactagtactataccaggatagaaagagagctggagagtctcacattggtgattcttggtgcagaagtgatgcatatcgcttctactaacatctaattggccagagctagtcccatggttccagccagtaactacaaggagaggaagggcctggaagccagggagctaatgatgactaacacactatcaagatacagcaagatctcagagaagatggtctgctaatatccctagggagactattacagtcgcacttatgattcccttgcttgcagcaggcacagaaacagcagaatcacagccatgaaggatcagctgagacagtgggtgaactagtgtggcccaatgtgttccatgcaatctgtgacggaggtagaccaatgtaaaccaaagactgggagggtcaaggaagggggcacttccttttgctttagagatacttaagatcctgggatttttgcaccattctgggcacgggaggaaagcacaaaagtgattgagattgaatttcctgccacaggacgctcagtgttagatttaagttgattcagagaaatgtgatatttctgacacacttcaacacggggagaaaagttcatatccactagagctgttatctgtgtaaagtgcactagttcagcacttaacatggggcagtttagaggaggatttcataaatgcttggaagatgataaactcttcatatactttaacactaaattgacatattgacttagaaaagcctgagacctataatttttgtaaattcatattggggattcaattaatggagaaatatgagtcgttggtagttagtcactttttgtgattgtgacagttaattcatttttatctattagaaaattttacaggcattcagctagtatttttctgttatataattttccctgcctgccttgctttcatctcaaaataaagagaaggtattagccacgtagtgatgagaaagtagtcatagtaaaaattgaaataatacagtcttgggaaaatgtctggctcatgtggtgaaggttttattacttcacacttttggaaatatttactggagtcttagccactatgacaccataaatgtgtatttgatgaagatcaaaatctacctctgaagtgcacatttgtattgaatgactctgatgtttgtttcagttgcattgtaatgtgtattagatgattaaacccctcttccttgggggaaaggtttatggtagaaaaatttatatggtcaccatatgtgtgtgtgtgtgtgtgcacacgcgtgtgtgtgtgtgtcttcattgcatgtcagagagtgaggccaaacatatgtttcaccttctcactatgaaatatggacattttaatttctgcccacttgtggccctgtttttttccccattcttaccatgtatgtgtattgctcaggaaaactgatttatgggattaattaatgtacttttaactgggttcaaatgtactgtctcatctctgacttttgtatgtttgacttttgtcttctgattataattccatgctagaaatttgcttatagtcgtccttaagcaatagccaccaaaagttcttatggagactcctggaaatatgcttctgttgtttgctataaattacatttcacaatattgtagtaaaatataattttaggaaagtggtacaattgcatgaacatcaagtatctacacttattaacaccaaacatttttctcaaatgtatttttgaggtttattgcctagataataaatctatacatggagtattcctttaaacataaatcccaaaaccattttgctttgcaaataaatcaatcaagcgtgtgactcagatacaataaaaatatatggagggaaatattatatgtgataaatagtaaaaattttgcttactaatgaagaaatttcatgagacaatttgcagcccacatattgtagttttgatcaaaaagctttatacgaaatccagaatcctttaaatcacagcatggaccatagaaatgtgttttatttaagagactttaattcaagactgttgttttaaatcatgattgcatctttatgtttcattcaactcacatgttaagctgtgtgtgtgagtgtgtgtgtgagtgtgggcgtgtgtgcttgtaagtgcatgtgtgtgcatgtgtatgtgtaaattacatgatgcatctgggcactcattgcagtatgtcacttaaaaactttaaaaaaatgtttggagttaattttgttccaagataattttatgtgccattagttcatctcatcgtcttatataacaaggaaccaactgatgcaggttttacctttttagctaaagaattaggagatggccgggcgcggtggctcacgcctgtaatcccagcactttgggaggccgaggcgggtggatcatgaggtcgggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaagaattaggagatgtttaaatgttatatcctgttttccttgacaactataattttgcttgggagatgattaccagaatgactgctaaattactatttttctattggtctaatattttattcttatgaaaaatgttatttctagtggtctttattgaagaccagttgatgagggtcctcctaagtcaggggaaagagtgtatacgtttcatgtaaaatatccttcctctttgtaacccaaacctttgtatagcttggtttctctttcttagtctatgttgacagcagtacaaatagcataatagattcttctctgtatatttagagggtttttttccataaacttatgtgatactttgcttttactgtgtaggaatgatgaaaacacacaacagacccaccaccacctccaaaattgctgctgccattaatcaactcagtgcatgacagaaattatgaacaagtttcacaattttctcttttcttctttgacttttgaataactggtagagttttattctatgtttcatgtcacgggagaaaggaaccacaaaaatataactaatatgagataaagcaatatttgggttctgactccagcaatacccttgaagtcaaataggagcatgtgtggtagaaaaaagacgtgttctccccctaaaactctgacttgcttgtcactgtctcagcagtgacttgcaattgcaaatcattgcctgaataattaagcagcatttctgtggcctgtgacgctgagaagtgaatgctaaatatgtagtcactgagctttcatttgcttactgtgccaaaagccagtgacccaggaatcacaagtgactactgtctagctgctggctgtatgctgtatggatttttgtgctacaaatcatcatcaagtgtagactacttaaaggagctcctgtgaaattaccaaagaaataaaataagttagtatagtcatcaaggagaaatatagcatatattatactgaaggaagagaaagaccctctcatattattttatattgttttatactcagtacctgttttaagaaaaaacaacaaggaagtaaaaccaaagacaggcagtccggcgccaggcccgaaaccaggcctgggcctgcctggcctaaacccagcagttaaaaatcaactcatgacttagaaaccgatgttattcatagattccagacatcgtatagaagaacattgtgaaactccctgccctgttctgtttctctctgaccactggtgcatgcagcccctgtcacataccccttgcttgctcaaatcaatcacgaccctttcatgtaaaatctttagtgttgtgagcccttaaaagggacagaaattgtgcattcagggagctcggattttaaggcagtagcttgacgatgctcccagctgaataaagcccttccttctacaacttggtgtctgagaggttttgtctgtggctcatcctgctacaatacattgaagcgttacatccaagatgtcaatcttttccctgtatatttaaaatctctgcagagaaactgtcattttttaattatagcaagtgcataatgttttccttttagttaatgcagagtgaaatatgtgaatgtgcaacaaaattgctatatcatctaaatgtctgttctaagcactggggataaatcagtgaacaaagcaggcaaactttcaactcttacatcattagtaaaagggttaaggtcacagatgattcacaagaaaatgtatcattgataagtcgtctgaagaaaacacaaaattgggtgatggagagagttgacaaattgaagttgggtgatcaaggaaggtctttctgaaagggaattgtgagttgagaccagcatgacaaaaagccagatgtgaaattttagggaagatggatttcaagcagaaaaatcttcttgtacaaactcatacaactgcttctttgttgtttttttaagggacagagtctccctctgttgctcaggcagtgacacaatcaaggttcactgcagcctcaaactcctggactcaagggatcctcctgtctcagcttgccaagtagctaggaagacaggcaactgccaccacgcctggcttgaagttggtgcaatttctcagaacagaaaggaaagtgtgaacagaacagagagagggaggaggagcatagagatgaagccagtgaagtaggcaggggccaggttatatgggatcttgcagagtatggtgagtggtttagaatctcctctcagtgggatgagaagccaatggagtgacggacacgatctgaattatgttttttaaaagcactttgctcttcgtttgcagaatggaatgagtgagaggaaagagtggaagcaggagaaggaagccacagtggtatccaaaagaggaaaagtgggttagcctagggtgatagccagagcactcttttaggagtctcccaatgatccttgttctgaaatgcctcctgcctctgcagaacaaaatcctttccatgtaaatagttcgtgttttaatgcaaatgggaaggatggtgtacttcctccacatctgtttcctgttgcagggcttgggactgtcagtgctttttctccacatggaggttattttgaaacatccaggtggttttgatcaaatcatgtattcttagaatattattcttaagcttcaataataaccctacagatagaaagattaacataaactgactaaagaaatgttaactgccaggagattaaggcaatatctcaattcataatctatagtactttggggttaagctttgacttgcaggatgtaatttactgaccagtaacaaagactccacctagctggaacctcattccagaaatgtttcttttgataagattcttagatactgaaacatcatttttaaaaagctgtgctttgggaaatcaatttgggggattgtatcaggaattacaggcagcaatagcttcataaatgtgcaacccatgcagcttcccagggcctgtgcttagcaaggcttcacacttggtttaatgctgtgccttcattgtcttgaattcctaataattttttaacaaggggcctcacagttttcttttgtaccaggcaccacaaattatgtagccagtccagaattcagggctcaaaacactctatgaaaatctgttcgtctgctataagatatagaaagatagagacaggaaaggagcagacttgaataaaggaattctcagaaaagcaaattcatcaattataaaatttgagactttttagtctagtggttctcaggtgcctgtttacagtccatgcccaccagatttttacctctccatagcaaaatcacaagaatgatgatgccattgggttcttattttttagctaaatgtattcaactcaaatgtctgctctttattctgagattagattcacctataatttttgctgtaaaaatattttcgttttatataataacatgttggcaataggtagaagctttttctttgtatttaaagtaccttctgtaaaagaaaacttgaccatctcatttcagctcaatgcttcttggcagaaaagaagaagtcctttatcccactcctgtacctttacctgttttttctaatcccaggctcacttttctcttattgtaattattctcaataccaatgcctcaccattcacaaataactaaactcagttttgtacaactgagtaaaaggtaatcagaaacaaatccacacgaatattagaacttctggcaaggcaaaattgaaattggggaaggattaccctcttgcaaccaaactacttatctttttttatagttttattttataaatccatcctttttatgccccaaaggatagcaacatttttcttttcatctttgtgtctccagcatttagcacagggcattgtactcaataatccttcaatgaatatgtagaaactaaataaatataaataaataaaaattttaaactagaaatggaaggatgtctctcttccatttacaccttctttggcagtttcaacccttccttagccagagaacaataatgaccgtaagaaatgttaataaagatacactacatctgtaacaggaagttaaaattagacattttctctatttcagctaaaactgagaaggtaccttttactccctcatttcaaaatgaggcatgagcccaccaaataaagccttgaaaagctggtagacagggactgatttcatgacccttggctgaccgcccaatacaacagtgtggagattagagcaaggttttcagagagggctgttgttgatgttctgggaatcctgtcctatcccaacccttaagggtaaggggtgagggatgcctttaccttatcccaaataggtaagagccttcattgaaacaaaccaaagagcttgggggaaacaatggcttagactttgagtcaaatacgagaaatgaaaagggggagagactacagctgcttggagacctgacaaggggatgtaaagagctgccatccggtgagtatgctgaaacctgcggggcaaagaatgtttcgtgttggcaagatgtggccttacaagagagaactggcctgaaagagtcttggatcttgtccagaactgtcctgcaagaatcttagttctcttctacctgggggagggaggtaatgcgagcagaaagaacatggaggtctactgtcagagccctgggaaggagctatgagtgaccagtgggaagagctgctttcagtcacaaagagcaaactacagatatctctctagtgaggagaagacaaagaactcctaaaatatcccacccaacaagagagagtcagctttaaacacctaacaaaatacaaagagctgatgccagcaagtaagatccctggaatctagtacagtgctttgaacatagaagggactcaacagatgttggggaacacaaagacctgttccctcgttgggctaatgttgcaggaatgattctcagctttgtacacatgaaggaattatgaggttcaggttaagtgcctcacttcaaaatttaatttttagtccagaccagtgttgttttaattttactacactcacagttaagaggagtccagaggagcacccttgaaactatagtgctaatatcaagtttgtgatgtagagcaactaagtgtttctgagagggcttcaaggcatcctttcctgtgctgtttttacgttccaggttattaagcttatcttaggtgaagtcaagctttaagtggtagttactatgtgcctggcagaatacagggcactgaaggctcaaatgagaataagacaatccctgacctcaagtggctgatagcaaatggattaaaggcaattgtttatcatttacttaatgtatagcacgagctcaagaaatcttacatttctatagttacattactgtcactataacattaatagttgaactaggcttcccaacagatgtaaaagccttctaatctagagataaataaagattgtactttttgttatcatcagattttattattctttgatgatgattgactaaatatactaatgaggattgaaaaatatactgctttaaatagttatgtcataatttctatcagtcatgcaattagaagtacatatatggatacatattttttctattgccccttttttcctggctttgttaatgtataatatattgcttttctgcattcactctccatttgatttttctcctaatgtaatttaccacctgcagaagtatgaggcctggaaaatgcaggtgtgaaatgctcattagcacaataccaataaatcaacacatgtttaaaagaatcttctacctaaccctatttcttaaactgtgtattcagtcataattttcagatttaaaaattggtccaggttatagatcaggagatagctgtatttttacataactattaggaatgctgtggttttctaaccagagaaatatgacagtaatttcttgcgaaagatttgggacattgtgactgagccaaactaagaatgaaagaagatggagaaaataaacataaccacatgtcctataagtcttctgtatgaagacaggtgtgaagcctatgaggagggggtcattgattcatgaactgattgattcactcatttattaattcatatagtatatgtttttggtgtgcatataattgcaaagcactgtattggatacataaaagaaatctacttccttttgaagtgacttctaaaagacactccccatcagagtgtctaatgaaatgagagagacagaacaaagtggacatgaacaaatctgttggtagactttatgataaacaccatgagaagcaaatgagcagaatgcagtgctaaagagtaacctggggtgaagtgggagctagggaaggaggatgagagacaacctacttaaaattgtagggatggtctttcagaggagacttaaaaaataagaagcaatcagcaattcaaagagcattccaggtggaggtaagagcatatgcaaaggccctctggacagaaagagattcacatatttgggaatcttgaaggatatcaaggcaactaggacatgggcaagaaaagtggcccaagactatcagggcactatggaccattgaaagatgcttagaaattcatccaaccacagtggaaagccattcagttctttaaagtcagagaacaacccatttgcttgatgtttaaaaatgcttgctctggttgctatagcagagtaggtagtaggggaccaaggtctaaccagagagagcagcatggaggctttggtaacagtcgagagaaatgatgactaggaaatgaagaaacttaagatataatttggaggtataatagaaagggtttattgatgaatcagagttggaaagtgttacaaaggaaaggatgaaatatccttcaaggtttctgtcatgagcgactgtgtaggtgcctgctggtgccatttccagagattgggaagacaaggaggaaagtcagggtcaagtttagaaatcaagaatttgttttggacatgttaagtataaaatgtgttgcatgtaatggataatgccaagtagctagctgaatatttaagttccaagtgttgaggaaaactttggaggtaaaaacagagagttttggccaggcgcggtggctcacgcctgtaatctcagcactttgggaggccaaggtgggcggatcacgaggtcaggagatccagacaatcctggctaacatggtgaaaccccgtctctactaaaaatacaaaaaattagccgggtgtggtggcgggcacctgtagtcccagctactcgggaggctgaggcaggagaatgttgtgaacccaggaggcggagcttgcagtgagcctatcacgccgcagccctccagcctgggtgacagagcgagactccatctcaaaaagaaaaaaagagtcttcaggatataaatgtttaatcccaaagaaatagactacaatatctagggaaagagtgaaaatagagcagagggaggcccaactggaccaagtggattaggcccctggatattccaaaatacttagggattgaatcaaaattacaaaatatttagaggtcgaatagaaaatgaggacttgggtcaggtgtggtggtttatgcctctaatcccaacaagttaggaggctgagatggaaggattgcttgagctcaggaattcaagaccaagctgggcaacataatgagaccctgtgtcttccagaaaaaaaaaaaagttgggcacagtggtgtgcccctgtagtcccaggtccttgggaggctgaggtgggaagatcccttaagcctaggagttcagaggctgcagtgagctataacagctgccctccagcctaggagacacagtgagagcctgtctcttaaaaaaagaaaagaaaaagaggcttattcaaggaatagtgaaaaagggaatatttggagaattatgtcagggaatctatgaaagtagaatgtttcaagatagagggagtggttaaaaaaagttgagtatttatatgtgccagtgtgtatcatgctgaatactttatctggatggtgttatattatccctcctatagactattgagttgagtactgttattagatccattttacaaatgaggaaactatggagagattaagtaatttgcccaagatcccataataagaaggcaagtgtcgaatgccaggcattctaacttcagagtccatagtcttaacccttgtgctattctcttccacaaatacacccagcaggtaaaagactgagaaaaataaatatcaaaaagtaccttttgaaattgactacatgaagttacgaaaacctgagttgttttgtgaaagcggtgagtacaaagcagtattttggagagggttgtgcagggaatcggagatgaagctgtgtgctgaaaaggagagaagaaattagaggaagggaatggtggccttacagagaaacagacttgaagtgatgtgaagtgtttgcgctgggtgaatgctggcaggaataagtgagcagggagcgagtgaacaggataagagagatcacttcggagtaaagccttgaaaagggagtgtaggaggaagtttttctccctttcctgcatcccttcctttgtgcgtaaaatagaaatgttcttcctttctgaaggatttcaaagagaatgttggcttttctttcattctccctgactcatgcctccccagaggaagaaaagtgacttctgaggctgtgaaaaggaaggactctggctgcatgacccagcctcctctggcttcttcttttgggacctgatggccctcagcatgtccatcttaactcctgctccccctggggcaatctcaccaggacactgcttctccaagtgccagcttggggtggggtccttgccccctgtgtctatttctcaattagttcaggacttacagaaggaagagagtggttagtacattaaaacccccagtataaagagggaatgcaattaggtttagagaacatgtggagagattggctttggcaagaagaggatcatgttctcttctgtaatagaaagaaaagttttaaaataatggggaaagataatgtttatagagtcactgctgagaagaagaaaagtgatttctgtaatgtaatttttaacattttataattttttttctgaataaagtctgaaatccaacttggttgtattgggagcactacatagctttcatgtgtgaagccactatcatctaagcagaagaaaactagaacagatacacctagtgattctcaaactgaggaagaggatgtggcatgccctgtctagggtagctaatccgaatttcgatagggcagctttcaaaagaaatcatttcaatcaacaatgtaatcagtaatgcaatcgtacatttttaaaaaccacaaaatgtcatttttacttaaaacatttataatgacttaaggatgttttatattcatcaataggatgatttagtttgaagaagtcaagaaacaatgggttacccagagtgttttccacccaattcctgaattaaaatgtagctaagaatcatattttctgtaccttcttttcctgtcttttgtgtcttcttttggggaaagttaagagggtagatcgttggactacattgtcattttaactataaaccactggactttggcccagattattattacctgcagaagctatcttgattaagtttggagttgccttatgttgtgcataagcaaaactacattttaatcagcttgtccatatgatttatagagatagtttgtaataggccttgttaaaaataggtatctttaatcagcaatattggataaaagcctaaagtcttaaaatagtcatatttattctgattccttcttcctaaaatgaataaacagaaagaaatcgatgtggcaatagcgtgttacaaatcactccatcaaaggtaatgaaattaaatttcatctctgtgagttactgcaaaagactgtttaacatttacaagaatttgacttccaaatccttcaagccctaatctttggatttacataatgtgttcctactttcagccttttccagttgaaagactttgaagttccaaggcaaaaactgaaataaattggaaatttgtgtaatttcaaagtgaatgcttgtgatatagtgacataatcagaaagcacatgagggaaaacccatacaaattttgctactattaactcagtgtttgaaactttatagtagaaagatgatatgcaaaattcttaaagattgctccaaggaaacatgctacatatttctaatcaataaaattaaaatatctgatcactagtttgttgaaagcgttagatcctggacttaaatctagatctttgattttagagcccttgccctgttttgtcccccagggcactatagaaaatttttgcatgatgatatcaatttatcaaaactgcagagtgtttatttagaaattataaaatgacttagtgaataaaaaattgaggtattatttggatttatcttagtattaatggtggagaagaaactgtttcttttatctaagctccaacaaacattctttattttttctttaatcagagtctcgctctgtcgcccaggctggagtgcagtggcgagatctcagctcactgagcctctgcctcctggattcaagcaattctccttccttagcctccctgagtagctggcactacaggtgcacaccaccacgccccgctaatttttatatttttagtagagatgggatttcaccatgttggccatgctggttgcgaactcctgacctcaagtgatctgcccacctcagcctcccaaagttctggaattacaggagtaagccactgcacccagccccaacacatattcttataatgggatagggaggaggctatgttatgtggatgcattaatttaatcattatatccactaccaaatatcaagtcttttttttagtttattttcataggtttttatatgtagacatgctttcttctttgtggtttttcccctgtaatgaaaccattcattcattcaacaatttatttcctaagtgcctactctatgactagctctgtgctaaatcctaggaatgaaatgatgaacagactagaatttccatgaatgtagtaattaagttgatctggtggtgtgcacttctaatagaaaatgcttctctcatattacctctttctctgaactgatgcaagaattggaatataaacaaaccagctggcaaacttagatgatttagatgtccttttcattaaaggtcagtaagaaatgctaacgttttatgttagcatttattaaactctgaagaggcagaattagtttggggtttaatttctagtattcatagcataaaattaggtataatagcagtgaatctatgtatgcttctatataattattattattctttatactggcctagcccttcacagagttaaattcaactacatttaatgagagaatttcttgtttttttgttagaatttctagcaaaccatttctgcatgtcattgcacctgtggcttaattcttacattttctgttctctgaatttccaagatagaaaagcataaatttcttagagtgaatacagggttagaaacacatcttgttataacaaactatctagtttcagcatcccattaactgttccaacaccaatttgaattcccaaaggatacttctgttgaagcatttttgctttggtttggaattgcaaaagtagattgagtaattcccgattccacgttaatgagactttctgtcttaatcctcctgtttaagggcacaaagaatagtatggccactgcaattactgagtgggctagaattggaatattctatacccccaagggattgttttcttcttttaaagcataagtttccaatctatcatttcttctgtggttgagtttctgaacatgcttgggttttgctgattttatggtttgtttttagctgctgatttttagtcagactgtataggaggggtaacaaaaacccttaattttgcaatgtgaaaattctttatgcatttgctcccgaaagcttatttttgagtaacttgagacttttgcagcagccacagtatccaacttggaaaacctgcattctcagcagctttcctactttaaataatattcttacattagctcttttaggaagcaaagagacagcttccctaacagtaacaagatgtgcaaaccacagatggtcttcttgctggaaattactggaaaggactacgagtgttcggcctttggggcacagtcattcacatgcattcatacacctcacacacacatacacacacactctctctcatacacacacacacacacttgtgtgaatatacaaatgaataaggcaaagtgagaatgtgtatagctactactagtatatagatttctgtggaattttatacactgctttaatagaaatgaacatattttatgtttacaatagctttcttaggtagagcaggcagatatagcatgaataccattattgtagataagacttagatagtccaggtccttgcccaagtgtaagagctgaagtttatctatttctcctaattccagaatgtggcctttggttcaaaatgccctggttgtatttcagcttttctactttctagttccattactttcttaaagcctcagttgatacctctaccaataggacatatgctacctacctcataagcttgttgtgatcagtaaatgaaatattgcgtgtataacatgtggccttttacctgatacattataaatgctcaatgaatgttcatgtttgctttttcaaagcaaacatttatacgatacttatgccaaatctaagtactttttcaaatattagtctaatcttcatgtcaattttatgacagatattgttaatattcccattttacagatgagaaaatggaggcaaggaaaggttaagaaaattgcccaattgcccaaggtcacacagctggtaaatgccacattatggattcaattccagataatccagtccccatgtccatagtcttaaatgctattctgttattctcaatgtacacagtgggatatatggaaatgtgagttgtatatgctaattttatactgctttaaattcctaaggcctagggaatattcccatatgctatagtgggttttctcaactgttgctactattaccaccaatatcttaggactataataagtggatagaagaagatctgtttttttttccagacaactacagaactcaggaacatatccaactagttataatccaggcacaatttgaattccacttgatgggagaggtgattccagtgaagaactcaattaaataaaaacacttttttatgcgtttcagtcatatcatgatgtagtttaggctcaaggtagagttgtatcatgtagtatttagaccagattacaaaactattaagagatgcagagcatgatagacgaggaaagatgaaaagcattgcttggttatgacgtgaggggatgatgatagaagggtggagatagtaggaaagagaaaaccccacagatgtgagaggaaaagggaagataagacaaaaaaagtaagacaagtgataaataatggtttataagggctaaaagtgaagaagcttgaagaaagatttgctacaaagaaagctattgaaataaagaattgacccagatgttgggagaaaccctccacagtgagcagtataaagccacattcagtcactgttggcgtttgccctgggctttgggatgtacgttcattcatttaagccaaaaagtgcatttatcctactcaaaaagtgatttagaaaatgagtgtaagatttcctatgcttctagtaaaatagaaataaattatgcaagagtaaaattagctaattactgtaagaatcattctgttaaaattagtgagttttggatattttctgccagttctttttttcactagtttctgtgacttcagatttcattatcaacctaccaggcctttcctgctccttggagagctggttgaaatgggattgaaccctattttcacagagtaggaaagtcaagatccctcctcaaattgcattaccacttcttgtccttactttttcatggttctctggtttccatctatgctcctgagtttgctgtctcaggtcaaacctgcgtggatttatacacacacacacacacacacactcaggtgatctatctgatgggtttagttgttttctgaaagatttggggattgtcgtgaaagaaataccacattgcataccacataagggacttgtattcagttagttctcttgttatccttcactcctccctcaaaacccacactccagaatgagtcaagcctccttcaaaatgcagtgcagtccctgcaggttcagtgtttatcgaaagtggtacaggaggaaagaagcctgagaagcggatataatttcctcagcatccctgggaattgtgcagaacacaattatagcatcttacatactcttacaaaatgattggaacttgcatttatagagagcttcctgtgtagatgctgtgctaggcactttcacatatggtgtttattgattcttagaacctttctgggtatattttatacccgttttatagatgaggagagtgagtctcagaaaagcacccagcattgttaccatgctgaaggaaggcattggaatacatgtgcagaggaataagattgttcttttcttctcaaaagcagaaggacaagaaaaagcaaaaattaagacaaaccagtctgcttataggagccatgccaagagagatgtcttcttttccttatttcctagtctctgtctaaggcttcagcacccattttcctttgggaatgcaaagcacattcaacaaagaacctcgcagtgcctattaagagcttatttttgtcttcatttttaatgtttcatttattatcaaatagggtactttatctcgtgcacacctatatgttccattatgccatatttacatttgtttaacgcatttaattaagaacattgttaaaaatttaaaaagacttcccctttcacgaaatttggaaattgaaggtagcatttaacgggtttccttgtcaaccacaatactcatttttagaattgttagccagtaattcaattacccacacagttctgctttctaagaatgtgcaaatggaagtcttgtcttatgcaagccagaaaacctactagcagtattctaaacttagaacaaaaacgtgatgcccttcgagtcttggttgggaagagtgtttggtgaggagggggagaaagaagaaggggaataatagtgtcattttctgtttgtctttggccatctggagctcagtgccacgtcctttgctcattctacggagaatataaaaagggcaatgagatgcttatatattttgtagtgctggcagagcatcatttgttataatatctatccctttatcaaatataagccatcatataagccaatatgagactttagatcaattctaaaatgggccaatgtaaaatacaaacagtttctggtgataaaataatctgctatgtgaattgaaggtaaaacatttataaaatgtaaataattgttaataatgataattattgctgagaacaaaagagcagctggctttttgtataatttcacacctttcctttaaatatttactcctctgaaactgccttcccccaaaataacttactttatattgaaacttaaatttaattttgaaataaaatttataggatcaactatagaatattgacattttgtatgtcaaaaatggttgaatattagggatttcatcaggttcaacataatactgttagtgcagtctaagtcttggcgtgtgtaagtgtgctctcctggaaagccatgctggtccaaataaactttgttgccttggtgatctatagcttatttatcttcttttttattagttgaaaaataaaaattatatatatttatagggtacaaaatgatgttttgaaatatgtatatgctgtgcaatggcttaatctaattaacatatgcattacctcacatatttattttttgtggtgacaacgctgaaaacctactctcagcagttttcgaaatacactacattggtatttaccatagtcacccatgttgtatagcagatctcttgaacttatttctcctgataaaattttatatcctttgatcaacattatacccatctaaattccttatatccttcattctactctgcttctacaagttaaactattttagattccatataagtcacattgtgtggtatttgtctttctgtgcctggcttatttcatttaatgtgttccaggttcattcatgttgtaaatgacaagatatttttttcaagttcagtagtattccgttgtgtatacatgcaagttgtttcttaaactgctttttttattattaatcttaatgccttcttaggtgcgtatagtacttctgtagcttttagctctagtctgaaaacacctaagataagaatggtgttattgggaggaacaaggcattaggaaaaagtagataaagctatacagtgtaaatccatgtttcctcaagtatatgacaacataggtgatttttggttactactccttgaaggactccattcagcttgcttaactgtgagatacagctttcaccctaatttccacaaagcagctcagagtgattcttttaccatgtgatgactgctttgctcaaatcctctcttggcctcatttaagaaccttgaagctctatatgatttggcctcactcccctgccctcaggaccatcttgtttaacttcatctccagcttctcactccctctttttctctgttccagccattgtgccctccctgctccactaacatcacatacaagtctatttctgaaatgctgctccctcataactgctccctcagttatgatcatagctcattccttcagtctcttctcaaaagtccaatggtctatgagccctacttggctgtcccatatatagcagtacaaatgcataccttcattccctatctcttttactgtgcttgattttaatccactgcactttttgccacctaatttgttatatattggcttgtttacttatcacctgtctccctccataagaataagggctctaggactacagttgttttgcctgtgttgttcactgtgtatccctggtgcccagaacagtgtagggtggagagtagccattccaggaatgaatgaacagttcatttcagctcatgagaagtagggcgctggatagggagaacagccattcccagtggaaaaaaagggttgttcattaaatgtcactctactctgtcagtttctaggagtctggaatgaaaagagcttcactctatttatttttattaccacctttttgtggcaagtagtcattggcaccatatataatcttcattgtaaatgaatacagtagtaccaccttatccacagtttggttttctgcagtttcagttaactgcaatatagtacaatatgatattttaagagagagaaagagagagacctcattcatgtaacttttattacagtatattgttatagttgttctgtgttattattgttaatctcttactgtgcctaatttataaattaaactttatcatatttatgcatgcattgaaaaaaacatggtatgtactgtatagggcttgttactatctgtggtttcaagcatccactggaagttttgaaatatatcccctgcagataagaagtgattactgtatggtaaaagtcaatttctcatgaaaatgttttattgaaagtataacatatacccagaaaaatccaaaaatcgtagatggttaaatgttcacaaagtaaatacatcctggtacccagtgcccagatcaggaaacaaaacattaccagaatcccataaaccccttcatgttgttgtcaatgtaataactccccaatgtttagcctaccattttactatcatagatagtactgcttgtgtttggacttaatatacgtagaatcatagggcatgccctcttttatatctggattctttgctcaaaactatttttatgaaaatcattcatgttgctgctaatagtcatagttcatgcatttccattgctgtataaaattccattctaccattgatagacatttgaggtttttttcaatttttgtgtattacaaatcctgctgagattaacatccttgaatgcatcttttggttaacacataaaaatacatgccttgaacttcattcaaaaatatattgccagacatttttccaaagtaatgttaccagtgtgcaccaccaccagcagggcagaattccaatcgcttctcatcactgcactttgtatcatgtcttttacattttagccactgtggtgggtgtggtgtgagtgcaatgtagttataatttgtattcctcaggactactgctgttgaacacttaaaaatgtacttgttgccaatctgagttacgtgaatctattttcatggatattaagataatataggtcgtatatggataaggtagaaatcatataggtcataatttaatgactaaaatttagtagacattgctttcattaatgactcttttagtacttgatagattgtattatcttcacaaagcttttgctgtggaaaattcagttcaatagaagctaattgtgggttaattatgaataaccctccatgctgaatggtgtgaggctaccaaggtccacgtcatgggaagcttcccagatgtcacgttgaagctatgtctaacaagcatgaacagggtctgcaagcaaggcagaaaagggaagccaacgtactagaaaagcctaaatcatatttgaaggtatgaagaagtatgaaacttttaggaaattgcaagtgttcagaaaataaagaaaattgccaccatcttgtttatagggaatgaaagacttgaaaaatgacacttaacatcagcctgcagaagtaccaagggccaatagtaaattggacttagggtttaattacattagttgtgtagcttgaaatgtttgaagttaactcaccatcatttacaatgatttgtatgccaaaggaaatatgcatgagcagggaaatatttcctggatagctttttgctttccatgttaggccttatgtcagctatctaaaatgtagaagtgagcaacacatttattgttactgagaatgcatagtaaaataacatgaattctatcatttttacagctaagatgctgtatagattaagcagaaaaacactggcagcctctgattaaaaaataatgattttattattctttttggagttaacatttatttttaactaatgtttcactgtattaaaaaattcctttcagaactaaatactatagtcaaatacattatctttgacactatattttaattggttattgaaaaaataaaagctctttatcaccttatattttaatgcaatctttcaaaatgattaggcagaagatatttttccttctagtttcaaaaatatttgtagaatttttcttaaaatactgtagggaatgtctatcatttctgaatagatgtggttctatctcaaggttaaatataactcaattgttgaaaaaaaattataaacatggaacaaatgtgtctctagaatcaggattcatagcatgtggtcttctttacttgtaggctgaagaaaaagtcccagtcggtggatattaatgctccagggttcaaccctttggctggtgcaggaaagcaaacaccacaagccagtaagcccccggcacccaagacccccatcattgaagaagagcagaacaatgcagcaaatactcagaaacatccttccagaaggagcgaactgaagaggttctacacaattggtgagcaccagatgttttatgcaagtgaatagatgaaatctacctaaatggcattgagaatttctgggtctgtttagttaagtggctccttgttataaaacatgtaaatctttctgatggtttatttggacattttcttatgtggtctgaacataaagatggaaaactactgaaaaactttcagcaaagttaaataaaagcaggcttgaggaccttctatatcctaacctaggggaagtaaatatacatatacgtacatatacgtacacatatactatctctctctctcttaggtttttcaatttttaactttgtgtgctattttcattttagccattgttcagccagcacctttcttgttttttgtttttgttattttcattttcccttcaggctcccaggtctctgaacctgttccgtcaggttgttaagactgtggttgacgttagcctgtaactaacaaagccagtaagaaagtaacgttattacattctgagagaggacagattacattgtgggtctattttgaccttgcaccttgctttactttggaaaaattgaatgacatccaggcccttcatagggaagagtaataggatatggcttgggttgtgcaggcattacattatttcccccagatataatgatatcctgtaatttttgtattttaacatttaatcagacagttgtaggcaatcagtccaaaccaatcaaattaccaactttagtgtaccatattagcccagcatgtctttggccttgctttttaatgaacaatagcagcttttagtgtcttcagtctatctgagacaaaagttactaaacatctagtatatgggaaagaatggtgtgtaggggagacaaatccacccaaaaagagtgtggctgctttggccttgcttgttacttcaatttggagagatttggtcacatccaaaagctgtaatagtagagactgtggcttaatgggttaaccagtgttacatcaaagagggcctgttttctttaaaatttaccatcctcaccactccagtatgagactgtttgctttaagatgattgaaatctttttctttgattttttagtagccattcctagaaatgatcatcaggagaccagatttctagttctattgaaatctttttctttgattttttagtagccattcctagaaatgatcatcaggagaccagatttctagttctaattcctacaacaatttcctgtgtgactctgtcaagtcattttccaatgtctttgggttaaattccttccttcaagctgaagaaatgcctccatgtaggtttagccttatttcagaatttggctgctaaaaccatgctttctctttccaccattttatgtcctcttcttatatattcattctcaggcttcctttttccagatggtcaagtcttattttctaaaaggcaacaagtatggtgtcaatgagactgtccatagtcaggtaatgagaattaataaaagtgtagacaggcacatatttccatttttaaaacctatgctagcacagttcctcaaatcaattgactagaaaatctcacaaagtctacataactctctccaattaccactatccttctctcctctgcaacatgtctgtcgccttctattgcttttctaattagcgaaaaagacacaattagtattttttccttcagcaaataaagcttatcctacaaactcaatgttccttaaaaattagaaaaaaagggagagatactgaccaacttggccaccatgactaatgggctaagcctagaaaatagaagtctcaaaaggggtggattgcaaaaagatgaacgatgagttattttaaataataccaccactcatgaattcttcactattgaattggtaacaatttgattcataatcaatgggagtggcatgtctattgtgttaaaagagacatctgaactgttaaatatactctatctatataacccttttagtaatttggacctggaaacattattttcaaggctaacatattagcaaccgtataatcaccggtattgaaagttccctttacaaaacaaatgtacttctatgtctcttagtaaaagtattagtaataaacaataaaaattttcatttattgataatttcatatgccaggggcaatttaagctcctgggttttatcctcaattcaccctcacaacagcttggacaggtaagtgttacaccctatttttatagatgaggatagagccatagatcatttaaagatggggtcatgagctgtagagagcaggctctgcaaattaaatctatgttctcttgtgacccgtcagaatcaggctttctctgactctcaaaggttgccatccctgcgctataataagctggaggagtgttgttgtttgagacggagtcttgctctgttgcccaggctggagttcagtggtgcgatctcggctcactgcaacctccacctccagggttcaagcgattctcctgcctcagcctcccgagtagctgggactacaggcacatgccactatgccctgctaattttttgtatttttggtagaaacggggtttcactgcgttagccaggatggtctcgatctcctgacctcaagatctgcccacctcagcctcccaaagtgctggggttacaggcatgagccactactcccggccagctggaagagattttatggataatatagtggagtgatatttttaccacaagtcccagagaatctcagtgaaggaagccttgccaacgaacgaacccgtctacaagccaatatgctcattcattgaaagatatttttcaatatctcagtttagagtttatactcctggaaaactctaggagccctcttgtggccaagtaagtgcatttaaatttagcaatgaagtttcatactatagttactatatacattcaagcaataattttagggcttaaaggattttcaaataaaaaataataactagaaaaatgttacagccattgaagtgtcttttagtggctgcagtggcttttctagaattattttcctagaagtacagttattctttagtattcagggagtagaggggattggttccagaaccctcacagataccaaaaatctgcaaagcccaagttcctgatataaaatggcataatatatgcatataacctatgcacatgctcctgtatactggaaatcatctctaggttacttataatatctaatacaatgtaaaagttatagaaatagttgttatactgtatttttagtcagtattgttttatattgttgcattgttactgtttattgtttttactctggaatattttcaatcagtggttagttgagtccatagatgcagagcctacagatatggagggatggctgtataataaaattccattgatttagaataagtaggggaaagctagtcactattgatgtgaaataaatgaatcttcagataaaaggaaagtaatcaccatgtcaggctgtggttcaggaaagagcattttctgccctgcttccatcactaactgtgtaatctggcacaagttatttaccatcattttaccttaatacttacatgtgtacaatgaaagagagaaaccaaatcttgtctttcagagttgtttttcttcttactctctttttatgatcacaactgaccatagaaagtactgtataagttttctattgctgtgaaacaaaataccacaacgttagcagtttaaaataacaccgatttatgaactcactgctctgtagttcagtccacacggtatgactggattctctgctcagggtgtctcaaggctaaagacagggggctagctgggctgtgttttcatctggagtttcaaccaggggaaaaattgcttctaagctcattcttattgttggcagaattcagtcccttgcaattgtagggctgagctacccgttccttgcttgctgtcaaccagggaccactctcagctcctaggggccacttgcttttcttgtcatgtggtcccctccaccttcaagtaaagaacttcacatcaaatctatttcatttggatcctctgcctcaaccaaccaagaatactctctgctcttaaagaattcatgttattgagtcaggatcacccaggtaatttttctgtcttaaggtccacacaacctaatcacaggaataaagtccatcataaattccagaccctggagttatgcaggtatgtacaccagaggggtgggagatcttggtgaccattttagaattctgcctatcacattttacagcaccacctgatatatacacatgcaaataccaatatatctcagatgaaatttcttaaaagcacttccattactattttgactacttatagaatggaatattctatagaatatgaaatagaatacaatattctatttcatttttttaaaatacagtctcaactcactaagtttatttcatagtccattaatgggctatgacctgaagtttgaaaaatcactggacttgatatttgaaatccttcagatacttaaacttctattattctttgaaaaatagaatggttaattagagctagaataaaaaacattaacttagtggagtagcactaataggtaaatagaagaaaatggagtggaaatttttttttttttttgagacggagtctcgctctgttgcccaggctggagtgcagtggcacgatctcggctcactgcaagctctacctcctgggttcatgccattctcctgcctcagcctcccgagtagctgggactacaggcgcccaccaccatgcctggctaagtttttgtatttttttagtagagacggggtttcaccaggttagccaggatgatctcgatctcctgacctcgtgatccatctgcctcgacctcccaaagtgctgggattacaggcatgaaccaccatccctggcctggagtggaattttttaccactccaattattgtttgtgttacataaaaccatttgaatttgacagtgagcataagaaacatatccttcaaaaccacagcccctacttaaagatagataatgaagccaaatagtagactcagatatttgtgataatcagcttatttcactacccttcattcaaagaactacatataaggacttctgaaaaatattgtaaattaagcatggaggtagtaaagaaaactgtgcacacaggaaccaagcatgtacgattgctccctaaggtatacctgtacagttctatgtgatattgattcctcacttcagggaactggagctggaattcatatatcacggtccagcttctgcaactattagtaaaagctcctgatgtttttctatatggaggacttttgctggacagttaggaaataggaccactcttgaatgaatatccacacgatcagaatcactcagtgacacaccaaacagtgattagtccctgatcaatccctgctgtgtgaaggcctcatagaagatgctgctcagaatagaatgaaaaatgaaacagagagagccctgctttcaaggcagccatcgtatgcgttgggaaagagcgtgcctggttgaaatgagcacaccggtaagcaaaatagacaacagagaatgtcctaaatgccatagagatgggagagagggtggtgtgtaatgaatgagggagggggcagcaggagccaagggatattcagagtaccctggaatccacaaaatggagaaatctcagattgtatagatgctcagagggcctttatgggctccatagagcaagacaccctcaccatcctcctctgtttttgcttatgagctcccctggcatctgcacttctctgtgcctcctgttttcttgtgttggcatgtctgtctccatactggttctcagttcttaggaggagggaatggtgcctgcaatcttattaatcccagcacttagtgcagtgtgaggcacacagttaagtgccaaataactatggagggcagagaggatagttagaaagggttatgaatcttgtcctttgaagtggaagaggagaggagggagtctgctcagaattcagttggaggacgagcttaacatttactgtgtgccaggatctttaagcaatttattcacattatctcactatccaaagctcagtgacacagggtaatggcctcactttcatgaaaatcagaagtccagagaggttaggagatttgtctaaggtcacagcttccccaaatagcctagataggatccagacccagtttaatgtaattgcagagcaaaggctcttaaacaccacaacgtgctatctgtttacccctcaccataagtatacagctaaaagattcttctgtctgtagtccattagagaaggattggaatacctggtgtagcaaacaataagtaagataattacaacctttatgtttattttttaaaagtcctcttttattacttatgccacctaaatgctctctgcaacttcgtagaaaagccagaaaagctttcagtttagcctttcctcggcagggctcctgaataggtccaaaaggggggctcctcggctaacaggtgtttgaataatacctctggaactttccttcagttgaaatctctccctctcagtttctcaccttgtcaagggaattgacagtctatttgtcccttttaatcttgtttgtcttcaggatcaacctctcccttttatcctatctaaactaatctcactgtaacaccttcttgtaagacacagtctacgattaatcatccaatgttctttacacagccatttatagtcatttagtttcagataaatgaattaaataaatatgtattgaatgcctactatgttccaggctgtgttcaaagtcctgtgaataaaagattaaactaaggccagccctcaggtgcttatattctagttgggaaggcaggcaataaatatacaatcaggtatttaacacactgtcaagtaatgataagtttttaaagaagaataaaatagattaagtgagagaggtgatatgttattcacgtaaaatatgtttaaatcttatacaatttttatggacattctagatgatgaattgtctcagctctaactgggaactcaattggctggattcgattacaggacattagacgcattaataatagatttttcagagttgtttttcaccttccttggaatcagattagcttatgaaaagactaatggaattgatatttgcagcatgaaggagaaaatgattgaggggaaatttaatgaccctcatgcttccccacattgttttcaagaggaggtatccagatgtccatttctaccaacaatgaataaggagtgtggattaagctataatttagagtattgaaattaaatatcagggaaaatgtaacaagtattagtatatacagggaagttggttttttgtttgttttttgagacggagtctcgctctgtcgcccaggctggagtgcagtggcgcaatctcggctcgctgcaagctccgcctcccgggttcacgccattctcctgcctcagcctcccgagtagctgggactacaggcgtccgccaccacgcccggctaatttttttgtatttttagtagagacaggttttcactgtgttagccaggatggtctctatctcctgacttcgtgatgcgcccccctctgcctcccaaagtcctgggattataggcgtgagccaccgcgccatgtatagctattgtctcttcagagtggtttaggtgtcagcttgccagagggaaggagaaaattagctctcaaagatcctaatttttttgatcaaggccatgaaagctgtgtagtcattcagtgggtgtttattgagctccttcttttgctcaggaaggcaggtgaatcaatggtgaggaacttggccttgagaatctaaagtccaagttggacctttatattcctcctgctagttatgagaccataaacaaagtagttagaatctcaaatcccagtatgcctctttataaaaggaaataaaactgttgcttactgaaagggctgtggtgaggtgtaagtgaggtaatgtatttaaagtacttatattagtgcctaggacttgcaagttctcagtaaatattagtgagcttgttgttgttgtgaattaaggatagagtatgaatgaagcaccatggtacctgctctcatggagcttatatgaaacaagcctcttgtcttgacctttgtggatctgatcaagtcatcccctgtttaaaacccggcagtggttccccacttccacaaaataaggttgttactctatagatctttcatactgcgcttacctttcatcagcttcattgcagacctcagccctacactccagccaagctaaaaactctttgtggtttctcgaagttgtaattctgtatgatgtatcttgggcttttcctcctgcctagaatagtgatacctccgcctcttttagccttctgattaactattcatttgccaggattcaatccaaacgtcctttacacctggccacaacttctctaaatctgattaatatgaatacatttcaagcattttaatatacagattgtcagtcttttaggtgactaacatattgaatttactaaatttaataaatgcttataacatttttatagagtgagtggaattaagtctctggaagttaaatgacttattcatggtcctactgtaaatagtttcaaagccaagggaacaatctaagtaaaatggccagtggtaaagagctcatcctctacattgattttcagatcaaattctcttttcaaaaacaaaaatgaaattagatcattgatggagatctcattgagtggttccccaagtgctagtctataccattgatggtgaaaacgatgcaataataaaagaacagtagtttttcataagacgatacttagttgaagtgactgtcctttccattttttctttcttttttcctcttttgtcccctccctctttcctttctttctcccttctgctctttcttccaccctgtttcctctctttttccttctttccttccctccttgtgttaaaatgaatggtcttttgtgaaatgactgcttagttatggtatcagtttaggatatttgtttaagtctgttcttttaaaattattttacttgtcaaaatattaagttgggaaatggtccctaaaatattctcttaaaattgtgatggtctgtgaaattgcaaattctaaaatccaatgcaatgatcctgtcttttgccctgcttgcaggatagaataccttcaacattccaaacttaacgatgcacagttaaatacaaatttgtatcttactaaccccaggctgcttacatattgaaaagagagcctatggaattaggggttccctgggaattcttctcagtagtaggcaaaattaaaacagtaataactagtttggaagctctgaagagaaaagcaagacacatatttaactgctttttaattgcagtacaccagacactttaaaatatcatcacataacttgtacgcctctcatttaataaaaaagataaccctaaagtaacaatactataacaggaggttaaaaaataaaaggaaaaaactaatcttgctagaggtggcacattctgcagtgtgaaactaggtcaccactgacctggaacgttctctccaagttagaagattcttcatggaaaagcaggaagtctctgtgatttaatcaacagaactatcttggcatgcaggtcactgtctataagcacagaaactaaaacacatagctgctctgaggattccaattaaattaaattcttgagaactatgactttgtttgaattgaaatttgttttgacagtttgatggctttttacattttctggatcacaaaaatttttagggaaaattatttcatttgctgaggtttcttgttacacatggaagctaaaagtccctaagtggacctgggcatttcacagcttttgaagagtggttcaaagtttgtgtaagtagccaatatggaatttttttttatcaagatagtggaatttgaggatatcaagatttcaagtttagttttttggttcatttgtggattaataagaccatgggattcaatatatgtttctgacagtctacatctccatgtgcatgtttgttgggggcgatatttgattgggattttattttacaacatttttcatttatttcatttaatatctactttaaaacatgagattaaggaaatcccacaagctgaaactactttcaactctaaaattaatatgaaagctttatttctttcaagataaattagattttttttaaccaatcatttatgtaattttaactaaaatttaccaaggaaccggaggtattctcagaatgagaaaaaatatgtttgcttgatattcctataaatttgtagtgcctataatttgttaaataagcttgccaactctagttttatagcattagtaccttattttatagatttgctttattcttttttgccctgattctgtgattgttctctgtcagaagtaatcaacccagaatcaagaaacacagcttaatcatggccatgataaacagattaagaaatgtcagtaaccctgaggtctccttgagcaaatggttttggtattatgtctgagctacagcctaatagtcttataacttattcaaaaacaaattatatctgtcaatttatttaatgatttctaaactgcccaattaaacctatactggtttaatttatggaataattaaaatggacattgttcatggttgagaaataagcatgatcctgtttgaaatttcctaaatcactattaaaattagtctttcactgctgttagcaaacaaaacttgcccttttaacctgctaacacgtctatgaacatcccatttcactgaataatggtgaggggaagaaaatgacaaattattaagcaagacctactctattttaaacatttatagatagaactaatggcgatttgaacagtgaagtaatatgtctacatttcccaatgttttcatttttttaggagtatgaatttaaagagcttctaggatcttgctcacattcagaaatgaaactattggtatctcctgattttttttaatttgcttttcttcccacgttgtacctaaggatatatattttcttatttgttttttcttcttttatgagatgaagtctcagtgtcatccaggttggagagcagtggtacgatcatagctcactacagccttgaattcctgggcgcaagtcagccttctgcctccagggtagctgggattacaggtgtgcataaccgtaccgagtcaagatatttctttacatgtaaaaatactacaggatttatgctggtcaatgaaattttgaccatgttaacagttatgactgaaagaatattacttatgagaatggaaaaataggtaaaaaccagacacaactggggggagaatcttctattgctgtttctaccaaagttttgaaactacttttactatagttaaaaactgtgaattcaactgaagattataaatgttacagtgaccattcatgatacattccctatatattatgtgtacatctacatagaagcaagctattagtaaacagctttaaaattcactaactgaaattttgtgatcatctgaacaaactgagataaaaagtctttgtgttagtacaatatgaaaaaaaaatctatgtgggtttataactgaaacatgatttcaggacacagaagatattaggttcagcaatttagcttagaaaactgctttttggtagggaaaaatatgtactaagagaaattaataagttggttttaaagtaaggttatttgttagtttattttatgttaccatatatgtttgaaaataataaagtgaaattcctccaaaatattacatgaaaaagtttagttaatttagattggtatcttttgagggagaaagcccataatgtgtccttaattatgaccaacaaatcttagcattctgtttgatcattaatttgataagcctctttcataaatctgaaccttctgtcttacagaaaaagactaatatgctttgtagaaaaaactaatatgcgttggatttaaatgaactcttttaactaatgtaacataaactcttaatgaatgaattattatatttataaaccctcttagtatgagaaacactatggattaggcatatagaggcagctcaacccagtatacaaatcagtaagacttttaacagtatttgcctccctgctgcatttcaatgttctctatttgctaggatttgtactcaaagattcttggaggttattgtgttgcttaaattttcatacatgttgatagaaagggcattgatatcctctcttagttttctgagctagagggggcaaaaattatctttgataacatattgtagataaaatatcataggtgcccacagagagttgaaccttgtgactctgatttattgagtgtcttacaggccaattcaatagaatttcttttccagttagatagattccgttttgaagtctttttcaagtactatttcaagggaggcaagatgtggcaaaatcagcacaataatatttactctaagtaaagaaaaaaggtacgtggtgtgctgtttggggtacaaagtttttacttcctgctttaaataattctctcaagttgcagatcttttgtgatatgaaaaacactcgtgtaaataaacgtatagtgagtgggatggaatggggatagccaaaaagatgcacttaaggaaaaggggaatataaataataactctgtctctccatgctttcttctttctttttcacctccacccctatataagcctgggtaaacctcaattcagtggacaattttaagaatgcttactcattcatttaaaaatatgattgaatgcctacattatcaactaccaatagttggaaacaaggcttgagagagaggagagggagtcttgtgtgctacaccatggaatttgggcttactcttggcgtcttaggaacttgtgaagggctttgcctaaggcagtgtcttgatgagattgctttatagagagatatttctagcatcacatggagaatggttgggaatttatgtgcctacaaagagaagaatcttttagccatatagtgtaagagctaaaaagatagcatattatgttatttaagagccttggctctggaattacatacaattggatttggatcctacctctgctattctgggcagctctgtaaccttggacaagtcacttaatctctctggacttctgattttcatgaaattaaggatattacctggtattactcagatttgtaatataagataatgtatataaattgcttaaatgatcctggcacacagtaagcacacaataaatgttaattaaaaagcaaattatcagaagaaaaataaagaggagtaacaagaaccaaaactaagaggcagcaggacaagcaaaagattccagacagatgcagtatataaatctagatgaattcatgaccagctagaaataagtaagaggaagattttccagtcaatgctgtgatttcaggctttaaatacttgaagccatagaagctaaccttttcatttaaaaagatatatcctctttcatgaacaaaataaatatctctatgggccagaaaaaggataaaatgcataacaataaatgagtgttgaagctatatgccttttgaattaatatacattgaatttaaaataaccttatcataaatatcagaaacatcatgcattgagcatatggaggacagcctgttaggcacagtgttgatacattgctattaattaaatccattcttcattcatatttccttactttttacctgacatcgtttttcttttccaggatcctatccagggtactacattatatttagttgtcacatctggggtttttctcagctgtgacagtttatggtgtccttttcctagttacaatgctagagttgagctcttggctgcccctgactatttctggaccagagccctaaagggataggaagagccaaataggaaaggacgttgagaaccaatgatcagagacatagaaggcaatctttgttgtttcttcctgctctataatccaataaatttgttaattcttagcctctgctagtaattaggaaaacaaatgaaactatgtcattcatatgatgaaaagtacaaaagaagacgattaggatgggaccttgacatcctggaattagagaataaaggtgtttatgaaagctatgttgggaatggtagcaggagaagactctttattcaaagagagagaggaagcagcacattggtttggtatctattagtttttgcacttagtgtaaatcacacttaggattcattctgtttaaacaccctatgtattgcagagtcataccacatcacacggcctgagacctttctcctatattattttgggacttatagaagtcttaaaggcaaggcagcagagaataaatggctcaggacttgaaggcagttttatgatatgctacctgaacagggcagcagttgagtttacttttttttttttttttttggagatggattttctctcttgttgcccaggctggagtacaatggcacaatcttggctcaccacaaacctctgccctctgggttcaagcaattctcctgcctcagcctcctgagtagctaaaattacatgtgccaccacgcctgactaattttgaatttttttagtagagacagggcttttccatattgatcagtctggtcttgaactcccaacgtcaggtgatccacctgcctcagcctcccaaagtgataggattacaggcgtgaaccaccacgcgcagccaggtttaccttttatcagagggactcagagaggaaagctttaaagcctgaaatctattccaaagaattgcattccaaattttaatgtgcacgggggatcttacaaaaatacagatgctgactcaacagatctggggcggggcctacaattttttctgcatttgtaacgagattcaagatgatgctgatgctgatgctgccaatcctgggtagcaagactaatttaaagagcctgaaggctttcatcatcgaacagcacacataaaatacttttcactatttgatcccaagttatcatcctgaatcaagaatctatttatcttaacacgtgtgttcctttcccagaacaaactacccagttcccagtccttaacacctgtaagaaacctttagagtaagaaaaagaatatggatattattacagagacatccctgtagtttttatactataaaagaaatgaccacaaagtagtaatggataaaattgttttactaaaattagagcatttgagacacattagcagttagctgtgacagtatagtgtagtgtagagcagtgaaaataacacaggttcagatgtacagacacaaaaacattagaattagcaattcactggctattttagctctatcagtcattggctgtgttggtcaagtttgttggtcagtttttcaactgttaaatgggaataaaagcactttcttcataggatttgtgtgattattaaataagatagtgcatgtaaatctcttagtactgaatctgactagtaagtacttaacaaatacttgcaatttcattaaagaagcagaaagaaaatggaaagaggttaatagggggaagtaatagctaatcaatagtaagtggttttagcttgggaaaatacattattgataagtttttaatacctatattcatttatcctgaaagctagcacgaggttttttttgttttgttttgttttttttgagacggagtctcgctctgtcgcccaggctggagtgcagtggcgccttctcagctcactgcaagctccgcctcccgggttcacaccattctcctgcctcagccccccaagtagctgagactacaggcacccgccaccacacccggctaatttttttgtatttttagtagagacggggtttcactgtttttgccaggatggtctcgatctcctgacctcgtagcacgaggttcttggacgagaactatgatctgcagaaataacagcaggctggctcccccttccccagtctccaaggcgatgcaatgaaggtagatgtcagctgtacctacagggctttctactgcaaaaccgctgaaattatgaatctggacatctgtagaggagctggacagctgccctactccccctctggaaagaaggagagaaacttttgtccctaatgtaaaagagtcttctctgggaaagatccctaagtttttacagtcctttggaatataagaaaaatagctcagggatttagcctcctttgaaatgtaaacacaaagccccaaggagataaatctctgtttctctcctgagctatctattctatcaccatttcacccagttgccaattttctttgctcagaaagcctgaccctgtagcaacatgaaatttacatcatttcctgataattataaccctattataaagttacattaatggagaaaaaaattattaactacctcatataatagaaaaaaagtaaaaccatccctagcaaatcctcccctactcaaccttcatttctgataattataataataagaaaaacccaggctttctataaatttccttcaaatttttcattattagtgtgtgtcattcattccatacctcctaaataattcctaatgtgtgaactattttccttgtcattggatgagtagttataaagatagaaaacaaattttcaggctggctgcagtggctcacgcctgtaatcccaacactttgggaggccgaggtgggcggatcacgaggtcaggaaatcgagaccatcctggctaacacgatgaaaccccatctctactaaaaatacaaaaaattagccgggcgtggtggcgggcgcctgtagtcccagctactcgggaggctgaggcaggagaatggcatgaacctgggagacggagcttgcagtgagcagagatcgcgccactgcactccagccagggcgacagagcaagactctgtctcaaaaaaaaaagaaagaaagaaagaaagaaagaaagaaaacaaattttcaaaaatgtaggaagcagttctctagtttgaccacaaggcagataacacctgaccaaatgatgtggctgtgctctgtatggttcccaccaatgtacaaaccagaatggctttgagtagcaaggctatgaatttgcagtctccctaacatcagcatcaccgagaacacatggtcattgccaagcacagaaatgactgaagactaatacccaagcaattgctaaaggatagttgccaaagggaaattgctaaaggacatgtgtctccatgaacatagtcagatgtaacttgactaagctaagggctactaggaaatagcatttacatagcaatctcgccagccattttattttttaaattttttttttaatttttgtgggtacattgtaggtgtatatatttattgggttagccagccatttttaaataggtggtgctgggtcactcaaagcaaataatctgcaaacatgataggggaaaaagcagagacaaaagcctaacaaatgctttaagattctgagactgtctctgttgctcagatttgtcagccatttgttttttgattgtattttttctaaccaaactcacaaaggaccctgacaccagtggaaacattcaatcctcatgagaattcaaatccacaacattatctgttatctgaaaagcagttatcttggccagtttgaattgttatgacaaattaccctagaatgggtggtttaaacaatgaatgttgatttttcagttctggaggctggaaagtccaaaaatagatgctggcagacccagtgtctggtgagaacccacatgctggtttgcagatggccatcttctccttgtatcctcatgtctttatagggcattaattccattcatgagggcttcaccctcataatataactacctcccaaaggcctcattacttaatatcatcacattggggattcagcttcaatatatgaatttcaaagggacacaatattcaatccatagcagcaatgcattagatgatgcaaaagctagtaagacaaggcccctttctttaggagctgactgctagtacagtggagcaaagagagtgagggtgcagtgattctaataacacacaggatgtaaatgtcccaaggcaagtgcaaaatgccgtaagagtttaaaaacggaggagctcatatgtaatttaggaagaataaagcatggctccagaacaaaggaaagtctgaggtgggtcttcacctatggaaaggatttcagtaatagttaagaatcctagggttgggggctgggggagggatagcactgggagaaatacctaatgctaatgacaagttgatgggtgcagcaaacgaacatggcacatgtatacctatgtaagaaacctgcacattgtgcatatgtaccctagaacttaaagtattttaaaaagaagaagaagaagaattctagaggccactattgacagccagtcacagatttctacagtgaagataatgaaggagttccaaatggagacttgacgtagataggttcagggttcagagaggggggaatatactctccatcccaaaaaagaagaatggatcttgaagtagaaacctgaataaagagaggaaggagagaggaaaaagaggggagggtgaaattatgagaatgctgagccttacaccaccttcccacctcctctatctgtgactcctgaaattttagcaaagtttatacaagtcatgaaattctggctgtgattggattttctgtggaaactgatgacaggattaagttatttgtcctggctgaattaggcataaatagtgagaaatggttactcctagccaaatgtgtggtcctggacctgggtcacaaatattcagtccatagtggccatgtaggtattctcctgggattctaaatctcacatctggcaaattatgtgatttaatatcctgtgatcccaaagacccctttaggcctcaaattcttgaattttaatatttttaactgagattcattttattagtgctgtattcaaatgaaattattactttttaattttaatttttggatacaagtaaaaatgaaattatcttcagcattgatttgattttttagcacaacgcctctctaaataaagctcaaaataacatttgtttatgaaaacatgttcgatttcttgtatcatctcttttctactattttttttcccctcccattaagttttgttgttccaaatctaggcttaactcattttccaaaatgtaccaatttaaggttggacttgtttattgctcattcataattctaaccattcatcacattttgttgttttgcagtttcataaacttctttatttagcacaactctattgctggattaaaatgagcaacctttgtaataattaaatatctgtatagaaagggatcttttctcaacatgtatgctctttgttttggtttcatgcccccagatagttctgacaaactcaacaattgtgaatagcataaaaacaggctttttgcatgcagtaaaacaaagttaaagtttgctcaaaaatgcatgcagagtgaaattcttcaacgtggggaaaaggaaaaagtatggaactgcatatgctggatgctatgcattattatctcatttaataatcttaaaaaccttatgccgtaggttttttacatcttcattttacatgtaaatttcagtgatattctatggcttgcccaaggttgcctacctgtaaaggggtagagtaaggctttaaatccacatttgacttcaaagcctgtcttccttccattaaattttactttctctgggtacatgtcatactatcttgtggccacttatttatcagatgagataatgactgtatcaactctgtataaaccataaagtgctacataactatcacttatgttgctgtagttgataaaagtgaataagccatttaaacttcctaagtaacaaaaataagtaattgataagcccaattatgcacttagtcttactgccgtaattttacttctcatgtgtatatctaaacagtattttgtaatcaatacattactgccactgaagcattgaacatgcccgttccatattgtcaaggtttgaaaattcattgtatgatttagttgtgctggggaattgtgtgtgtctgtgttcttcagtaaaaactaaatacgacttctataatttgcatattttactccttagtaaattatgaactgataaaattacagtggtttttttgatgaaaatcaaaattaagctcggtaaacatattgctaaggaaatggtaaattagaaaaaccaaaagaaaaggttaggatctgcagtgggatgtagtatgaattctttaagagtgaatcatgtccaacaacttttcttaggaatatgaaaatgccatagagaagtatgttgattttagcagatccttttacaaacttatggctgtcatttagaaagaaagagaaatgcacatgagataatactcctagttttgaagagtaataataaggggtcagatgggacagtggtccctagcgctgagccaaagggcctgagtttcgggctgtgtctcatctagaattcattcatatctttgactcatagagaaaagaatgaacacaatgctgagtgagatcaacatatgacaagataagttcactttcaatgatagctgtaaatagaaaaaataatatttatataattgattcaaactttataaaattgactcaaatggaaaagttaatatttaagaaatttaaatatttatttcttttctgtctttgaaaaagtcaagtatacatatacagatttcagaacacttggactagcagcaatttgggtaaaaaagatccagtgagttcatttggaagcttgttctttgggagtgaactgtcaataaagtgacatagcaagccaaaaaaggaaaataaagttaaggaatcaggagcacagagatacatgttaacagtggaacacccgaggagcaaagatcaaccattgtttgtatgggttccataggtaaatctaaagcccgtgggtaaaagttccagaaagatcactatttagcttaatgttaaaaaggactatatgaaaataataaatatatataagggattctagacaactctgtcctagagtgaatctattttattcttttaaaataacatttttcatttttgcacaaaaccatgcttatatctgcaccattccagtttttagaatacacaacgttacaatcaacttgtttgcattttgatacacttctgttttcttttccctctagtacttctgcatttctgccctcaattagcattataaaagaggctaaaagccatggctgttgtattagtctgttttcatgttgctaataaagacatactggagactgggcaatttacaaaggaaagaagtttaatggagaactcagagttccacgtggctggggaagcctcacaatcatggtggaaggcaaggaggagcaagtcacagcttacatggatggtggcaggcaaaaagagagagctcgtgcaggcaaactcctgttttgtgaaaaccatcagatctcgtgagactcattcactatcacgagaacagtgcaggaaaaaccatcccccataattcaatcacctcccaccaagttctttccatgacacagtgggaattgtgggaattacaattcaagatgagatttgggtggggacacagagccaaaccatatcaggtgcacagccagatatatcctgatttaaatccaggcttaccatgtactatgtgatgttggaaaggtcacttaatttctctgaccctcattttctacatcagtaaaaagatattctctatatcactatgttgtttcaggacagtggactatgtgctttttaaattaggatatcctttaaaatatgttaaatatttaacaaataatacccacaagtaacagtttataaaagtatgataattcatgttttaaaacatttagtagtgtgtcagacacatagtaagtggtaaataaataaaagtgaataactattatgttaatgtgaaacaaattcgtataatgttgctccttaaacagtgtttcaaatttgtgaggacctgacacaaatcatttattttcacttcatgtgcctctaccaacaagcataaactcatgctatatgttcttcttagaagcactgtattgtttacattaacctctaccaagagaaatacaatggtgaagaaatgaaagaacgattcatttaaaacattggtgctagcatgtactgcatgtttcaagtagtatcataaaaccatatctaccctgcaaatatttcctcttttagtttgatcccaaaccaaaccttttattcttgcttaccagtacctcgccaaaactgagtttagtaaattggtggctgatacctgagaagcaaggaagcagttccccagggtgtgattagctatggaaacagttgatttcagtgagggttggagaagcagggagaggatttaacactgagtggttaaaaatagttcccaaggggaatctagggaggaagcagagatcttcaaaagtgctagagaagaaacacataaaatgaagtagggataagataccaacattttacccaggcccagtgtttactgtatgtatttggtcctggctacctgtatcattttgtttaatctcaagtatctaacttatgtgtttttcactttcatttagcaaatggacaaaattaaggctcagacatgttaaggagcttgccttgagagcccagttagtaacctagagtaaggacttgagtctagcttctgtacaaaagctgtgctccatgtcactgccttcagtggataaagtgaccctttcttttacaaagagggcacaattatttcacaattttaataggtaggcagattttttcccaagacctttagagataattttttagatgtaggcaaagtgttcagcagctaagtttatacttggagattactatgaatatcaaaatcctaaaatgaatcaagtttacaagaaagcaaaacaaagcaacaagtagcctaaaactagtgtttattaaactggtgttgcacttgactggggaaaacactcccccctacacctagatggatttttgttcatcttcaaagggcaactctaggaaaatttggaggcagagcttcctaaacatgaaattcttattaagaacttaaaaagttcttaagaaaagatgtgttttacttcccaatccatatttccaccaacgtttgttaagaaaattatatatatgcatatatcacatatatgcaatcataaaattattctgtcttagtaaatttccagtacgggttaggcacctatttttttttcttttttaatttccattcccttcagtaaaactgtggtagcattattgcataaaaatagattcagtttaaatgtttcaaatatatcatgctgttagcaataaccacgaagtagtatcgctgcaagaaagtaaatttctcattatttagcttgatgcctagggtcatgagaagaaaaaaaattaatataattatgtgtcagttctggcatctcagaagaatcttactttaatatttttagcaaactctcaccattctctggtttgttctgcttttcataaatagatagtttgtgtcaacgattgcccccaaagagttgagggtatgctatattattttttgcccttaactgatttcaaatttaggttgtaagtccattagcttttgacttaagacacaattctgagctcctatttttatgagtcctattttattttctgtgataaaaggggctgcacctattgtagcttgctctgaatttgtatattggaggagtctacagagcagaattgaggaaggagaaagagacttcctaatgagcactgcactcatcattcacagaattccatgaatgttttattgattaagtactgtgctttgaattaatttaactagtttaatttatgtgtgttcatgtcattgttttttcatcctttttttaattccccacctgagatgcagtgtattcatctttgtttttcttccatgtttatttcatttttgtgggggttagaggttaatgattctgaacactgcattcacatcaaacaaaagataagaccaacaaaaaatcctgtagaaattgtgtcattcttaaccacaactggtatggtatctttaaaattttatgaaaagctactgccttccttccttagagaggagagttgatttcttcagatacaagtaaggtgaatatccccagatgaatattcattgatgagctgatactgtgtgtcagctaaggtttgcttaggaaaactgaaactgctctagatatttgaccaagaaataacttcttaatacagggaattatatgcctacaaagctatggaaagggctgagggtcaagttcagaggaattattgctgatttttagacaaacccagaaatgtcaatatggcaggaagctatagccaggctttcagctgcctgcagtgctaaagtgaataatttgttgagacctaaccaagaagcctttgaaaacctcccattgccatccagccctaagtctaccatgtcacaaatggaggaaaggaatgacttctccatatcatctcctttccaaatcttttatgaataactctccttgatggaatttaaatggagcccttactattaggagaatttggaaaatgtggttttcaagcttctaactctttgggtcattgtgcttaataggtcagggatgacactgcattgacatatatataataaaaagcacactagtcagctcctataagtcttatgcagaattttatttttttcccaaagcactggcctgagtaatgttgaataaattaacactctgaatgtttatgtacccactcttatcctgtctcttaattgtagaaaggataagctttttctttttctttttttttttttttcatttataagatggtgttcttgtcaaggcataaatccaaagggaggcagatgtgcaacacacaggtaataagggagttccttagcaatcaatgagatttgaaatgtccagcttttctttgcctgtatgagcatttttgttagaaagtttgatcacattaaaaggtgaagcatgcagaaacctatttcagtgttttcactttatcttgctttagaagctaaaaggttatacctcatcatggaaatgttctttacagtatatctgatttgttgtctattggaaagcgattatgtctataacatcagtgaaaagagctgtagggaaaagagcaatgctcttcttgtgatgtttcattctttttgactgacatagcactacgaaaaagtattctgttttcctctgcaaataaaaataatggaaaaaaatatataatgctgaatctcgtcatcacaagagacggattttccctgaaagtttgtattaaagattatatggttgtgttggaacaatttgtaaagtttggaacaagacaatagtctcaattagctccaaagtatctcctattatttaattaattttttttgtgactatcctattataagaaccttcacaatggccagcacacttacatagactggaatttcgccatccggatttggattagcttattagagtttattactgcaaaagtgattatccagaaacaatattgcccatcttttaccattgttatttaacatcttctggaagtttgacattagacttttttaaacttggcactaacgtcattttgggccatagaattatttgctgtgaaagcggtcccgtgcactacaggctgtttaacagtatccctggcctatacccactagatgccaacagcactgctcccagttgtggcaaccaaaaatgtccccaggaattgccacatgtaccctgggggcaaagtcacccctggttgaaagctactcttctagacactgccgtataatacaaaacagaagtttgaaacaaaggtactgaaagggagataaaaatgattattttagataatgtgattgattgtctgaaaacaagacattcagctggaacgttatttgatctaatgacttaaataaagtagccaaaacaacataaatgtacaaaaatcaataactatcaataacaagttagcaaaggtaatttagaagtccgttttatactgggtagcaaaaacaaaagaaaaaactataaagaacacaagcaaagtgtgtgtggatattataaaggagaaaggaatgaaaatcatttcactcttccagacacacaagcatactgtaaacctataataattaaaacggtggtacacagatgaagtaactaaccattagaccttcatgaaatcttctttaaagtatatctgactagacaagtagaacagaattgcctcaaaactgactttgatttacataacaaagttagttttgaaaggaagccccacagatcaaaaggtaaaggaaggaaaataggcttataactgtaatcccagcactttgggagactgaggtgagtggatcacttaagcccaagagtttgagattagcctggtgagcatgcaaaacctgtctctattaaaaatacaacaattagccagttgtggtggtgcacagctgtagtccctgctactccggaggctaaggcaggagaattgcttgaacccgggaggcagaggttgcagtgagctgagatcgcaccactgtactccagccttggtgacagagtgagattctgtcaaaaaaaaaaaaaaattgaatgatgcaggtataattggttaatcatttggaataaaaatgttaaacacttcacacattacatttcaacaaaataaatgttgactgtcacgtgtcattcggtagggtctcattctacccgagagtctgtcttgtctttttcaccaggctacaggacattcaccccaaggcgtagctgagtcatttcgtgctttacccaccacagtttttgttagatacctctggcatgtaattccacatggggatatgcttagctttcatcgtgaatgtcccttagctgttgtccctgctaaactgtgctcactttggggagacttctgtcattgcattcccaggatctaacacagtggacttgttatttgttaagtacatttataaaaaggatcattcatttttaaaattgtggtaaacatatatgtaaaccaacatgtgtctgagacaggtctcaatcaatttagaagtttattttgccaaggtaaaggatgtgcctggaagagaggtctgtacttttctccaaagatgattttgagaccttcggtatttaaaggggaaaagcgagctggaaggaaaagaggaagggtatggtcacattactgaatcaaaatgttgcaagaaaaaaggagcagttaggggaacagtcaatgatgtattcccctcatggtcagtaaatcagtgctctacataaggtaaggtgaacatagagaagctacctgtgcagacagttaactttcatctgcagctatttgcttaggcataaaaggaaaagcagttgcttgcgtgactcagctttcaacttaattttctccttttggcatagtgaattggggttccaagtttttattttcctttcacatacataacatgaaatttactattttaacctgtttgtttttattttttagacggagtctcactatgtcgccaggctggagtgcagtgatgcaatctcggctcactgcaacctccgcctttggttttaagcaattctcctgcctcagcctaccaagtagctgggattacaagtgtgcaccaccacgcctagctaatttttgtatttttagtagagaccgggtttcaccatgttggccaggatggtcttgacctcctgacctcatgatccacccgcctcagcctcccaaagtgctgggattacaggcgtgagccaccatacccagcccattttaaccatttttaagtgaacagttcagtggcatgaagtacacatcgccaccattcatctccagaacattttcatcttgcaaaattgaaactttgtgcccattaaactccccattcccgctccctccagacactggcaaccatcattctattttctgtccttgaatttcactattctaggtacctcatagaagtggactcacccagcatttgttcatttgtaactggcttattcagttagtataatatcttcaaggttcatccattttgtacaatgtgttagaatttcctttctttctttctttttttttttttttttttgagacagagtgaaactctgttgcccaggctggaatgcaatggcgcaatctcagctgactgtaacctctgcctcccgagtccaagcgattcttctgcccagcctcccaaacagctgggataacaggtgcacatgaccatgcccagctaatttttgtacatttagtagagacaaggtttcaccatgttggccaggctggtctcgaactactgacctcatcacctgcctcgtggatcacctgccttgtcctcccaaagtgctgggattacggttgtgagccactgcacctggccagatttcctttctttttaggaatgaatattattccatcctgtgtcacattttgcttactccattcatttgtcaatggacacatgggttactttcatcttttggctatgtgactgatactactataaacatggacgtacaaatacctgtttgtgtccctgctttcagttcatttgggtatatacccagaagtggctttcctggatcctatggaaattctatttttaattttttgaggagccaacatattgtttctcatggtgggaattttaattctcaccaccaatgcacaacagtccaatttttcgtatctttgccaatatttcttattttctgtttgttgtatttgtttttaataatagtcatcctaatgagtgggaaatgctatgaatctttcatttttatacctagaatgtatctcagcagttgtctcatttgacttactcattacaccttaagcaaacctagactcagattcatgggatttactctaggttaaacgactacttaacatctttcctgacccctggtccagtgctcctcccaacaagccaaaatgtccctatggtcatacaagtagacacaaagaggaacaggccagaaactttctattttaactttatctttgcctccctcttgctttatagctaaacattttctaatatctcactataaaaaagagagaagaaaattataaggctatagaggcaacaactataaaaatgttataatatataaaaagctcaaaaagaaacatgagcaaatattatttcctccacaaactaataagtaaggatgaattaaagagtagtttacactctcttgctcaacaataaattataagcagccaaagtagttttaatttattagtatactgtatgtttaggaactcgatgaagtagtttggagggaatggctacatataaaggagtgctcagcatattagtgggatgtgtattgactattgctttgtcattttctattaatatgaagagatttggatttgatttttagagttctcaaaatatttgggaattcagaggtaatgtagtctgtgaatattataaaatgtgccatttctggcagcctaaaaccagctgcagaaaaagaattgcttgtctaaacatccaatcacagaatctttccctttcactgaaattgatcacaacacaaaaataacttccgcacatccatgaatatattaaagtggcataaagaagaaattctgttgcctgcaaagattacacctgcctcaaagtcatgatcaccggaaaaaaaaacaaaaccagtgaaataaatctaagatatggctatttcctccagagaattgaaacagcctaaatagaagcaatgctccttgaagcaaaggaaattcttatgtcacaaatcctactgcaaaacccccaggcccccttgtattttcccatcacaaacatatcaaacatttttttttttttttgcagttagctacatccttatctagaccataagctccaggaaggcaggatttatggctacttcgtttattactatctccccagcactttacttgagactagacatataggaaatagtcagtaaacacttgttgaatttgtgaataaatattgaatattagcaaatatgtatgaacacaatttagaaacttctaatttttaaaagctttgaagttttatttctgcacaggacacaaagggttttttcttactaatttcctcatatctatttttaaaatgatcactatcttaatccgttcagactgctataacagaatactatagactggatggcttataaacaacagaaatgtatttttcatggttctagatgctggagagttcaagatcaacgcacctgcagatttgatgtctggtgagggctgcttcctgattcatagatgactgtcttttcacaatgtattcacatatgcaagggatgaggaagctctctggggtccctttataagggtgctaattccattcatcatggctctgctctcaggacctaatcacttctcagtggtgttaccttcatataccatcactttttgtgttaagtgtcaacatatgacttttggacaacacaaacaatcctattttatctcctgctttggagaagagcattgtttagcagaggtcaccttgaataaaaacaactgatacttctcaactcttagtgtctgcctggcattgtgctaataaacatttcctggatatctaatttaatccttatagcaatcctgtgaggcagatgctattgtaattcctatgccacatatgagaaaaacgtggcttgaagagcttaaatatctacccaaagtcattatgccactaagaagtggaattcagtcacctgtggtgttaattttggttcctactggtaatggactcatcagatgttcaccagcagatagtcccagagtgctgtctctgaggattccaatggagaaaaatgttatagccactactctgaaaacacggagtgtacactagacaaagaagagcaagggcagaaatcacagtgtgttcacacaacagcattccatgcaattgactcatagttttgcatggcaggggaggcctcatgaaacttacaatcatggtggaagggggtaagacctccagaagcctcactcatttggatttcacctatggtagaaacaaatcccctgtgatatggtttgactctgagtccccacctgaatctcgtcttgaattgttattgtcataatccccacacgttgagggagggatgaggtgggaggtgattggatcatgggggctttttctcccatgctgttctcatgatagtgagtgagttctcatgagatctgatggttttataaggcagttttccctgctcttgatcattctctctcacctgttgccatgtaagacatgcctcttccccttccaccatgattccatgattgtaagtttcattaggtctcccctgccacatggaactgtgagtcaattaaacttcttttctttataaattacccagtcttgggtatgtctttatagcagtgtgaaaatgaactaatacaccctgtctagaacaattaacagtccaaactaagtgatgaccaagcaatgcagaaaagaactgttaaaatgtttaagtactcaattgtttattctagaatggccctttcttttatccttcagctatctagacctgagagcttattaatgttctaaaacttaatttaaatgctacctgtcctctgaaacgtactcccagtcccaaataaatctttccttcctcagtgcatccattctgttatacctttgtctatttaggcgtttaattggagtaatgtaattcaaagagtttaacatcaagagcagttacattttaaaataagtaggtaaattatctggaaaattcactcattccagaacactatatctattttaggaaatagtcaattaaacatcgtattcaaccaacaaccagccatatagggctcaataattgctgtgattagggaatatttcttgttgaaatgagcaaaatttggttgaaacataatgattaagaaactaaatgagccacagaaaatccacttgaaagttctattcacttaaggtataaatacaaaaatatataaacttttaattagctatttactttagtatatggttcacttttttgcttatataggctaaaataaagtagccttttacttgaatactggcttttggttgtgataacaattcagtttcaaatgctgaaggcaagtcttagtttaatatcttagagaaagaggagagaggatgagagggacttcctggggatgtttctttgtttctctgctaactaaatttttaagaagatttgacttagaaggagtgggtatgtctgggcacaatggctcccacctgtaatcccagcactttcggaggctgaggcgggaggatcacttgagcccatgagtttgaaaccagcctaggcaacaaagtgagaccctgtctccactatacatatatatatatatatatatatatacacacacacacacatatatatatgtgtacatatatgtgtatatatatgtgtgtgtgtgtgtgtgtgtgtgtgtgtgtgtgtgtgtgtatttatatatatatagcggccatggtggtgcgcactgtggtcccagctacatgggaggctgaggcaggaggattgcctgagcccaggaggtcctggctgcagtaagctatgtttgcaacactgcactccaacctgggtgacagagcgagacctggtctcaaaaaataaaagtaaaaataaaaggaaggcagggttcaataaataatcatttgtaccgaatcagctagggtgatcattcatactaggggaatacttgtataaagagaacagggaggatttattcatagtttgagatactaagttttacctctggtaaaagctgccatcaccctttctgcttgcctgtagatcaagtacatggcagaaatccatgttgttggaagacttgcagctgagatgagaaaccagatgatgctttctattatgagtctattctaagtagtcccatttctatgtatcaaatgaataaattttgttcttgccccccacctctatatgaatattctgtgtgggcagctagctatgctttctattcttaggcagaaatatgtggctctcgggcctaaactattataacatttaaaaaccaaatttgaattcagtacattcaagcctcttagatccatagggactttagagacattaaaccttaaggcctcctgatagagattattttgtaaatttagctcttaattggccatatatattgatggaaagccacaaagcaaaagtgcatgatgatttcatttattctctgtgtcttcctgagagaggattcagtaactcttgcatttgcaaaagataaaatagatagcttttctgatggatggaggtggctgaagactatatttatccttagattttcagatatgaaattcatttgaaatgcagttaagttcatttgtatgaatatttcatttctcttaacaatagtgacattggtgggttctcagtttacttaaatccacatgttttctctcagcccaagtgtggtcatagtggtcgatgatttcaacttgtctctccaaataaataatatcatcctggataacaaagactgttttattctccttctcttttattcccctcacactgatcagagtgctgggtgtgcagtaggattttataagtatttgccagcatcttaggaaagaaaatttttctaaaccaaagagagaaaaaaaattgtaggcataaatgctaaatgatgagttaatgggtgcagcacaccagcatggcacatgtatacatatgtaactaacctgcacattgtgcacatgtaccctaaaacttaaagtacagtaataataaaataaaataaaataaaataaatatattcatactgtggaaaaaaataagcctaaagtcttgtactttaaaaatcaaaactcaaagtaaacttttcatgcaattttcttctttttttttttttttccagacagggttttgttctgtcatccaggctggaatgcagtggtgcaatctcagcttactgcagcctcaacttccctggctcaagcaatcctcacacctcagcctcccccataggtgggactacaggtgtgtgccaccacacctggctaaatttttatatgatttctagagaccaggttttgccatgttgcccaggttggtcttgagctcctgagctcaagcgatccacctgcctcggtctccaaaagtgctgagattacgggtgtgagccaccatgtccagctgcaattttattcttatataatttgtattccagtattagattttaaaaatcaccaaaacattatataatactaagagcaaaatgtgtataatctatacatccacctccaccacccctaccataaacttcacttcttgcctccagttttcttaagattcggctcaagtagcatcgcttccaggaggccttcatagtgcctccgcattggatatcttatgctaaaaatactttcttacccattaccttaagctccctgatggccaagtgaatatcccatttatcattgtttccaaaaacctagcaaaatgcctagcatgtagtaaacattcaatttaaaatgttaaacctaaatgccagtcatttatatatgagttttcattatcctggaattttttttctctttttcatcatctctgtaacatccaagtcccaggatttgagttaccatgggttgctggagaccctcaccataacatcctctatgcctgtggttctcaaacttaacattagagtcacctggagaatttgaaaatagatggatgcttgtaataagacatatcaacatcatgtgccccggatgtgatatacagagaggggccacaacgtggcttctgcagtatccttctcaaaagtgcataacccagtttaatcctgagaaaacatcagacagatgtaattcaaggacacttacaaaatagccagcactcctccaaatggttattgtttttttccgcaagggatttttcaagggtgaaatgattcattttatgttatataaatttcacctccattttcaggatctaatgcaggatcctggattggaccctgaactagaaaatggacattactatgaaaactggtaatattcaaataagaccggtagattagttaaaatattctgtcacatgtcctaatttcgataattgcactatggttaggtaacacaattttagaggaatctgggtgaagtgtatatggtgactcttaatgccattattgcaactttactgtaatctacaattatttttaaatagaaacttaagcatttttacaaagtgacttatgtcacccccagatgtgaaacctgggcattgggacctttaaaaatccccacaaattatatgagaaccagtgctctaagccaatgttagttgaccttggttgtccattagaatcagcagggaagattttttaatatcttaatgctcattcttaaccccagattaaagcagaatgtccaagagtaggaccaaggaattgatatttttatttattttaaactttgtgaaaaaatgttattgtatatatttaaagtatacaacaggatatctatatagtaaaatggttattataataaaacaaattaatgtattaatcatctcacagttaccagttttagtccctgtggcattagcagttgtaatgtactcatttagcaaaaatcctgaatacaatacattaactatagtcctcatgttgtacgttagatccttcgatgtctccattctacatatgctattttgtgttatttgatctacatctccccatttctccctctgcccttacccttggaaaccactgttttatattttttaaaagctcttcaggtaattccatgcaagtcatgggtgagaactgctgctgcaagctaaggttcccaaatgtgcatgataataagtatattgtggaatggtccaggatcatgagcattttaatgtagaggctcccactaaaaatctactgaatcaatattcagggaggatagtattttaacattcactcaagatgagttttattatcagaaaagtttgggaagtattatatgctgtctagaaattctaggtgtggtccagcttctgatagtgaagtttaaggccctactaagagatctttcacacagctggtagtagcaggaaaatgaagagtctatagatgagaaatccccaattccaatggaatataagtaattgtggccattatttattcactaatgattttctaagcgctttctgtgctcattactaaagacagagtagtagacaattaagtccctgacctatagaacttgcattccagtggtagagggatagaatgataaataagtataaatgaatatgataaataatttataaatgaatatgatagtttcagataaattactattaaaaaataattttaaaacggcccaaatatccataaacagatgaacagacaaattatagtgtgtgtgtatatgtatatgtgtatgtgtgtgtgtatatatatatgtgtgtgtctgtgtatatgtgtgtaggcatacgtatatatatgtacatatatatatatatatacacaatggaatattaaactataaaaagaaatgaagtactgatagatgctatgatgtaaataaaacttgaaaaaacttagttaaatgaagtaagacagaaacaggtcacatattgtatgaatcaatttatatgaaatattcagaaaagatcaatctgtggagacagaatgcatattgatggttgccagggcctggggtagccaaaatgaggagcaactgcttaatggatatgatacttcctttttggtgatgaaaatattttggaactggatagaggtggtggttgcacaatgttacaaatgcactaaattccactgaagtgtccactttacaataattttatgttatgcacattttgccttactaataataatttttaaaagttccttatgatgtcatcagagagagatgtgggacagtaagtgggtacttgagattgggccatcaaggaaagcatctccaaggaaattgcttttaatttaagacctaaatgataagaagccagtcatgtaaacatcaagaagtagagaatcccaaatgaatcctgcctctgcctttattgtgtgtgtgtgagctgggtggaatacttaatatctctcagcctcatttgcttcatctgggaaacaggattatagaaagatctaattcacaaattgttctaattaaatgagatcatgcacagaaagatgagcttagtaggaagtcatatgtccttaagaatcaaaaggcaaaaaaggaattgaaaactcactccagcaaaagctgatcagaagccccttgttatgcaagatgaccagctaatgccaagtctgttttacataatctttcctcactgattatgtaatgattctgctggtgttgcttcacagtcacttttctgtgtatatgtttcaccactaaatgttctttctaactcactgtgtttcctaacagctagtctgagctttcctcccatagctttgagccgtggcttcttgctctcatcatccaagactgagcaattcccttccctcattaattttgtaaccttgaagatatttacgcagtttgaacaaatactcacctgcagttttcttttttccccaaactcttatatgaatctaattctttctttttcttctcacacataatatacaaactcaaattcctttctccctttgtgtttgctctaattgtggttaataaaacatttcctacattgagcccttccaattaattaagattattttcctgttctaattgaggaaatatacctgaaaagctgatcaacaggatttaaagacatctttccactttattggtacttaaaaccattttcatttcttgctattctttttaaggtaagctgaagcataggaaataattccatacatagctgtaaggtaatgttcaggttaaaatgaaattttaattatgtaaatcatatagtttggggttatgttattcatagagttctagactaaagtttttcctcaataatgttggtgattgacaggcaactcaggtgagtagcatttcctaagcttgtatatctgagctacaaaattctatacccataaattagcagaaagcatggtaaaactactgttttttagaattctacttttttttttttaaattaggaataactttactgcaaggcaactcaatttttttttcctagattccacatgttgaattcatcacataggatactctggcaacaaaaaggaatattgggacttagcatttattcgctctctctgcaggcacctaatgatgaatttagctaaaatgctgcaagaacaagcccttacagttgtacataaaatctgctgtcctatgcagggttaaaggccacacatgttggtaacagaatttttctctcagaagtgggttctttgttgagacttgccttgttccttttgtttttatttttaagaagagacttccatctcaataaagaaggaaaaatcaataagtgataatttaaacataactcagaaactgaattgaaaactgaagatatatgagcaaagcaaagtatattacattttactgtgattgttaatctctatgatttgaagtcagactggctttgaacttccgctttaccactgagtagatttttttaacttggaagaagtcattttatctctctaaacttccatttcaccatgtacagagtgggcgtaacaatcatggcttcacagagttactgtgagaatcacatgagtaatgaactcctaattctaggacatatgcataggaaaagcttccctcttgaagaggctactctggggagtaaaagcacatagccttttcgtattgctatgtaccaaagcagcccaaaagccagcagcttaaaacaacaaccatttatcaaactcagaattctatgagctggcaattccaaagccactgccctggtacagaatcaccaccctggattccccctgccaggtgattgacagtcctctagttcctagataatcaggtggcctggtaggccaaatggaggatccgggacagcaagggagagggccattggaaggctaaggcagcagctatatattagccagtacaaagtattctgatacacaatggttaaatgttggctatgttagccctgtcccattcatattacaatccttttcctgtccaggttgccccaagcatcttgatatcttattaatatacccataaaatagcagaaatcacagtaaaactactgttttgtggaattctactttttttattaggaacaaccttattgcaagacaaccgaaaatcttttccaaaatcataagatgatgaattcaacaagtgagatgaatcacataggatgtgagggcccaattagcattggtattccctatatcttcacaacaagtatactgcttatatccatgtgtctgtccatccctcctaccctaaatgccaataaacccacatcaagaacaagcacacattatatacatacttcttggaaatagggcaacaattcttaggagaaaaggtggtagtgatggtgtcttttcctgagaattttccaaatctttaagttggcttcccttttgattataaatttcacctttaattcatttttattttcttgcatttttctataatcagtgaagagaaaccatgccacgctctcaacactttacttagatatttattctctgaaataccccatttaatcactcagaagttctatcctccacaaaacactgggacacgaacacaattcagccaggttctttgtcactttataacaaggatggactttcctccagcttccagtagcatgttcctcatttccatctgagatttcatcagaatggcatgtactgtccatatttctaacaacattctgatcacagtcacacaggtaatctctaagaagattgaggctttctctacagctctcctcttcttctaagccctcaacaaaatcatccttacaactattttcctggtaatgtacataaaaatctcttccagcctttatccattagtcagttccaaagttgcttccatatttttaggtatttgttacagtatctccccacttcttggtaccaatttctgtcttaatccacttggactgctacaacataatatcatagaaaataaaaaacaatactgtaaaaccatagactataagacaaatttatttcttacagtactagaggctgagaagtccaagatcatagcaccagcagacttgatatctggtgagggttttgacccatagatggtgtgggtcctttttgctgtatcctcacatggcaaaaaggctagctggctccctcacctcttttatgagggtcttaatcccatttatggggcggaacctcatgacctagtcaactcccaaatgttctacctcttagcaccaacacactgcagattcgatttcaacataggaattttgatggggcacagagagatgggtagcttgaaaaaacatattcagcatttcaatgatatagcaattatatttgtcaagtgggacaaaaacctccattttttcagataacagaaaataagctagtggagatttgcacagacatgcagttcttgaagtagcaaaagagacacaccccatttcaaaagacatcatgggttaaaaccgagaaacatgaaactagagataatatggagaaagctagaggaaatatagtaatatgaagaaatctctggggtacagcccaggagcctatattttaaataaatgattcctagtggtactaaagttggaaaaccattggctacaaactattcactgtactgaggaaatgcagttgtaaaagggcactaacctggataataaagagaggtactgcagcttgctaaggcaagttcaagatatccactggttacagatttctgccctgtaagctgggtagggtttttcttctgtgctttttttgcataaatccacccttaagcccatcttgatagcaccaacactccctacttactcattttacttctatgggagttgtgtaaaactggctaggattgctcgaagcagacatccagatgtagttcccatcctgaaccttgacagataactggttcagattcttctgaagcatctgtaagacctggaagtcccatctgctgagcaggggtgctgacctgagtgactttggctccaaatagcactgaagtcacagaacactctccaggggccacaacaagtagatcccactctctgatgaaaccactctacttcagccatctcatttttacacaatatgctacaacaagcttgactttagaatgtgtcgaataggaacacgtctggtctgcagctcccagcaagaccaatgcagaaggtgggtgatttctgcatttccaatggaggtaccgagttcatctcattgagactagttagacaatgggtgcagcccacggaggatgagcaaaagcaggatggggcatcaccttacccgggaagtgcaagtggttggggaactctctcccctagccaagggaagctgtgagggactgtgccgtgaggaacggtgcattccggcccagatactatgcttttcccatggtcttctcaacccacagaccaggagattaccttgggtgtatacaccacaagggccctgggtttcaagcacaaaactgggtggccatttgggcaaacaccaagctagctgcaggagtttttttttcatacctcagaggcgcctagaacacctcaagcaagggagccaagtggtcttgctcagcggatcccacccccgccagagcccagaaagctaagatccactggcttgaaattcttgctgccagcaaaacagtctgaagtcaacctgggatgctggagcttggtggggggaggggcatccaccattactgaagcttgagtaggctgttttcccctcacagtataaacaaagccaccagaaatttcatactgggcagaccccaccacggtgctgcaaaactgctatagccagacttcctctctagattccttctctctgggcaggtcatctctgaaagaaaggcagcagcacagtcaggggcttatagataaaactcccatctccctgggacagagcacctgcaggaaggggcggctgtgggcgcagcttcagctgacttaaacgttcctgtctgctggctctgaagagaacagcagatcccccagcagagcgatcgagctctgctaagggacagactacctcctcaagtaggtccctgacccccgtgcctcctgaatgggagacacctcccagcaatggtcgacagacacctcatccaggagagctctagctggcatttggtgggtgcccctctgggacgaagcttccagaggaaggaacaggcagcaatctttgctgttctgcagcctctgctggtgatacccaggcaaacagggtctggagtggacatccagcaaactccagtagacctgcagcagaggggcctgttagaagggaaactaacaaacaaaaaggaatagcatcaacatcaacaaaaaggacatccacacaaaaacaccatctaaaagttaccaacataaaagaccaaaggtagataaacccacaaagatgaggaaaaaccagtgcaaaaaggctaaaaattccaaatccagaatgcctcttcttctccaaaggatcacaactcctcaccagcaggggaacaaaactggacaagaatgagtttgacaaattgacagaagtaggcttcagaagatgagtaataacaaaaatccaccaggctaaaggagcatgttctaacccatagcaaggaagctaagaaccttgaaaaaaggtgagcggaatggctatctataatacccgtttagagaagaatataaatgacctgatagagctgaaaaacagcacaagaacttcatgaagcatacacagtatcaatagccaaattgatcaagctgaagaaaggatatcagagattgaagatcaacttaatgaaataaagtgtgaagacaagattaaagaaaaaggaatgaaagtgaatgaacaaagcctcctagaaatataggactatgtgaaaagaccaaacctatgttagactgctgtacctgaaagtgacagggagaatggaaccaagttggaaaacagacttcaggatattatccaggagaacttgcccaacctagcaagataggccaatattcaaattcaggaaataaagagaacaccacaaagacactcttcgagacagcaaccccaagacaaataattgtcagattcaccaaggttgaaatgaaggaaaaaatgttaagggcagccagagagaaaggtcgggttacccacaaagagaagcccatcagactaacagcggatctctttgcagaaaccctacaaaccagaagagagtgggggccaatattcaacattcttaaagaaaagaattttcaacccagaatttcatatcccgccaaactaagcttcataagtgaaggagaaataaaatcctttacagacaagcaaatgctgagagattttgccaccaccaggcctgccttacaagagctcctgaaggaagcactaaatatggagaggaaaaaccagttatcagccactgcaaaaagaagccaaaatgtaaagaccattgacacgacaaagaaactgcagcaactaatgggcaaaataaccagctagccacataatgacaggatcaaattctcacataacaatattaaccttaaatgttaacgggccaaatgtctcagttaaaaggcacagactggcaaattggatagaatcaagacccattggtgtgctgtatttaggagacccatctcacgtgcaaaggcacacataggctcaaaataaagggatggaggaagatttaccaagcaaatggaaagcaaaaaaaaaaaaaaaaaagaaaaaaaaagcaggggttgctatcctagtctctggtaaaacagagtttaaaccaacagagatccaagaagacaaagaaggacactacataatgataaaggtatcaatgcaacaagaagtgctaactatcttaaatatatatgcacccaatacaagagcacccagattcataaagcaagttcttagagacgtaaaaagagactaagactcccacacaataatgtgggagactttaacactccactgtcaatattagacagaacaataagacagaaaattagcaaggatgttcaggacttcaactcagctctagaccaagcagacctaataaacatctacagagctctccacttcaaatcaacagaatatacattcttctcagcaccacatagcacttattctaaaattgactacgtaattggaagtgaaacactcctcagcaaatgcaaaagaacagaaatcataacaaacagtctctcagaccacagtgcaatcaaattagaactcagattaggaaactcattcaaaaccacacaactacatggaaactgagcagcctactcctgaatgactactgggtaaataacaaaattaaggaagaaataaataagttctttgaaaccaatgagaacaaagacacaatgtaccagaatctgtgggacacagctaaagcagtgtttagagggaaatttatagtactacatgcccacaggagaaagcaggaaagacattgaatcgacatcctaagatcacaattaaaaaactagagaagcaagagcaaacaaattcaaaagctagcagaaggtaagaaataactaagagcagaactgaaggagataaagacacgaaaagcccttcaaaaaatcaatgaatccaggagccagttttttgaaaagattaacaaaattgatagaccgctagccatactaataaagaagaaaagagagaataatcaaatagacacaataaaaaaatgataaaggggagatcaccactgatcccacagaaatacaaactaccatcagagaatactataaacacctctacgcaaataaactagaaaatctagaagaaattgataaattcctggacacatacacacacacacccccgccccaccacgactaaaatccctgaatagaccaataacaagttctgaaattgaggcagtaattaatagcctaccaaccaaaaaaaacctgggaccagacagattcacaagtgaattctaccagaggtacaaagaggagctggtaccattccttctgaaactattccaaacaatagaaaaagagggactcctccctaactcgttttatgaggtcagcatcattctgataccaaaacctggcagagaaaaaacataaaaagaaaattacaggccaatatccctgatgaacattgatgtgaaaatcctcaataaaatcctggcaaactgaatccagcagccattaaaagtttatccaccacgatcaagttggcttcatccctgggatgcaaggctggttcaacataagcaaatcaataaatgtaatccatcacataaacagaaccaatgacaaaatcacatgatttcctcaatagatgcagaaaaggccttcgataaaattcaacacaccttcatgctaaaaacactcaataaactaggtatcattggaacatatctcaaaataataagagctatttatgacaagcccgcagccaatatcatactgaatgggcagaagctggaagcattccctttgaaaactagcacaagacaagaatgccctccctcaccactcctgtacaacatagtattggaaattctggccagggcaatcaggcaagagaaagaaagggtatacaaataggaacagaggaagtcaaattatctgtgtttgcagatgacatgattgtatatttagaaaaccctattgtctcatccctaaaactccttaagctaataagcaacttcagtgaggtctcgggatataaaatcaaagtgcaaaaatcacaagtgttccaatacaccaataatagacaaacagatggctaaatcatgagcaaactcccattcacaattgctacaaagagaataaaatacctaggaatacaacttaaaagggatgtgaagaacctcttcaaggagaactacaaaccactgctcaaggaaataagagaggacaaaaataaatggaaaaacgttccatgctcatggataggaagaataaatatcatgaaaatggccatactccccaaagtgatttatagattccatgctattcccatcaagctaccattgactttcttcacagaattagaaaaaaactactttaaattctatatggaaccaaaaaagagcctgtatagccaagacaatcctaagcaaaaagaacaaagctgcaggcatcatgctacctgacttaaaactatactacaaggttacagtaaccaaaacagcatggtactgctaccaaaacaggtatgtagaccaatggaacagaacagaggcctcagaaataacacaactacaaccatctgatctttgaaaaacctgacaaaaacaagcaatagggaaaggattccctatgtaataaataatgttgggaaaactgactaaccttatgcagaaaactgaaactggtccccttccttacaccttatacaaaaattaactcaagatggattaaagatttaaatgtcagactcaaaaccataaaaaccctagaagaaatcctaggcaatatcattcaggacataggcatgggcaaagacttcatgactaaaacaccaaaaacaatggcaacaaaagccaaaactgacaaatgggatctaattaaactaaagagcttctgctcagcaaaagaaactatcatcagagtgaacaggcagccttcagaatgggagaaaatttttgccatctatccatctgacaaagggcgaagatccagattctacaaggaacttaaagaaagttacaagaaaaaaacaaccccatcaaaaagtgggtgaaggatatgaacagacacttttcaaaagaaaacatttatgtggccaactaacatgaaaaaaaagctcatcaccactggtcattaaagaaatgcaaatcaaaaccacaatgagataccatctcatgcctgttagaatggtgatcattaaaaagtcaggaaacaagaaatgctggagaaaatgtggagaaataggaatgcttttacactgctcgtgggagtgtaaattagttcgaccattgtggaagacagtgtggtgattcctcaagtatctagaactagaaataccatttgacccagcaatcccattactgggtatatactcaaaggattataaatcattccactataaagacacatgcacacgcatgtttattatagcactattcacaatagcaaacacttggaaccaacccaaatgcccatcaatgttagactggataaagaaaacgtggcacatatacaccataaaatactacgcatccataaaaaacaatgagttcatgtcctttgcagggcttgaaactggaaaccatcattctcagcaaactaacacaggaacagaaaatcaaacagcgcatgttctcactcataagtgtgagttgaacaatgaaaacatatgggcacagggagaggaacattacacattggggcctgtcgggggttggagggcaaggggagggacagcattaggagaagtacctaatgtagatgatggtttaataggtgccgcaaaccaccatgccgcttgtatacctatgtaaaaaacctgcacattctgcacatgtatcccataatttaaagtataataaaaaaagaataataaaagaaagtgttcatgttacctctcatggaattattttgttttcaaacttggtgcatttggtgcagtgaggagagagaagagaagaactttttcttttatacatgcttgctgtgtacatagagatttccaagatattgaatctatttagattcaggaaaggtggaccaaacacttcaggtaaattcctcaggttttaaaatgattactcatcgcttcaccagattctctgaaattttatcagcagtgtgtgctttatacagatgcttcctgaaaagggggagatacttagtttaatgccatggcttttgttttgtgcttacttcagtgaggaatgagttaaaattcattttttagcctcatctgtttacatttttttctatgagcagatggccagataattacctaaataaggagttacttttctggagttggcctgccaagatttactgtaataccaaatacaaatgctattacaatgaggaacatttggaagcttacatttgtgtgtcaaaatagtaaataatttgaaagctgtatcttttatgcatccttttaggacatgaagttttcaggaagagttgataagggtaatgcaaaccaaataaaggtaatgaaaactaaataatttttaaataattttctgcagctctccattccagtttgttaatacagaatatcttcaattaaaatgtaaatggaattcattgcatgaagcgatctatctggatgatatgtcatcattgaataatttactaacagccactgaacaatgtctaaaataaagtagaatcattgcttcatgattcaaattatgacatgttataatcattcctctttagtactagatgaatgtgagcctgaaaaagtttcttagccttccagagtctttgtgttcccatctacaaaatgaggaaatggaaacacatttcctcaggaatacaagattctttcctgatctaaaattctgtgactttgttatatcttgttttcttctgcactactgatcaagtaacagaaggaagactcatttcagactcagatatgaatttaaatcttgctttctcacttcctagctgtatgtacatgaacaagacacctttgcctgagctacttcatttggaaaaaaatggagaacacgtacctcatgggattacgataaataaacaaggaagtatttaaagttccaatactgattcttcacttatcaagtcctcaataagctgtatttcttttcttatattccatcattttagaattctcaaatctgccttttctatgaaaccttccatcctctcctcccaatagaaaagactacaattctggagaatgtactagacggatgataaaatatagatgagaattatagcagataaaacataaaagacaattttcccctcctcctgagttgtcttagtaaaaagaatgatggcagctcttgaagagagttgtccctcctgctgttcccttttccttttgtcactgaggtctcacatccagtttgcttttgtaaatgaaatacatccaaatcacgagaaagtggcatgcttcctgtatgatagaatacctttcctcattgctcctttccaacaatttttaaattatttttgctattgtatatcccaatttttaaaattaataccaacatgattatttgttcattatacaaaatactagaaaataaataaatgtaagacattaagcataaacacaccgtccagggagagctactttatataacttcctatattttctaactacatgtaaacattatgtaaaacgtgtacaaaacaagagttaatactatatatttctaatgtaagcatcagaataagtgttctataaaggctggggtgtgctttgctttgatatctgtttttcagtaacatgctggacacagggtacgtactggatacccttttaaacttagtatattccatatatctttttgtgtcaataaatacaattctgcagcatcacttttaatgatcacatagtattctacaatatagataaaatcaaaacttaatttatttcctactttgacttgtcaggctttctgtgttttgttcccccataacagtgttttaatcaacacccatgcaaacaaacctatgccccccttcttctttcttctcaatgattttgtttggataaattcttaaaaggagagttgccaagttcaagtaatctactcacaatttagggaatcattacatattgccaattgttctctaaaagattatatcaatttacaatccagtcaactgagattgagcatttttctgcaattgcacgtataggtattatgttgaaaaataaaaataaaaaacacatttaaaaagcaaatcatcgcatcctaagtgttgaacggcaagaacatccattcttcatgctatgttaccagcccacgacaactttccaaacccttttccagatatacaagatcctataacccagcgaagatgcagtctcactaaatcggtataaagagagttctgtcttgtcttactaatttgattaatttaggagaaatgacaggaaagttcatataaattgtccattgacattcacatgaattctctcactttgacattttaccattctacgtcagtatcactttcagtaaataatgttttacatgcagatagttttacaatgcccatttaaattaattctaaactgttatgaaatccataaaaacccttgtggaacatttgtagcttgtacagtagtctcccattatggaatcaaatgtgaaatgtctgtgtgggagctgttttcctaaggtaaatagattattatttatatctctaggtgcaaatgcttttaaataaccagaacatacagcatctgaatatgcccttacataattttcacagctgctgcattcttgtcagtgcactgtcatggtgaagctttgatgctttgatctgagtttgacccctggccatgattcttgcttgtgtttttatcatccactcttaatgtgaacaataaatctgataatatccagtagtgcttccttatgttctctgactttgacattcagaaaaatcattaatgctgcttccactgtgtctacatctccatacttgtgattttcttcccctttgaagatattttagaatacatagtcctggaagtccaggaccaatgactttgtattttctgtattgcatagtgctccgctttgtacttgccgtattgcatagagctcaatttgatatgatcaaatgatgattaccaagagctttagatatgatttcactttttatgaagtaaccaacatgaacgattaggaaggagcctgagtgatagggtgaaattggaggggagaaaatggagaatttagaaagattaagtaacagaaactctatctcaaattgatataaataataagagaagttcacaggcacatgtgcctgaagtacagaggtcagctgacttgagactgttctctcttctgaaatggtgcaagaagaacccttttccatcctgtgagaaggaccctttttcatgctgtcttcatttcctgactctgcttccttcatgctgactccattttgtgcaggcttcctacctcattgtccccagatgcctgtcttgttgacattcaggtttcttcctgattaagctgtccaatctaaatagccaacattctactgtgaacagttgggaacttgaatctcatacctgctatcttattcacattcagcaaacaagagcacaggtttttcactctcaaacaaaattactgagttttgacctaaacaaatcaccctagagcacttgcccattctataccagtaatgcagcttggtatggggtcatgccaattagcttagacttgagtcaaagattctaattcagaggtcaagccagctacccttgaagcacacgggacacattgttccaaagagttggaaccagtaaacaaatggaagtgctaccaccaagagcaagaggaatatatgctaggtggccaaaaaggcagatatccaccaaggtagctacaactaaatggaaacattgggttttacattagttagttcgggctgctgtaacaaaatatcatagactggtggtttaaaccagagaaatgtattttctcacaatctgaagtctggaaatcagagatcagggtgccagtgtggttgggttcttgtgaaggctctcttcctggcttgtagacagctgctttttcactgtgttcttacatgagaaagagagacagagagagagaaagctctgtggtacctctctggtgcccatcatgaaggcctgaccctcatgacctcaactaaacctaattatatttcaaagattccttccttaaataccattgccctgggagctagggcttcaacatatgaactgggtggcggccaggggtgtggcataattcactccacagcattcctcccctgaccttccaaaattcatgtccttcttgcatgcaaaatatatttattccatcccaacagcccccaaattattaactcattccaagatcaactctaatgtccaaagtcttatctaactctcatgtaaatcataggggtgagatacgggtgagactagaagtcgaattcatcctgaagcaaaattgctttccagctataaacctgtgacaccagacaagttatgcacttctaaaacacaagagtgggcaggcatagaatagacattcccattccaaaagaggaaaaaaaacaggaaagaaggaaggcatgatgggtcccaagcaagtccaaaatgtagcaaggcaaatatcatcagatcttaaggctcaaaaatagtcctttttggtttgatgctctgccctccaggtagagatggcaatgtcactcccatgacttgatggggtagccctgcccatttggcctgggattgctgcccctgtggctctctgcagggtccccactctttcaaatggaataagaaacaactcttccccctctgcctgtgatgggagtggcagccctggtgatttcggaatcaccttcaatatcatccttctcttttcttgaagaatagtgcattttcacaaccaaataactcaatggttccatcctatagattccaaaaagtctgacagccttccttcattttacctagcttccatcccttcagttcaaactggtaatgacccctatggtataatctgatctatatttctggcttccgctgggatggctgattaaatccattgttttcaccatctctttatcaagttgtttttaggccacatgtttagtgttctcttcagaaaaagctttctcaatttttcacaatataggtagcctgaaaatcttccaaatatccaagctcttgcatctatgcttaaaaattgcttctacaatttatttctctcttcttgcattttactgttagcagtaaggaggacccaagccctacctttgatattttgcttggaaatctcgtctgctgaacactgaatttcatcacatgcaagttctaactttcacaaaaccctagaacaaaattcagccaagattttttttgcttctacatgacaaaaactgctctttctctagtatccaataacgttttcttcatgtctgtctaagacatcactagaatcaccctttacatctacattcctgctatgcatctcaaaattcttccagcctctacccattgctcagttccaaaaccacttccacgtgtttaagtatttgttacagcagccccttcttattagtacagaatctattataaggaattggctaatggaattatgaaggctgagaactcccaagatctgtagtcaagcaagccaatggagacccaggagagctgatgtgtagttccagtctgagatcaaaggcatgggaaccatgatggtgtaagttctagtccacagttattacactggagacttaagaaaactgggtgtttcagtcagagtctgaaagccagaaaagattattatcccagctcaagcagtcaggcaagaggggttcccttttactaaatctttttgttgtattcaagtcctcaaatgataggatgacgtccatccacgttagcaagggcaatatggtttactcagcctatcaatttaaatgtgaaattcatcaagaaccaccccacccctgccccaccacagacatacacagaataatgtttggccaaatgtctgggcaccccatggctcagtcaagttgacacctacaattaaccatcacatacacacacacacacacacacacacacacacacacacggaaagcttgaagtgtgtgttatactttcaggaattaaattcaaggaagagtttattgagtgaaatgccaaaagcagagatgctgtattcagtaatgattctgctaaaaaagctcagaaacactggtcaaatactgactttttgtatacatatttgttttaatttaatgaaagacatgatttgaagaatctagactagattgctaatatatccattagttcttcaaataaagccattgtaaatgcttgagcagtattatattgctgtgacttcatgtttaagttctctaagaagggactgtagtgcagcattttaagataagtaaagcaagatgtctttatgcttaagatgtctgatctgaagtacccagatttctactgtgaagacttgagaatctaatttttatttggacactagaatgggaaaccatgtaacctaaaagtattcacaacattttctcaataaataaattccttgaatgttctccatcagttgattctgggccatgtggcatttaatgggtaatttttaattcaaaaaaaaaaagaaagcattcattcttagaagaaatttagatggcttctgagacatctggtttcaagtagcatggcactctgcactcgcaaactgctatattaattggcctacagaatgggctatttaagattagctatttaaatgttgggaaatggctactaaatatagtgattttagtttgggggtaattaatggtaacttaatattctaagaataataacaaaatccagctgcttctgccagatagaagcagtaacagttaggatactaatttgctcctataaaaaagccccaaaatgtttatttttgtctcacacaacagtctgaagataagtaacctcctgggcagattttttggtatcaagggtagattctcctaattcctctggcttccttaatattcaactcccatctctaggtctaaaaagcctttgctggtaacttctctcccactccaacatctgccagtggaaaaaaaggggggaaatgaaggatggacacagaaccctccttgtagaaacatgacccaaatgttgccacatcacttctgtttatctctcattggccacaaacatggccacacctagcactaagtaagtctaggagataagatcctttactggacagcattgggcacagttaaaccctgtatcttcatagaaaaaggtgagtatagacagtagggagaaagcaagaaggctttggcacagaccctctgaaggacaggggctatgccccatccaccaaagctaagtaaggggcatctgtccagatctcccagtaagtgtgccaggttgtccaaatagaaataaccatggaaagaacataagattcttatacacttatgaaaatagtgcttctaatgcagcttaccatgacttctagattccagcatgtaaaaaattataacatgtactctttacttctgatgtttttgaatgcccatttttaaaaagtttgggaaatactaaaaataaataaagaagatgacaatcaactacaattccgttagccagagataaccattaagttatctttagttggttttttatggcttttctccatgtgacttttcatttacataattggactcagttttgcattatttatcctgatattaataatatacatttttctcacaccattaaaatgtgattctcaatatcattttacatttgcgttaatttaacctgtagaagttccagaattttttcaacatattactgatgttagatgcttagagtttccagtctttattagtattaataatgctactatcatcatctttatgcataaattttatctgattttgtatttattaatatagaatcttaaaggtgaaataagctcaaatggtagggaaattttaaaggctcttaatctatattgctaaatcactttccaaaaagtgttgtgaaaatttcttcttaaactaattctactagtttttttcatatcaccctcactagcattattacaattaaataaatttgactcagttaattaaatgaaaatggacattcacagccccttgatgactgatgagacctcctatggtttcacatgtaccagcaatgttaccatgattaaattctcatattttgatcatgtattcatttcttgttttaatgcaaatatgaacagtcctgcctgtgttaagcatgaaggcaggtacaaagtaaatgaagatatctcatttaatgacccctacatttaatgatatacaattaatttaatgatagcaatcaacttgatccatccaagaaccttgaagaatatattaaaaaaaaaaaaaaagagaaaggggcttgaattactgattactgaaataaatgacacctcacttatgtgccaaagctcatgcagttttctcagaaggaaagactttaaattcttatttcaaagcacattaattcttaacctagataaaatcctaacacatttgattatatgattttcaaatacgtggcagattaaaaacagcaaagtagaaaggagcagcagacacattaacaacaaataatggtcactgagaaaatgacaaagagaagagatagaaatgtttataacacacacacacacacacacacacacacacacacacaaaaccctgaaattatgttttttaaaatggtgatgtttttaataataacagagtttaagtaaattatagctcatctattcaaagattattaagaagtccttatattatttttacaagaacttttaatgtcacagaaaaaaatcacttttatactaagagggaaagctggatataactttgcagatagaatttaattacaaatatggttttaaatagttgaagagatatcctggaagtactgttcttaggaacagtaagattattttctgtatctcgtaaattttctaaaatgtatatgatgtattaccttaataaagaaaattaactttatgttatttttagaataacattctggaaattttaggagtagaaattattcttttgtatattactaacaaatagaattatacagttatttgtgcttataatggtagcacagttattcaaaaaaaaaaaaaaaaaaagaaaacatcaaatagagccacaggctttattgcagaagacctgggaaagttatctgttgttgaagatttttatccaaagtaaaaataaatgtacagtctatgtaacatgtaaaggtaaacaacagaaattcaaaactcatagttaggggtgattttaaaaatcattatttaggcattggtcttttgaggatgtctcttgagtaatatttaaattatttgttttataaaataatgatcatagtgactatgatggcattagaaagaaaattctcaaattcagtaagtcaaacatcatcacatatttagtgtgctcatgctgtgtaaatactgaaaacactatagaaagtaaaattacatttcaagctggtagaatcccaacaattttaatcaaaatatttttaaattttatatacactcatcttgcatatgagagtggcatgtttatgtaaattgtttttgtagtatctcttaattcgaacttttttgtttctattttgtaggagtaactttcaactacctttacttcgaagaatttatagtattttccagaaaattattaaatgtatgagctttaataatagtcatcggcagactttctaaactaacatgaacaattaaactacagtatttgctccatgaaattataaattacaatggatatatatgtcagtttttacattattgtctcacagacccaaagctatccgttttttttgttttgttttgttttttgttttttttttgagatggagtctctgtctgtcgcccagactggaatgcagtggtgcaatcttggttcactgcaacctccacctcccaggttcaagtgattctcctgcctcagcctcccgagtagctgggattacaggcgcccgccactatgcccagctaacttttttttttttttttttttttttttttgagacagagtctctcttctgtcagccaggctggagtgcagtggcatcatctcggctcactgcaaactccgcctcccgggttcacaccattctcctgcctcaacctcccgagtagctgggactacaggtgcccgccaccacgcccggctaattttttgtatttttagtagagacaaggtttaccaggtcggccaggctggtctcgaactcctgacctgaggtgatccaccttcctcggcttcccaaagtgctgggatttcaggcgtgagctactgcgcccggccaaagctacccttttctgttcagcctcaggatgctggggctgagttcctgcaacccaagtttctgctttgccagcagccacctgctaggccctgccagtagggggctccagaaggaagctgcaaggccggaactgggaggaggaattcacttcaggtacgcttgtagttcctgtatctcctctccagctacccttccttgctgtggcaacaagggttcattccagcagcaactactgaattcagtttgcagtttttctaacatttgcagaaccagctccattgtaccctgctcttcagagacgccagcattagttggccggtgcccctttgtagaaatctgggttgtggcttcacagggctaggggtgtcacatttaacataaaattatgggaaacccaatttcaatctcaggtaaacaatgaataaacatttagtataagtatgtttcccgatattgcatatttaactgtgcttactgtattttatcagcagccatgtgcagggttccttctctaagcttctgtattttaataattccaactatttccctttgctgcctagcccctgagtcagtagctgttttctgctattgctttctttgtgataacttagtgtcatcaacttgatacctccattattctttatattctgtcctgtctcctgactacattgattgatacagtagagttttttaaagcagatactgggatttgacaagataattttcctaccagttaatattcctgtgtataagttaacagggatactcatatggtaactccgatagaagctatccaaactttaacttgcgagtaaatgagttcatatacataatatttgtagttctatgtggttcagagacataagtcatagtaaattcttgtgcatagcatatctcctttatcaacattttaaggaattaaggacttactatgtatactgtgtgtgtcattgtaaaattgtgacaggaggacaagaagaaaaacaatttacagatttaatgtggttgtaaaatacaattattaatttgtaaaatagattaatttctagtccacttgcatctgagttctagactctgggcactaaattcattacttggcaaaatagtcagcacacctggttatatattcatcagctcagtggtatttacatggtgtttgcattgctcttatcaagtttatccaggcttcccatttactctttaccctattcccaccctgttcccagcctgttccaaccactgctatagtggcatctttgactttagtgaccacctaggtaacctcactttttctttctttttttttttttttgcctagtatgaaaatatacccaataccaccttctttattgctgactgggaatgtcctctcaaagctcctaaaattcttgactgtctccttttttgcctttctctagctggactattttgattatacccttctgaactgactctgggtttctggcttgccttgggccacatttctggcttacagtttgggtttcattgtaattccctatttatggctgtagttggttgtacagtgttcacttcaaacccgtcacttcctgcctgaaatcctgtaattgctagtgtttgacattcgaaactcctgatccctgatttgcctcaaacttctggctctcctgtgtgtcctttcatcttacctgaggccctggattagctctggccttgctgctttccaggcctgctgaaataaatgagcaagctatttctagctaaataaaatgagctagaaagaataggctgaactgagagaattaggtgactttatgcatgtctgattatctacgagagtgcagggaaggatgttgcaaagccttgggactgagcttgctggctctggagcacttccttgcctcatctcatgcactgctcatgagaaccccatagggtaggcatcaccctttcaccatccagacttaagaaagaaagattaaagcttagaaaggttacataacttgtccaaaagcacatagtagctaaggaggggagccaggaattaaattcaagctgtttctggtcccactttttttttttaatcactatgctatatatgcttgatttcatataattgagccctcacaatctgtctagttcttcaattcagtgagttttggggtagtaatgattggtttcaagtccaaaaagtttcactggtctcatggcagcagagcaaatgcttttatcatcctaggctcacagcagaagcatgtgcattctgattgaccacacacttcccgccagctgcataaaatcactattcatgatttagattggaaagcatactgatggccagcattttcttcctgtgtatgattgactggcagctgtgactctaaatgcacagaactataggcatgagaataatttcaacaagtatcctttaaagcattatgtcttttttaaaccatcttagccatctttaagtgtatggttcagtagtgtgaagaatattcacataatagtaaaagccatctccagaactgttttggttttgtgaatctgaaactctatacccattaaatcacaactctccttttcccctccctcaattcttttgtttctatgaatttgaccactttctatacctaagaaaagtagaatcttacatagttatcttcttgtgactagcttatttcactttgcctaatatcctcaaggttcatccatgttgtagtacatgacagggttttctttctatgactgaataatatttcattgtacatatataccacatttgtatatctattcattcattggtggacaagtagtttgatgccacttcttggcaatagtgaatagtgctgctgtgaacataaatatgcagatatcttatagaaaccttgctttcaattgtttggaattcataccaagaactgagattatcggatcctatggtatttatttatttttttaattttttgaggaaactccatactgtttcctattgtggtagcattattttacatcctaccaatagtacatggcagttccaatttctccacattctcaccaacacttgctattgtctgtaaaacattatatctttttctttttttaatgatgcaatataatttttatttcaagaaatatgtgacttaagctaatattttgtgagcaaaaatgcagggccaatatatttaaatattatccagcctttcaagtgtgttcactttcagaagctaaatattttcctgaacattccttaagtaaatgaatgacttgctcttttgaacctaaaacacatgcttgtttcctcattcttgtggctaccactgtcttacccagcactaaaagcttcttaaaattagtcagaggaagacaagtgggaaggtgtagacttctcacttcaatagtctgctaaagatggaggaaaaatatggtgctattcaaagacagtctagacttaaagatttagaattttggatggaaataatccggtgaaatagcaagaacatttgaaagagaacttgacaaaccactgctgcagaaagctgaattccaaggaaatatgcccaatatccatgaagctgagaagtaagtttctgaaatcatgcctttctatttttttttaatttttcatttgcctaaaaaatgtcaaccacttgttgaggcaagcggagtcttgctactggaatgtataaattaaccaaatagagtattatgcaaataatagtagattcggatatttgtttagtggcccttttatggagtattagaaattgccaacttttgactttgagaaaagaatatgtgtgttgtcagtaatattttgattctgtgttttttttttaaaaaaaaccttttaaacatttgtcttatttctattaatgtcacttgatttttctggtttccaattcctgtttcattcatagaagcttctagaagtaaatgtcttttttcattttaaacatgaacgcagatgaataaaatgaacttctaatacatttaatgtcacacttgagacaaccatattgagattcttaaaaaattgcttgtatggagaaaagaagattatcattttcagggccaggcacaatggctcacacctataatcccaactctttggaaggccaaggcagacagatcatctgaggtcaggagttcaagaccagcctgaccaacatggagaaaccctgtctctattaaaaatacaaaaattagctgagtgtggtggcaggtgcttgtaatcccagctactagggaggctgagacaggagaatcgcttgaacgtgggaggtggaggttgcagtaaactgaggtcgcaccactgcaccacagcctgggcaacagaatgagactctgtctcaaaaaaaaaaaaaaaaaaaaacctaaaaaacaacaacaacaaaaagaaaattatcattttctagccagtgactagtaaattttctaaacctatcagataatttataacaataatggatttaaaaaacaagcaagacagatttttttctattgacatatatatatatatatatatatatatgaaggaacatatatatatatatgaaggtaaatactgatcaaaattcaaaatccagggcagctcacttggagagaaataaaaataacaaagacctattaggtaaaacaagattatttggaactataggagtaagagttaagaataaactaaaaacaaagcacttgttctttgtggcagctgaaaatagcaaacctggggacaacaaggtttttcttcccatattctctatgctggttagctggcatgatgactaaaacagaattgtgcctgccattgtagagcttacaattatttcttcttggtggtagtattccacaatggagagcgttaaataaaagtaggcagtcttttacaacattttaatttagtctttgttaatgttaaagagacaaattccttattgagtttctgagcaaagcttaataataatgaagttagaggaaaaacacccaccacattttataaagtagtgaaaaaagcttattaagccacagaagtgttgtttttcctctttttagaaaataaccactaaagcttatcacttgacaagcaggcttattttacaaagaacttactaatttataaaataataagactttggagaagcatcttccttatcaattgtcttatacgtttcagggacatgatggaccaaaccaatgtcacagtctcttggcaccacttttaggatatgaatatatttggcaccctccccacagtgttcagccttggggttctcagccaaaactaaaacaaagttccatttccattgcttctctacttctatgacataatgtggttatgctattttaaacttattcctattgattaagtttttagttgttaggagggagttttttttgaaaaagactaaaattatttgtgtctaaatatataactttcataaacagagtatgaattagaaagtatagtttttccttaagctttaagggcaattcataaggctaagtatttttcatataaaatatagtcacttgattccactgactcgtgactctaatgggttaagttccccaaaatttactctcatttacaagcctattaaacttctttaaatacttcaagctaaattacaaatttatatgatttttaacaaacactttaaatgcctgataggacaaacttaaagtgtaataagccaatgcttgctaaacacttaacctctgtaaaactaataaatcaaacctataaatgtagtaaattagattctcctaagcatttcaaacatcttaaaatcaggactggaagcaagagttccagtaaaagatggcggattaaatgcaaccattaaggtctgttccatttttatcctcaactaaaatgacagtaaaaggattttctaagaagacatatgccaaaaggaccaaaaccagaagaggaggtaacagtgataaaatttcgtagtttgaaggcaatttagcagacccaagaaagctaatgctaacagtgggaataactgagaagcacccaatttacagtgtggaactcctgaaagtagttggtgatgttgagtattttaaaaagtaggagtaaagataaagctaaagtatcttttcgaaaagcagattgacctaggagagaagacttaacgttactgacattaagaattctcttaggaccagctcaatcagagcatgctacagtcaagaccacagttactgcctcacttccaatctgcttttttagtgtcttgttcttaaatgggaaatttattgaggttcaactcctaatatgagaacactgactaaaccaaggacacagaaaagaaaaattggaaggaaaagaaaatacttgggaagaaagaaaaccatctaaagagattcttagcattctcaaaaggataaaatagattgtatccaggaaaccaaaatagggtgatacaaaaagggatattcaggaaacaaatttctaggaagttaaaggtataattgcataaatgaaaaacccagtaaaagctttgaaggaaatgtttctgaaagtagaaaagagatgaaaataatagagaaaaagtagagaaacctgagggccagtcatggaactccatcatccaaacaggatctccagaaagagataccagacttaaaaaaagagaggggtgttcgggggaggggggagaaaagtcaaagaaataatgtgagaaaatttcccagaactgaaggacatgagtttccaaattgaaagggcccagtagcaagaacaatgaaaaaaaggctcacactcaggcatattatcatgaaacttcagaaaacttgtttcaaagaaaagattcttaaatcatgagggagacatattcattcaatggatcaagaatcagaatgacataggacttctctatagcaatactagaagctacgaagtaagagtatgcctttaaaatttgaatggtaaatggtaaattatttcctatcaatagttttactatcattataaatcaactatgagtagaataaagccattttcatatatgcacattttaaaaatttccctcccattacagtttctcaagtgctccagcaatatgagaaagaaaaaaaatggaatccaagaaataggagatatccataaggaagaagtgaagggaatcctgcacagggtgattctaagacagctataccacataaaaacagtctaggctggtgcaggtctgagaaaataattcagagtggttggttctggagagtaggaaaaagggtgggattggggggattgctttattttacaagtcaattagaactagctatttgcttctttagtttatgtggaactttgataaaaatttaaacttataaagagacaaaacataatttaaatgccatgtcaattagaaaatccactgttcctctataaactcaacttgaataatggttattccttcatcatctctgcacttttatggtatactttcctggggtgaaaagttgcttatttgactaaggagaattttatcatcatctccagtctacaacagcaactatgaccataggtttgtgttgtggatggcaattctagaatagggcttctcagagatatttctaggaaaattctatctaaaaacaagatagcaatccaagtcccttctttcagtgggacttctaaagcccactccttttcttacaccctagtgcatcccaggttattttattcactattttcctgttatctcaggcaactttagtctaaaccaacttgctaggttgtatatccattacccagattagaatttctcttttctacctgattgaattcagtactcttttaaaattttacattatttcattatccaccattctacatgctatagtaatttaattcagttcctcatggaacttatgttacatatcagcagaaggcaaaaactatataaatgaacatgaatgtagggcatgagtaaattgtagagtaagttaggtaacagatgctatggagtaaagaaaatgccaagccaggtaaaggaagtcagaagtgccaaagaggggatgtgtcacaatctttaatggtagtaagagtaagcctcattgagaagatgacttaagtaagtaaaaaattgaaggaggtaagggagttagtaatgtagatacattgggaaatggcattccaagaagcaggaaagtaaggccttgagatgggagcttgctttgcatatttcagaaatatccaggtacatgttactagagtgaacaacaggagaatatatgggagatgcctttggagagataatgggggctaaattatatgacatcttagaagcttttactcccaattagactttttactctaattctgggctagagtttttactcccagtgaaatgataagtgattagtgattttgagcaatgatttggcaaatctgacttacattttgagagacttgttctaactagaacgtggaaaacaaattgttggaacatcaagattggaagcagaccagttaggaagttatagccatgattcaggtgagaaacatggtagttgagaccaagatggtagtgctagaggtggtgagaagtggtcacattctgtatatactttaaagatagagcggacacattttcctggtgaatacgatggggtgagtgtgaaggagtagaaagaaagaaaaaaaaagagagaagaaaaacaaacaaagcagtcatgtattcctcccccaagttttgacctgagaatataatggatttgacctcacatacagtgggaacagtgaaggtggcacaggtttgcagagaattcaggagtttacttctgagcatagtcaagtttcaggtgttagctaaatctctaaattgagaaatggaataaactagctggctatttgaatgtggagtttgggggagaaactgtactagaaatattgatttaggagtcttcaatacatgggtgatagcaaaaaccatggaagagctcagcaaaggagaaagcatagatagatgatctgtgctaaggcctagtatttccagtgttgggtaggaagaagtagacctggaaaagagactgagaaggagcagcagtggaggaggaaaatcaggagattgtgatgtcctgggggcgagtgaggaaagcaggtgggaagaagatagagataaatgtgttgaatgagaactgagatgactgtttatcaaggaggaggtcattggtgacttcagcaagagcagttcagtgcagtggtgggtctctaggcccacttagaatggattttaaaaagagcatggaaagagacgatttagaaatggtaattagggaaaatttctaggatttttgctgtaaagagaagcagtagaaaggagtgttcatccatagtgtaaattgggtcaggagagggttttattaagatgagaaagtaacagagtatttttatgtggattaatccagtagaggtggaaaatttgatgatatagaggagagtaaagagtttcaagattgtctctgaataggtgagagaggatggggatacattagcttaaagtagaagcatctgagaaggttgagtcggtgggcacagatactggtaggtgggtcgatgtggtattgagtctgtggaagttctctaatttttttttttcagtaaagtagggaccaagattatcagtggagattaaggatgttggaagagtttcttgggtttgcagggaaagaacaaatggcgtgaaattatcctctaggagagtaggagagtgaatgaactatgaaaatatactacaaagatcaggcagcactaaagtttcacttgaagctcacactcataaatatcttagcaaagcttgcttatcattatgacagagttatatttgaaaatacaaagacatcttagttatggttgttattttaaggtggactttaaataaagaatgttctcaaatgatgggctgcagcacttctcagagaagtcccagtagataggtttgtaatcatcattggggttctggttgaggcgtgctcacacctgtggccattgctgtgcctgaataaactatgtagcatggtttttccttccctcctcttcatgaaacctccctctcttcttgcatgttttctttttcttaagggtatagactggaacattaatatttgaatcactgagtataatcattatttgagctgtggaagaggaaaagaaaatggtactaggatgcctagtacagagaaggaaaagatagatatttaggtaaagaattacttagaataatagatccgtgaaggtaagaccagttgaaccatcttctaaatataaacaattttttttttttttgagacagagtctcgctctgtcacccaggctggagtgcagtggcacaatctcggctcactgcaagctccgcctgtggggttcacgccattctcctgcctcagcctcccaagtagctgggactacaggcacccgccaccacgcccggctaattatttttgtttttgtatttttaatagagatggggtttcaccatgttagccaggatggtctcgatctcctgacctcgtgatccgcccacctcggcctcccaaagtgctggaattacaggcatgagccaccgcatccggccaacaatttttttttttttaaatagaagaagaaactgcagtgatgggttggaaattcaatatatctcaaaggactcctaacctattttgagttatctttgataggactgccagatattgggttaactgagcactgaagctcttctttaatgatctaatgtgccaagcaaggaggaaaatgttcattggttcttggtcttcatttatgtgcaagaaattcatataatttctcatttactttttttttttttgagacagtcttgctctgtcacccaggctagagtgcagtggcgcgatcttggctcactgcaacctctgcctcccgggttcaagcaattctcctgcctcagcctcccgagtagctgggaacaggcatccactgtgcctggctaatttttgtatttgtagtagacagggtttcaccatcttggccaggctggtctcaaactcctgacttcatgatccgccctcctcggcctcccaaagtgctgggattacaggtatgagccaccgcgcccagcctctcatttaattttaaaccaagcaatttcttttaatatggtataatagttaaaagcttcctatcagggcttgtatatctcagctgcacaatactaggcagattacttaatctttcactgtctgatgttttaatatctaactcataactttgtaaccaaaatgcagattccatcacacactgtgtgcaaagtccaactaacaagagcgatgtctggtataaagaaagtggctttattccaaagcttagcttagggaaagaggtgcaggctccttcctgcctttagtggactgcttcacttttggggcagaaagccgaagctttaaagggggacttggtgtgaacagcatgcaggggagagagcgagcaggtgctgatcattttggtgccttatctactgggtggtgagctggcaccatcacaggcagatgtgggttgtaaaatggccattgtctcaagacaccctccaggtgggagagagttccatcgcagggcacaccttaggttgtaaattggctgttgtctctaggcagcttggtgagacagagttctggccctggagccttttttttttttttttccacagcagagacaagtgaacatttatttttatgcctttcttcctatgtgtatttcaagtctttttcaaaacaaggccccaggactctccagattcaattatgtccttgggcttggttgactgctgcaggagtcttagggagccttgtacaaatgctagagtgactcatttaccaacagtaaaccctaggatagatccaacaaagcaggaatgtgccgatttcagacgacgcagcacccaatgtagaaaacgctggaatttttccttggaactagactgtgatgagaggtgcttgacatgaacataagctactgtcttttctgctttttgagatggagtttcgcttgttgcccaggctggagtgcaatggcatgaactcggctcactgcaactcccgcctcccaggttcaaacgattctcctgcctcagcctcctgagtagctgggattacagacatatgccaccatgcccgactaatttttctatttttagtagagtcggcatttctccatgttggtcaggctggtcttaaactcccaacctcaggtgacccgcccacctcagcctcccaaagtgttgggattacaggtatgaaccaccatgcccggccagctactgtcttttctttgacccttcctttccagtttttgaagataaagcaggaaataatcttctctgaagatacttgataaaaattcccaaaacgacaaaacacatgcttccacttcattgataaaaaatttaatgcagtttggcacctaagagtatgacaacagcaatagaaagtaatttcaaagagttacgatttcttcagcaaaatagatgattcatatcttcaagtcctttttgaaatcagttattaatattattctttccccatttccatctaaatgactgcggcaatacaggtttttggtttttgttgttgttgttgttgttgttgttgtttgagacggagtctcgctctgtcgcccaggctggaatgcactggcacgatcttggctcactgcaatctctgcctcctgggttcaagcgattttcctgccttagcctctcaagtacctgggactacaggcatgcgccaccacacccagctcatttttgtatttttagtagagacagggtttcaccatgttggccaggatggtctcaatctcctgacctcatggtctgcccgccttggcttcccaaagtgctgggattacaggcatgagccaccgtgcccggccagcaatacggtttttagttactcgacatctttaagcctataactcttaggctatgcatagccccatgtcctaatcaggcattcactgatcccagcaggtctccatctatttgtaccagcctcttctttcctcccaatctcaaggttactcttaaatactagtaaatgcaaaaagaacttgtaaagtggcaaggcatggcctatcaaaagtcagcccaagggcagttttcagccctgcctcacctgggtctagctcagctggcgggtgagctgattgatgtgttcaccccgatagccaggtgtgcccatctccttgaggaagcccactctatttttggtagcatgagtggacctggagcttttgagataagtacacattttgagataagtacatagttagataagcttgccctgtggggagcatctggtgaagggaaggtaaagggtatcattgcgtttctaaagaactaagtctggattaagaaaatgtggcacatttacaccacggaatactatgcagccataaaaaaggatgagttcttgtcctttgtagggacatggataaaactggaaaccatcattctcagcaaactatcgcaaggacaaaaaaccaaacaccacatgttctcactcataggtgggaattgaacaatgagaacacatggacacaggaaggggaacatcacacactggggactgttgtggggtggggggaggggggaggggggagggatagcattaggaggtatacctaatgctaaatgacgagttaatgggtgcagcacaccaacatggcacatgtatacatatgtaacaaacgtgcacgttgtgcacatgtaccctaaaacttaaagtataattaaaaaaaaaaagaactaagtaggaggtaggaaacaaggggaaaggaggaaagaaaaattattaaaaaataactcttactcttagaaaaatgggagtacttggttacaagtctagtccataaattaaatgtataattatagataagttaccttttaccacttatttccaacattccaaaggtcacacagctggtaaacataacacagctgggaatcataaatattgctaccaccaccactacccacccaattattgggggagtggggagggtcccatgactgtttcccagttggatgaaataagaaaccaaaaatgagtttttcttgatccttgaattgaaaactccatttttacagaaagaaaagacattttacaatccatttctctgaaaacatccgttctttatctcacaggatgtaataacttgatgggaaatttaaacgcaaggttattcataaaatggtaaatgaggggacacctggcgtgagagctgcagcggcatttccgacacactgctgccccctgctgcctgatacatcgttttccttcttcacgtgtactcaaaattaacactgtctgtcacccagattataaaatcatactgaggagaaaactgaggccctgaaagtgatctggatgacatggatagtagaagatttagattatggaaaagtcacttcttcctgctttaccatattgccttttccctattaaattaaaagtcaacaaactactgtgtgcctacgtagaagtactcaaaatggagaagtgaaaatcaagatctttgcacttacataactcatattcttgtgtgagtaaacagccaataaataagaaaaaatcaataaataatttaagagaataatagatgtattaaatagtaacaatgataaagatttctggagtactaggagaacatggaattcaaggcactgttcccagtgctttccatgatttctttcatttgattctcactgcaacctgcaaatagctacttcactttacagatgaagatattgaggcagggctagaatgatcctaagtgatggaaccaagattcgaaaccaagccacttctgactccagaagtgtctagggtagtctgctctgagaaggcaacagtgaaatgaagagaagaagccaggcttttgaagatctaagggaagagcaagcacaaaggcctggaagtggaagtgagtttggtatagcaaggtatagggaaaaacaaacaagcaaacaaaaaccatcccatatgattgtactaaaggagcatgcagaagactagcagaggccaggtcatggtagggagcttggattttattctaaattgcaagaggaagccattgaaggatttcaatcagagcaccaacctgatttatggtataaggagctcactctggatgttgaaaggaaaacagatggtaggataagagtttcctgtttctaccatttatatagacattgcataaacgctagcaatactgaactccatgttttctaaatgtgacccctacagtctcctgttcctttttcaggtgttttcctctgtttagaatcccttccttgagtcctctcctttccattgcagcctgccttttaagatttcttttgtgaagctttcccggattcttcaattatataatttccatcctttgaactctgtatatttcaagtatagcttttctgtgttaacctctgtcctaggatatctgttatttgactgcctacctcacggactgttagatcccaatcttgagatcaagggctaggactttcaggccatcctgtataagtatgcacgttgactccttcacaagggcacccgacccgccggaactctgctaaccaaactgagctccctgacacaggctgcacccatgaaggggagagtccttttttgtctaatttgtatagagatatcatataaaatagtggatccagaattgatttctttcatctttgcatccgaaacagcacatcacatctagcaatagaagtatacacatagtagatattttatcaaacctttttattaataattgattctgatttggccaggcacgatggctcatgcctgtaatcccagcactttgggaggccaaggcgggcggatcatgaggtcaggagatcgagaccatcctggctaacacggtgaaaccccgtctctgctaaaatacaaaaaattagccgggtgtggtggcaggcgcctgtggtcccagctactcgggaggctgaggcaggagaatggcgtgaaccaggaggcagatcttgcagtgtgcagaaatcgcgccacggcactccagcctgggcgacagagcgagactccatctctaataataataataatagattctgatttaactaagtccagttgtggaaagtaagatgaaaaactcaaggtttatggtatgctttactcatttaccaaggctatatgcagaaaggaatgggattggacatcctgccaagcccccctgcacagccaccatatctcaattgcttgataggctgtggtttgtgtaaaaagagggaaacaaagcgtagatgacagatttaaggtacgtcaaactggaacaggccgttatgttgaagtgttaggacactgcagtgcaccacagtctatgataccatggtttagaaaccttgaggacttttgttaagattgctgatgacatattttcagcaaaggtcacaatatccaggggaagtaaaatataagggtgtattcaattgctgaggctttattttttttttctccagctagcagtgtaaaggacatgtgtctctattttgggagctgatttcttcttagtccccattaaagtgaaactctaataagggtatgtcagcaccaatgtttctatgtaagaggacctccttgtcatctttgaaattaatttgaaattaaatgattaattcatcgtctgtttccactggaagtttgtataagtggtcctaaaaccagcaaagctggggatagtcctctttgttacatgcaagactggaagaatcatgtcagacccccacggaagccttgggaacccacccttaactgctgcttttgttttcagaaccttattagttgagagttgtacctcctgttttcagacctcctagtgttctcatctgcctttctgccttcagtgtgagtacataatctcttctcagagcaagtttagttgaaaataaagttttggcacctaaaaaaataagaggaggcgaccagcaagactgtgaggcatggaatctggagcacagggatactgataagaatgaactgattcatattgctgctaagactcagaactgacctatgaaacatagcagagtgggcacaaatgaaccagagccgggctctcctcccttggaaggtgctcagtatttacacaatgccccttgtctgtaagggcaagtactacatcagagggaaattggcaggggaattgttggaactggaaagtatcagagtgatgaaagaggcagctcttgtttagctctgttaagctgttgctctgcagatgcctgcccattgctgctagatttttcagtggaagttgatgttctgcatttttatgaaacactttctattctttaaatgttgtcaatcaattcaaaaaagcttttgaaacatataggcaaaaccacagtcttctttgtgtggacgaccagtttgcaacccttgccttaaaattataaccaacttctgttctctagactctgagaaagaagcatgcacagaactatcattttgctttgttaaaaagcagtctgatcattaccttctctgtttaaagaagtatcatttctccttaagagtgtagaactggccgggtgcgctggctcacgcctgtaatcccagcattttgggaggccaaggagggaggatcacgaggtcaggagttcgagacaagcctggccaacatagcgaaaccccgtctctactaaaaatacaaaaattagccaggcatggtcgtgggcgcttgtaatcccagctacccatgaggctgaggcaggagaatcactcgaacccgagaggcagaggttgcagtgagctgagactgcaccactgcactccagcctgggcgacaagagtgaaactccgtctcaaaaaaaaaaaaaaaaaaaagaaaagaaaaagaaaacgaaagagtgctagaactgtaactcatggggggaaaataggaagaaaggcagcatttatcttgtttgtttgttttctggtcacttttaccagcatggaataatgctggaaatagcctttcttccttgcttgtaaataatcccacatgcctcatagagatgcagcatatcccataaacatttgtgccaggtaaaactcctagagcagtattcaaattctcaaaacttgctgaaattagaattcagtacacatttgagtatttttggaaatggaatctgtagcatgtctagctacaggtgcaggtcaggggagactggtgaatatgaacccttgaaaaagaaagtgttgaataaggatttagatttttgaaaaatgaattctaaatatttcttccttctcctaattttgtaatttcaagttatcatttatttttaaatataaattttagcaaaactttctactgacgcttcttttcttttattcattccgtttgttcaataaatatttattgagcacctactaataccaaagatcagtctaggcacacaagatcaacaggttatcaaaacagatgaaagggctggatgcagtggctcacatctacaatccccacactttgggaggccaaggtgggcagatcacttgagatcaggagtttgggaccagcctggccaacatggggaaactctgtctctactaaaaaatacaaaattaactgggcatggtggtgtgtgtctgtaatccctgctacttgggaggctgaggcatgagaatcacttgaacccaggaggcatagtttgcagtgagttgagatcacaccactgcactccagcctggggacacagagtctcactctgtctcaaaaaaacaaacaaacttatgaagagccctgccatcaaggagcttacaatccagtactaataaataataaatttatcagcaaattagaagcaaatgagtgcaatggaagaagtaaaattgaagcaggttaagagggatcaaaaatagagggtgtacacattgtatttttagagaggtcagagtgggccttggtgacttttcagcaatgactcatagagaggaggttggtgtttttttaattgactttcccactccatagagtcaatggttctctccatttatccaagtagtatacgttaaatggtaaagaactagtacgtggatggggccgggtgcggtggctcacgcctgtaatcccagcactttgggaggctgagacgggtggatcatgaggtcaggaaatcaagaccattgtggccagcatggtgaaaccccgtctctactaacaatacaaaaattatctgggcatggtggtgtgcacctgtagtcctagatactcaggaggctgaggcaggagtatggcttgaacctgggaggcggaggctgcagtgagctgagatcgcaccactgcactccagcctggggacagagcgagactgcacctcaaaaacaaacaaacaaaaaaaagaactagtacgtggtatgtacacctcatagaacacatctttaaaacaaagagggaaagtgctatggtctgaatgtttatgtctccccaaaattcatatgctgaaaccctaaaccccaagacgatgctgttcaaaggtgagcctttgggggggtgattaagtcatgggggcagaggcctcataaatgggattagtgtctttacaaaataggctcaggagagaccccgtcactcctgtgaagttagagtgagatgatgtctgcctgtgagaaagcaggctccttccagaacctgcaggcaccttgatcttggaattctcagcctccagaatcatgagaaatagatttctgttctttgtaagccacaatcattttatgatatttttgttatagcaggctgaatggactaagaaaggaagacaaatttaacacaaacagttctacaaaataaactgcttaaagaatatctgttttgggtattttatatttgtacaataagggaaaggactatttaaaaaatagttttctctcaagcttttagcttgcaaagttcttctcacacatttttatttgatgttcgttataactcattgagacaggtggaattatttccatattctaggtgaaaagatgaagcttacaggtttgcttaagtcactcccccttaagcgatcccacattgcccctcggattccccattccccagatctctgatcactattcacaaggcccttcacgatctggcttctgcttcatttccacagcatctcttgctaatttcctctttactgcccacactgccccaatatctagctacttcctttcactatttgctaagctctccctttcttgcctttggacttttgcacatactattttttgtcacctcctctggccaccctctaaagattatcccagtctccacttgggcatcatttatttcccagtgctagaacctctcatacaaaatcatctgagtccagggccttccccctgttccacaggcacctcctggccactatagtttctcttaatatttctcctttagagtcctacatgatggtccccacccctcatccaaaccttttaaacttgtggaggagcttgaagcttagatagggtgaaatccgtaatctaggtcagccttttctcccctttttgaatttttttcttgacctttcaagatgagagattagtggcttaacacatggcttctctgaaagtttaatgtcttataaggtatctccttcagactcacttctgctaacttcagtttttcctgccaggtgcttcctgtccttatcacagctctatcactacaggaggaaaggtaactcctgcctctctttctgtgggcctctctaaaactcctccagttttgataataacttaccaatcaatgtctggcaatttcacagttctgcgattgtcctccctgcttcctctgtggaagcaagcccagtgtgctcactgtggtttgattcctgctttcaggaaccgacatgtccaaaattcaaaagacaactgtttttaagctacatattatataagctgtatagtaattctaactaatgccttttaatatttttggaaagtttacaaatatccatagaaaacagaagtcatgagctgaacaattgctaattttgaagtgattaatattcatatttacatagtccagttggaatacattcaggatgaaattttagtgtaaacttcaccattgaacaatatcttcaaaaacttaatctcacaagtgagggatattttgcctcagaaaaaaaataaaataaaacaagaggaggcccctgatattttaagcaaatataattacctgaaatagaagctgaatttgtaaagaattatttctcgtgtccttaattttaaaaagtattaccttcaggtttcatttgataaaacttgggaaattattttaaaaattagcttttattttggagaaaattataaacacatgagaaagaggggacattgtagacaagttcagtggcttcatttagtaggcctcatttcatttaaggagcctagctgaaaggcaaatgtgaggatgacattgcctccttctcatgcacaatgagtagttttctttctccccagttgctatttattactgaaagatgaaaatgtcagtatttcttttaacagaagctaatgcagcacctcagatggtgaaaactggtggcaggacacaaagttactcaaccagagtagtttaaaagtgtgcacttttaaaatcaaatgtaattgtaactcagtggtcaaaaatgaaaaaggatgctgagcctgaattcaatatttcatgattagagagacttcttactatatatattttttccttctaatgtctgacctggatcatatttattcctcaaccaggaacaaaaggagattctttaattttcttttgatccacatgtgtattggattgttgtcaaatttcttactggaaaaggttaggttaatattttgataacagataaaatcttcaaagtaagccagaagcttaagtaatgcaagttagatttcatgtgctagaatgtcaaggataaagcgtagaggaaggatttgcaagtcatccataaaatgattatccttagtgtaaagtttatattcctccatgccaacaactcttttaacgtattaccttgtcctttatattcaggtgccagaagaaaccttagagcagcagtccccaaccttttcggtatcagggaccagagagacaatttttccagggacctggggtaggggtgttgggggttggggagatggtttctggatgaaactgttccaccacagatgatcaggcattagattcttataagaagtgtgcaacctggatccctcacatgtgcagtttatatagggttgatgcttctatgaagatctaatgctgccggtgatctgacaggaggcagagatcaggcagtaatgctcacttgcccactgctcatcttctgctttgcagactggttcctaacaggccaagggccagtaccagtctgtggccctagggttgaggactcctgccttagagagtccaagagtagcaaacccatatacttatttggggccaagcagttacaatggatgagcatatctgtcacttgtaagtaataggagtaatggaaaccatgggaatttgagagcatatgtcctatttaaagatattcaaatcaacttaaaaataaatgttgtgccttccatacaaagtccatccacaaacccaatgtggcctgtggctctccagttttctccccttacagtttagcccggcctagactacagtttcttccaacctctcatccaaggcctaggttctttcttgagcactcctaccagtggccattcagcttctgtttgagcaattccagttgcaagaattttgggggactgtcaagtcctttgccaatcatattagtggtggtagtgatggtagtatcttttgtgctttaggataaaatcagaacagattagtgagttttaacagtagattgctctgaccaacaaggatccaatggacctctttttgttttgtgattgttccttgagactctgtccctgttgaggattataatgctttgtttcatggaagatatagtcagtttcagaactgtacaatgtgatcttactttttcttatattattccaggtttacttctatggctcatgtcatataggctgatctcagaagggcctgcttgccattagcattggttcaccccatcacatgcttactgactgatttcttcatgctaggcactgtctaattactgggatacaggagacaaaaggtcataaagagctatcctttcctggggcttacattttagttagggaaataaatacaatcaagaaaacaaaaacatggtaattaaatgttctaataaattctctgaaggaaatagaggctggaggagggaggcaggaggtagccagatcatgcagcctagtagacttccaggctattaggagtttggagtattgtaagaaaatagtgagaagccactgaaggattttaagcagaataactgatcttagggcactgtttgcaaagtgagaacactaacatatattcagtgtagaaatttgagaaaatacccaaaaaagttaaaaagaatatccattatgcaagagaccattacccagagacaagtctggtgtaggatgggaggtatggtagccagaattctaaaatggctcctgtctttatctgttccggctgctaaaacagaataccacagactgagtagcttaaacaacaaacatttatttctcacagtttggaagctggaaagcccaagactgaggcgcaagcagatctgggtctggtgaagcactccagctggcttgtagaagccatcttttccttgtatcctcacatggagagagcccgggcccttccatctaatatactagaaggacactaattccctcatgggttccacccccatttcctaatataaccatgattttaccttctaaaggctccgtctcctaatattatcctattggatttgggtttgggtttccatatatgaattctggggagtcacaaacaggcagttcatcacagttcccaagattcccatcctctggtgtgcattccctgggtactcttttcctcctgcctatgggaatgtgaacatgaataagatttatcattattttgattaggttacattatgtagcaaaggtgaaaggattttttagaaatgtaattaaagtgtttgatcagttatattaagttttttaaggagattatcctgtgtgggcctgacctagtcaagggagccctttaaaagaggctctagaggtcagagacagaagtcagagagattcagagcagtagatgcgctttactgttggcttaaagaaaattgctgtgtagagaaacccaagtggcaagaagtgatgggtgacccttcattgctgagggcctcactcctacaaccgaaaggaaatgtgttatgacgcccagtgatcttgaagaggctcagatctgagattgcaacccaagccaacacctggatttcagcctagagagaacccaggaaagccatgccaggattcctagcccacaaaaccgtgggtagtaaattgtgagagaataaataattgttttttctaagccactagatttatagtaattgttgcacagcaatagcaaactcatacaaagggaatgacatgattttctctgtaaccaaactgactggagagggacaagagtagaggccattgagaaagtcaccgtcgtggtctaggcaaaagataagcatggcctggagtggcttggaaagaagtagacagactttgaattatgttttggaagtgaaacagggctagctagctgataaatacagtttggagggtgaaagaaatgaaatcgtcaagaatgattcttacaactttggtataagcaaatgagtggatggtggtgctgtctagtaaatattgaaagaatagggaaggaatattttgttctgtggagttaacaagagtggtggaagatggtgttcagttttattaatattctattttaccaaattagaagttaggtgaacttcatatacatatgtatgtgtatatatacatgtatatatgtatgcatgttgtattacatatgattatgtgtttattttataaaaattatgatagtacatttcttcatgttactttttctccacttaacagtaaaaacataaatattaataattataaaatattctaccctgtgcagtcccttattcctctattgtttgttttttgttttattttgttttgtttgttttttgcttttatgttgtcctagtgaatattcttatcctttcaggtttattcaaatgtattagattacccttcagaaagatgatttatatttacattcctcataatggtatataagaaagctagttgaccccattttcaccactgggtattattattttaaaagcatctttgccattttaaaggtaaaaaaactcacttctctattaatgtttcatagcctgtatatcttgaaggtatgcttcagtgttttgtactatttcttcttgcctggcctaacatctctcactgtatttgacatgcgtatgactggagtcaggtcctgttgttagtaagaatgatgccattaagtcacacatcctctgtgataacatgggtattacctctgacatttcttgagattgtatctagaatcagaaagccttgatgctgtccttatatacaaatcagcttttttctaaaaacatacagtgtatagttatttttacaccttgcctatataaaataaaaagcaaaaaaaaagtcagtaacatttttcatctggcttttctgtattttttaaatggtatatggtagataatactaccatctttttcagctaaaactgtcaagtaaaacctccacaacgtatttcaagaatcagttatgagaggtgtattaagtgaatgagagtgtgtattatttaataatagctccctttgggtgatgggtttatgatgggtgattgttattttgtttttgttgcttttctatattgccaaaacttttaatatggaacgtgtaattctcccttaaaaagaaaggtttgaatagagctttaaattttaataaagagtactttaagatgtcttagaaagcaagtctgtaaaattgctttaaaaatcaagaacagggccgggcacagtggctcacacctataatcccagtaatttgggaggctgaggcgggtggatcacttgaggtcagcagttcaagaccagcctagccaacatggtgaaaccccctctctactaaaaatataaaaattagctgggcgtggtggtgcatgcctgtagtcccagctactcgggaggctgaggcaggagactcgcttaaacccaggaggcggttgttgcagtgagccgagatagtgccactgcactccagcctgggcaacagagtgagactccatctcaaaaaacaaacaaacaaacaaacaaaaaacagaagaaacctgaacacttgcagggattaaatgggaaaactttttaaaaagcaggtgtataccgtctattaactgtgtgccatagcacttggccacaaaccaagtatacttttgaaacccctaactaatctttaaatatattttcaaacaccttttaaaaatgtgtcaggggcaaaaatgtcaaaagcattatgactcctatgggtgaagggataagccacgatgcttgaagtcaggggtcttggctttcacagggaaagacaggatttcaccatgttgtccaagctggtctcaaactcctgacctcaagtaatccacccgcctcggcctcccaaagtgctgggattacaagtgtgagccacccgtatacagtattattgatatcctccaaaccagataggatatttagctttttgtaaaattctataggtattaaagcttgcagcattaaaaagcactgcttttgaactctgacagatgcagacaatatatccagtaacaaaactgagtttctttactaacatattttgatagcgtgaccttaaacttgagacaaaaaggagagaggaagagttttattgaataaacgtttctaggaaacagatgcttaacaaatggttgtacagctgtttgcaataacatggaagaagcctatctttcgataattgtgacataagtttttcttgtttgttctcctagagttgtctgcaaaaagtttatgtaatatgcctgaaggttatactaagaaggaagcatttcagaaatgattgaagctgtttatctgtgtgcaaaagcctgtaagtgtgtttgtgtgggcctgggcacgtgtatatgcctgtgattcacacatttcttttcacaaaagatttgaggtcactcaggatgtcattcatcctgggtaaaagccacctcagattacaagcagttaataggtcagatgctacataatgctctcttcaacttagatttcttaaaatcttacaagttgaaggaggtgagagcctgggacttttaatttgcactggggcaaaatcgttcctttgtgctgaaaacatgtggctgacaagatgccactgggaaagccaagcttttttagaagagtttgctgtataattcataaagataaaatctgtaatattttatacttgaaagctaaaattttttaaaaagacattatccaaatcaaaactctagcaattaaaacacacagatagggtatggttgactttctgcaatgctaatctggtttctgtcttaggtctatttgtacaggacagatattctactttattctccaacaagactcagcctggagttgcctggtgacctgctttaattgagccaaccacattctgtaggggaaaagccagaccagaaatagctaggatttaatggtgagaacaaaggcattcctaaaatcctcaaatctgggcctagcatggtggctcacacctgtaattccagcacttttggaggctgaggcaggtggatcacctgaggtcgggagttccagactagcttgaccaatatggtgaaaccccgtctctactaaaaaaaaaaaaaaaaaaaattaggcgggcatggtgggcgcctgtaatcccagctactcaggaggctgaggtgggagaatcacatgaacccgggaggtggaggttgcagtgagccgagatggtgccactgcacttcagcctgggtgacagagggagaccctgtctccaaaaaaagaaaaagaaaaaataaaataaaggaaacacaaaaaacacctcaaatctgatatctcccacttcctacttaggttgaaacaacatatgacttctctaagtctctatttttattttcaataaaatgtggatgataataataaaatgtggatgataatcccacctcactatgggatgcaaagtgtttaccagatgtattatgtttcctattgcagttgtgacaagtcatgcaaaagttagtggcttaaaacaaatttattatattaagtcccagcattctgaagtccaaaatgcatctcactggggctaaagtcgaggtgtcagtaggtctgtgctcctttctagaggccctgtgggagaatccattttcttgccttttctagcttctagaggccccctactttccctggctcttggccacctaccatcgtcaaagccagcaatgtcccagcaagtcttccttagagcatatcactatgatactctttatttatttatttatttatttatttattgagacagagtcccactctgttgcccaggctggagtgcagtggtgtaatctcggatcactgcaaccaccacctcccaagtccaagtgattttccttcctcagcctcattagtagctgagattacaggcatgtgccatcatgcctggctaattttttttttttttttgtatttttactagaaacagggtttcaccattttggtcaggctggtaccaaactcctgatctcaaatgatccgcccgcttcagcctctcaaagtgctaggattataggcatgagccactgcacctggccactatgatactcttgatatcatatgatagctcttgcttccctcttccacttggacctttttgattacaatgggcccacctggataattcagtataatttcccatctcacagtcagctgcaaccttaattccatctgcgtccttaatttctctttgccaagtaaggtagcattcacagattccagggatcaatataagaatattttttagggggtcatcattctgcctaccttgttggagtacctgctactaaataaaaacaccaggaatggtagtttttgctgttcttaacccaaaggaagaaagagcccttctctgaatggtttttgttgtttagttaagaaaatgccaactgaccaatgtcccagaaaccaaatgggtgtagagccctagcatgcttcatttcaacacctttcacaaacagtagttttggcactttgcctaccaagctgaaaaacaaagagcagggttgttatgtctgacctaaatacacatggtctgtaactttcctcttctctctccatacctcttcccttcttgaagatattttactgctggggtatcaacttatttacatgtagctgactcctcagaagcggaacttgaatgccagccattctgtcgagcttaaagcaccacaatccagctgtgagctaggcaactttccccttatattttgtgtgcctctgaaaacatctccagaattcaaatgaccatttttgacataagttatcccttcctcccctctgattgcaagggcagcatcactctttctgccatgcataagtcaacatttggagtcaatagccctcttgtactaacactttcacagtcctctcaagtagccttcctcactgtattatccaagttcaaggattgcttacacttacctggactacaggcaaagcctcagaaccatctcctgccttccttcactgatttgtgtcatcactccctggaggtctcaggtccctccttctcatctcttcttccttaaatcgatccttctgccttaaatcagcccttctgcttagcattaaataagtctttgtcagcatgccaaagggtgcagggaactatttttaagcagccaccatatgccagacattgtgcttagacattttgcatacattatctcatttaatcccaacttaatgacctagcaggtcgatgttatttcctctttctttttctttttctttttcttttttttttttactagtgaggtaactgggacatagagaactttatgtaattcagccaaacctacacagtatgtagcaaagagttcagactcggctgtgtctttctttaaagcctctagttttaccactacattagacccgtcatttgactttattttgaaggtatctattttattagggtgggcactgggcactgtggctcattgctgtaatctcagcactttgggaggccaaggcaggagtatagcttgaggctaggaatttgaggccaacctgaccaatgcagtgagaccctcatctctaaaaaaacattattttttttaaactggtcaggcacggtggtatgtgcctgtaatcccagctattcaggaggctgatgcagaaggatcatttgagcccaggaggtcaaggctgcagtgagctatgattgcatcactagactccagcctgggttacagagcgagaccctgtcctctgtctctaaaaaagcaaaaaacaaacaaacaaaaacgatgaaaaaaaaatccattttatcaaggcttacctgtgctcatgtactttatgggcaaatctttcaatggcctaatgacaaacatattatggttgggtcatcttggtggtggtttctgtgggaggctaaagactgctatgtgtactattttttatcagagatctagtactgtcagacatctgcctttgaagtggcttgtggattaatccaggtacatttctcatattttttgaaaaggatgggttctgagggaaggaaataatttttctatatgcgagaggctttgagtcacagtaagttagagctcttgtggaggtaaataatcttgataaatctgttctttgtcattagagatcaactctcagtacccagtgacaggcccaaacatgcttttattctttgaccaaaacacccacaaaggaaacagaaaccagtttagcaactttgcaagtgggtgcagaagtattcctataaataaagctgctcattgtgcttctctggtcatgttaggtttggaatgctgatgggtttatatcgtcctactctgaattcttagtgacaacattgtgaatttagttctagctgatgcttgctacattgcattttttagtatttgaattctgctactccttaaaggtgactgaaatcataaagcccattttgtagaatgaactttgttccccacttatcactccaccatatgctttcctgattgctttctgtttttactttcttgaagagagaaaaacataacataactcaatcttagttgatcttagtaaaaggaagaatgtgtgggcagtgggacgtggtgggtcatgcctgtaatcccagcactttgagaggctgaggggagaggatcgcttgagcccaggagtttaagaccagcttggacaaaaaagagcccatctcaaaaaagtaataataataataacaacaacaataataataaaaggaagagcacttcctgggccttgagaagtcttcttgctcacaaagaagcatcaaagcaagtgctatatacacaggaggtcagtttgggcaactcttttttaatcacatagtagctttgccctcatggattctaagtagatagataatagaaaagttgtaagaaatggtcttcagtaatataaggaaatactctttcaaacctattacttttttatcggaaggaaaatttaaacagaatcaactattctacataggtcttaggtttttgtgtaattgtgaaaacaacatagcagaagaattaagactttaacctgaaaattaaaagtgctctctggagtcattattgggttaattgtcaaagttagaatgcagatgacagattacagaaaagtattccattcatgtgaaattttccaaagttgaaagttacactatggttatataaaagactacccatatttataggaaatatacatttcctatttagaggtaaagggctatgatgcatgtaatttacactcaaatggttcaataagtatatatgtgtgtgtggtatgtatataacacacacacacacacatttatgagagaaagagaacacaaacagaaagcaaatgggataaagtatgaacaatagttgaatataggtaaagagtatatgtttttcctaaacgatatcagttcacatctgtgggaagatgatgctcaaatttaaatttctagcccagaagattatcataaactctagacccataaatccaattgttcactagtaatatacagtaaaatatttcacaggtgttttaaaatcaaccttttgattttttttttttttttataatttacccctttaagccagttgccttcagtgttctttggcaccaaactagattctttcctctccctcccaagtccccaccaacactgctacaatccaaaaattctgtctattcaaccctgcaaattctcatcagttgatccacttctgtcaatcactgctgctattattcagcttcatatatcacacagtttataatcatcatcttctaagtagtcccctgcattcaggatgtgcctcctccaatccatcttctcatttgcagctaatttcagatgttcaaatctgatcttgttcatgctctgcttaaaagctgaagtatctctctgttaccctcagatcaaaatccaaatcctcaatacaattacaatgcatgtgaagacactggttcttgcttatttttctaacctcatctctctcctctcatcctaccatcgtttatcctatcctgtctcgtaccatgccacagtctcattcgactcctttcagtggaagttcctctggctgccaggcctctgcccatgctagtctctctgacttgagcactttccttttcccctgctcccaactacctgttcaatacataatcctacttgcctgacttactctttcctcctttaaatcccaacttagatgacattattcgaagaaacaatcatgacatcccaagtctgatccaaccaataattagatgcaaatttaaaataaagtaataagattctgcctgtttttaaactagcataaagcatgtacacagtccttccgtcaataaggttttccttaaacatttattaaatatctgttctatgcccagcaacttctgattgggtcattgaacagatatttatttattgatctcctacagtgttccagacactattttgggtgcagtgaacattcttagaacttagattctaatagaggtgactaatcacaaacaatgagatgggtagtatcagttagtgataagtggtacgaagaagaaacttgtacagggtgctgacctagatacagtagtcagagaacacccctctaaagaggaggtatgtaagttgggacctaaatagaatggcagagcaagggctggccaatgtctggggaagagcattctaagaaaagagaaactgcaagtgcaaaggctttaagataggagcatgcttggtgcattcaaggaccagaaaagaggcctgtctgtgttcaactcagtgagcaagatgtgttggtggaaaggagtcctgaaggccagaacctggagtgttgagcagtgaatgtgctttgtcaggttcagtttaactctgtacgcatttcatttgtccaaataactttgtgagtgaatggagaacacaaactgggctgcattttgtatggaggtcaagggtgatcgaaagagagcatccctagtaaaaagttatttccctaagggttaaagattgagaattggatagaccctggagaaccagaagggtgatgtcagaaaggtagaagtaagtagatcaaagtgtttgtcccacgcaaattggcagcgcttgtcagagtgtcttggcatctaatctctcccctctgccctttcccacccccattcattcctaactgttccaaaattaacttagaacatctttattctttgccagcattaggtggggatggagagtcctgttgcctgtaaacagcagtgacttttgtaaggaagtataacatattgtttaaaaaaataaaataatgaattcagtttttacatcagttttcggcacagtggcctaaatagaccaaatgtagcatacttttaatttctatacctttgtatggtaaaaacacataaaaacaaaaaaaaaataggtcattctgtttttcgtgagaactgccttatttccaggattaattctgtatgactgagagagcttgaattatttccaaaaggatagctttgcattttcttttcttgttaatcagtctctactcatttcataattttctccttcagtttttttttgtatttgagctttgctttttcccttttctcatgttcataccttaaagattgtctaccttttgtagaaaaaaatattattctgataggaatactttttaaaatttgtgtgaaagaaatgtaaatacatatataagatagaaaggaaactggagaagaaaataatatggaaatgaaatagtatatataaggcatataggttaagtccagtgaaactgtataaggtaaacatatacactgttaagcagtctccaaagcatgattgatgtaagtacctaaacaataactttatataattttgggggggtataataaccttcatatataacttgttacatatgtatcattcattttcttcagatgactttttatagaagcttgaaattcaagctcaaaactcatttcttattatgatctgagaattttttctttaattcatttcctttctgcatctcttatgacaattttgtattttctaagtcagatagttaagaaaatctttgttttcaggagttcatcataatgcatttctatatgtttaggactgtattaacattgtttattttgacagagcaggcaaaatgtgaagtacctacatacacttttatggctctcacttcttgaaaattttaaagcatttattgagtatttattacattccaagtactattctaagtatcttacatgtattaaatactttaattctcacacagccctacgaatactaagattctagttttacaggtgatgaaactgagaggcaggtgggttaagtaattggccctacacctcaaggctagaaagtgaaggaactgagatttgaaccctggtcaactatcttcagaatcataactgctcatcactctgcaacacgtgctttcaggcaagcgttagtcagtgcagctcagggaaaacaggaggcaagttgactacttatgcagattgctgagaaatataacaggagggaagaacagaatggaaaacatgcttcttacctaatatgagacatttttccctagggaaaacagaactttggctatttcccttcaagcagaagaaaatatgttcacacagagggaaagaggaggaaatgaaaagggctgtttggatcagatggctgaatcgccagtaacccgagtgcttagcgtaggctgctctcaaacgtatagttgctcattaaactttaattttcattgcatgctacctgatctggtttagtgaaggctcttttatgcaacctaaacttatgggaattttgtgatgtatttaatttccacaaaacctaacatacttgatatgtccttctttttgagtcagagtttcgctcttgttgcccagcctggagtgcaatggcacgatctcggctcactggaacctctgcctcccaggctcaagcaagtctcctacctcattctcccaagtagctggaaatacaggcatgtgccacaatacccagctaatttttgtatttttagtagagacagagtttcaccatgttggacaggctggtctcgaactcctgacctcaggtgatctgcccaccttggcctcccaaagttctgggattacaggcgtgagccactgagcccagcctgttatgtcctatacatatcagccaaccataactgtcagtgtaagtagttcaaaatttctcctaagaattactcttaaacacctactctcttcccctgaaaatgagttaactacttagtaagtaacctttctcacagaaaaactagatgttttctctggaattctttcccttgcagccatcccctggaaagccttgttttagaactgacaccatttatatggcttggcatctcgactgcatttgtttccccatctggcacttctcggggtgaaagtgttcattttggtgttctgcagagtgcattttgagaaatgtgtacacactacaagtgaaattcacatctcaggctaagactataccctcagcattgcaatgtgatattagcaaaagtgcttttataatcctacctgccaacaattcacatctataattaggaaaactacatgatttcaaaattacccaagtcttggaaaggcttgtttttaccatatgtttttcttttgtaaaaggtctattattttcaccgtcttaaaaaaggttcagtttgatcaagttctaattatattctcaagcacatttttcaatcccataaaaataaatcaataaacctagacatttaagtcactttatcacaacttggtcaatctacatggtgtgacaacagatataaggaaagtagataagtccgctaggatataaagaaccaacttacagtaaaataaataactaaactagaaaaagaatctagaataaaaactagagatgtagaagcaagagcatttttgactgccgtaaatcagagcttcttagcagcccacatcccaaaagtggtagatagccaatatttgtcagaaatgatgattgtatacctagtggacagctctaagcacaattataagattgatttcgttttacaaaaccttgaaagaagtaaacttaactgaccagtgacttgagtctagctcctatcagattcccaatgagagcaaagaataaagaacaaatggccaaatattgggaaataggtatcttatagatatgacatatagataaatagatatatttacttatatacatactgtcatatgaccaattcataggtgtgtttgatatggcagtgtgtgtgtgtatggttttataactctctcattcatattcagacacaatgcaaatgtagatagtattactataccatctatttgagatgtaaatattgtaaaagccctcctttgcatattccgcagatgctaaaaaccacatgtatttatgttttgtttggggtgctgcttctgtgtgtatgagttttattgttacatgaagtcttgctttaaaaatttggctgggcatgatggcttatgcctgtcatcctagcactttgggaggccaaggctggtggatcacttgagctcaagagtttgagactagcctgggcaacatggagaaaaataggccaggcgcggtggctcgtgcctgtaatcccaacactttgggaggccgaggcaggtagatcacttgaggtcaggactttgaaaccagcctgaccgacatggtgaaaccctgtctctactaaaaatacaaaaaattcagccaggcctggtggcacatgcctgtagtcccagctactcaggaggctgaggcaggagaatcacatgaactcaggaggtagatgttgcagtgagccaagattgcgccactgcactccagcctgggcaacagagtaagactccgtctcaaaaaaaaaaagaaaaaaagatggccgggatggtggcaagcacttaaagccccacagctccagtaagtccggaggctgaggtgggaggatggcttgagcccaggaggcagaagttgcagtaagccgagatcagactgctgcactccactcttggcaacagagacagaatctgtctcaaaaaaaaaaaaaaaaaggaaaaaaatgccaattcattcttgctttctacctgctgctgttgttttccagaagtctgcagctatgctgaatgatttgaacaggaacatcaaggcatcttcaaaacatttctgttctctccttatgctcaccttataaagctgcaaggaaacattgtgtcattaattttctatacatagcgtgcttggcaaatcttggagaataagcaacatctcccagggtggttgtgtgcataacatgagaatattcgttgaagcactttgtaaacgataaaacattacacatagtaagtcattgttatcattggcattactttaatgtagtagaatggaatccaggactggaataagccattcatgtcactaaggaagagaatggaaattaatatccaatgaaacaccttctttttttttttttttttttttttgagacggagtcttgctctgtctcccaggctggagggcagtggcaatggtgcgatctcagctcactgcaagctccgcctcccaggttcacgccattctcctgactcagcctcctgagtagctgggactacaggtgcccgccaccatgcctggctaattttttggaatttttttttttttttttttttttttgtagagacagggtttcatcatcttagccaggatggtctcgatctcctgacctcatgatccgcccacctcagcctcccaaagtgctgggattacaggtgtgagccaccgcgcccagccaaacaccttcttatagcagagtaccaggagcttaactagaagttttacataagttacctcatgtattgaacagcattcataggaaatactggaactcttaaaggaaccaaatagagtttgtattgaatacaaatgtagctccatagagaagattagacatcatgaattttcatttgagaatgaatcatcttgccaatttatatcattttcctgcaaaagcttattggcttggtcatgtactttactagtcaatgaccagttattatggagttgtcagaacttggccaagaccataagctctatattacatgcaaaatcttagtattattactatttatacaacttcagcgttgtgaactggtggcaccatgaactccattttcttcgtgatcattgtcacttcatcaccttgtactaactctgcacgtggtttttgacaatttgtttatcttttaaatttacccctgaagcccacctgtttgggcatccattagttcttagactcatgaagatcttcacccactgacttgacattgtctgttctcaatggttgtgatctctgccctcaaataaaatatgatgttacagtatgtatatatctcagtgagttgctgttgaagggtctcataaaaatgtgatgacagggaagaaggaaaggcagttttccaccacaatcctctccaggattctaaagtttaaggacataaacagtaagtcagaagcagccgggctataggtgctgccctttacttctaccgggataacagggaatgtggattaaaagggggctaagggctcatgcctgtaattccagcattttgggaggccaaggcgagtggaccacctgaggtcgggagttcaagaccagcactgacaacataatgaaaccccatctctactaaaaatacaaaaattagccgggcatgatggcgtgtgcctgtagacccagctcctcaggaggctgaggcaggagaatggcttcaacctgggaggcagaggttgcagtgagctgagatgaagatggcgccactgtactccagcctgggtgacagagcaaggctccatctcaaaaaaaaaggggggtgggtgctaagtacaaagaaggaagttattactacttttatccattcttttaattactaagcagttagtgctgttgtgtggactttcttctttccctcctagggaaaaaagactaaaataaataactataatgcaaagcagtgtgaactatatccattatgatgcaattggaagttctggatgcaaaacatcaaaattatgttctgacaatggctagcagtatttacatatctataaaggtacagaacaccagcctggttcatactcagcttatcaaatctgctacctgttgttgctattaggactataaaatagagatttgttaaaggtggccatgccatttatttactttatgataagaaattgtacagaggctagatattgagtcttgtgatctcactccatgatagactttacagtatcaacttagtaacgtatcatacagagcatgtcgtcgtcaccgtttctaaaatgttcagtgagccaagagcaagtccacagtcacagggcaggtacagtgagtttcctgtgtgcagaaacagaaacctctgaatcttgcacactgccaccaggggtcagggaccgggcgggaggagaaggcactctggcagaaaggaaatgttatattaccctgagaagcacaggaatcaaaattcctgtctcctcttcttgaaagcagctcactgctagctgagcaaggttcgaaggaaggacctcagaaatgttctgccagcgcaaaggtatgtgtaagtgctctcttagtggctttaaataagttattttggaaagtcagatacagcggacattaaagggcacactttatgttgcattttcaaagtccagatgagctgtatggatctgtgacgatgcagttggaggttctatagctactgcctccaaaatgcaaatgtttggctggggaggttaggagggattaaactgtgtcagaacactgaatctaaatagaatatctttctaaaaagactttacatgtgtgtaaattatttctctatgatttgctgtagatactgctgctaattatgattccataagtactcccagaaatagattcagacataatgattttgagtctcttcatgtccagtggccatttgtaacaagtccttagcgatttattttttattcattcataggacaacatttgtcagtaagatttccatgttgccttaccttattcttcactcaaaaattgtccctaactcgggtaatggcagtgatcaagtcacatgctctcacttttgtcaccactgtattctgggtttcaaagacttgtaattcatttcattaagactctccaaaccatccccttaaacatttgtttaaatgtctctgttcttcattagcgttttattacgttacattctctaggctccagaaaaacgaggcaagaaataggaggatttttttttttgccttttttcttttttttggttgaagttttggtcaaacaagccaaaataacattatcattaaacagatcgacctgtacttttaaatggaaggaataaagatataaaaagaactgaggcgtgtaagtaacctctttgatttttaatggcatgcagcagatggaattcattattgactttaaaaaatgaaattgctctgcattattatttatttatagttttgcctttcaaaagaagtaattaccattactaggttagtttttcctcaatcacaagcaactgtgtgacagtatcagaatgtataatatactttaccacttatttagacatgaggcttaatgatgttgcaggacattatccctttttaagttagtaataaatttatgagcataatgcacagctaagaggttgactatcttttctttttatctgggtaatttcaaaagcaattatttcatatcataagacaatttatttatgaaattctcattgctgaaacaaaagtgtttttaattagaaataatctaatttcatttttccagttcagcacacagatactgtgatgataatcataatttatacaaaattatcaagtgaaatgtttaggtgattggttttgagcccaaacaattttttaattttaatcacaaattctaaaacttttaagtcattggggaggttgataaccagtcataacaaaatttaatttttaagcaatgccaaatatttaatcaattatatctagttcaaatttgagaggtactaaaattgcctttgtaataaaaaaatacacaagaaaggataaaaatttttagtattaaacatggagctgtcaacgctataaaaatgtatgaaccccttttcaaagctgatgttttaaggtatcatttcatatacaggacagcatttatatttaataagatcaggagatttggcgtgagcaggattcagaccacttttgaatttcaatgaaactcctggttcaattagatccctcttcccatccttcttacccctccccagcccattctcctttccccttgctgcttctgcctctgtattcctctctctcctcctccctcctatgccttatatcctcttggcacttttacactgagacatctacaagtggatctgctgtcttcagcagtggtcattgttgtgaaactgaaggatagcaatgaatatttcatatatagcacttaaacctcttcatctagattatgcattttgcttcattgtacccatccataggcacttaataagtgcttatcgattgtctagtgagattgtattataactgattttgagacttttcataccctctgcagttactagtactatatttctttgattctaagatgtacatttttttcaaattttaactttttaaaatctaaaatcaccttgtgatcaagctgtattgtgatttaattgacagtttttttttcaatctttctttcttggtcatgcgtctcacaatcagtggtatcttagattgatgaaatgcagcagtgaaaatatatacctaagtttgtgacttgtataatatgttaaaggccatatatttggaacttcataaagtcttcttttttccttacgtggcttatctgtggccaatttttgtctctcctcactacattcttccactctggcttcctggcactgtggttctaactgttcttaggccactgtcttgactgaactccctggaaaatactcagagaattttattagtaattaccaatattcaactgtaatgaaatggacagggaacaagtttttaaaactgaagacccacattcaagttatgtttctgctcattaaaagctatgtgtatttagcaatctgataattattcccagagcttcaaattacacatctaaagaaggaaataatacaaataatttctttatctataaattaagacaattagtaaaaaatattgtaccagtaaaaatagtgaaaatgaaatgtgtatgacagtactttttaagccatgaagtactgttaaattataaaccataaggatcaacattaaatgaaacattattagaaatgtgtgagtagaaagttagggaaaggaaagaaggaaaaattaaataattcattccaaattagaaagttttaaattatcattggaaatgatgatacgacccattaactagctttctgaatttagaggagaaccgtgaaatctatcttcagattatttcttgcatatcagagtcctgtctgttctgaactccagtgctgaatgcatgccaatctctgagagcttgtatcctttattgaattagcaagccacaacccacagtatctctgtggtattaaaaataaaagagattacttagattccccacttcctttcctgccttgattctttccatttaaaagtgagacccctgtctctacaaaaaattcaaaactaactgggcgtggttgtgcatgcctgtagtcctagctacttagaagactgaggtgagaggattgcttgagtccgggagttccaggctgcaatgagctatgacggcaccaattcactccagcctgggcaacagagtgagatgctgtctctaaaaaaaacaaaaacaaaaatgaattgtattggttttcacagtttcaaaaacattcaataagagtaaaaaaaaaaaaaacttgttatttttgcatctttaaaagacaggatacttcaatggcacttgaaatagtactgttgaatagaaattccattgcaatagtaactataaaacacaagattatccattaaaagttaatatatttagtatatgtgttacttttgaggatagggatactttgaaaaggcaagaataaagaaaagaaggaagtgccatattaaaggcatgtgcaggttaaaaggggaattgaaggagagggaattcttagtcattacttgaaaattatatttttctactatactacatctgtcagtggaaagtctaaatcactttatttccaaagaccacaagttgtgactctgacatgaacatttagtcatatactggggtttaaaaaatgttcccatttcaatgtattattaataacaacaaacacatcagacccacttgatgttaactgctatacttagtgcttttaattcaccaattcattaacatgttaacacattttggcatgataatatattattcatatattaaactatattcttatttccattaatggaagcatcatttctctagctattcaggccagaaacattggtgtaattctaggccttctctttcttactgaccctgcatctaatcagcccagagatcctgttggctctcttctcagaataaacccagaatctgtccagtccttaccacttgcactgcttcctcctcggtccaaacaccatcatcttttgactgcactgtgcaagagactcccaaccggcctcctgtctctgcttttgctccccaatccccaccccagtcagttttcagtgaggcaactgggaggaatgtggttcaaacatgaatctcattgtatcgctcctttgtccaaacccaaagtcctaatcatggcccacagggccctaactgatcacccccagcacacacacacacacacacacacacacacacaccccttacttcatataattcccccgccattactccactccgacttcactagtctctttgctattccttgaacacaccatgcctgcttctttctcaaggcctttgcaatttgtgtgccctctaccttgaaggctctcctcctagagatccacatagccaacttcctcactttcttcgggttcttataaaattgtcttttcagtgagaccttccctggccactgtacctaaaatttcaaatcccctgcccatcaacagttcacatacactcttctctgctttttttctttttctccttacactaacacatatttatctaccttattggaatacaaacattataaaaaatgaatttttgtctttttccctccatattctagcccttgtaccaagagcagggcctaatacgtagaatgtcttcaaacattatttgttgaatatatcctcagttaaccctgtaccctcaataggtacaattattacccccattttacagatgaggaagttaaggacagaaaaattaagaaacttattcaaagtcaaacaagctaagcaagcgtcagagctaagattcaaacccaagaccctggctccaaaatatatgttcagatcactgactgagtagattaattagaagaagagagctacctatagattcctctattccctgagattttcttcaatatgggttccatccagttaaatggaaaaattgtgtcatctgctactgacaacatagtcagatatagtaaagctcctttttctcattcctctttaatttctttttgtaaaaaaaagtatgagaccttttaaaaatagaaaatatatgtatattttttaaaagcaaccctaatcccacccctgtggacattaaaatagtaataataatgttaacttacacaatagtaaaaaaaaaacactagggaaaagtatgaaatgaaaacatgcattgaatgcctattatattctgtaataagtcggcactctgaggacatatttgttacatggagtctaatgagagagacagacacatactcagacaaactctaaattggaattcagaagaaaaaacatcaaacagaagtcttgtgacagctgaaagtggggcctggtagagtaagttgtggggcaggtgaatagtagtggtggaaagggattgaagaactggagactgaagaaacagtttctgaaagaggaggtgggagagtaccaaagagaaatgtgacttacctcactattttgctatagaggatgggacttagtatgagagaaggtttttaaataacattttatatgccgtagaatagaaattacaggaaaatcagttattgaaaggctgtgttgaatttaacttgtaaaagggtatcattacttatccaaatgcatcatgtgagaaaattgtccagttcatttccccagactacctcaatctattccttctgacaaaccagaacaagaaattctgttttccaaattgttatttttgctaacacattaagccagcttcagcttcctacagcacacatacacacacactatcctgtgttatcctgtgtctgtttagtgttttcattcacatgtgtgttttctttcctctccacccttgtttctctggaaagtcaggttttcgaccaattatttccctgatttgacaaggtcactctgaacttactttcattgaaaccattggcagtatggtctagcttagtgacagactgctgggtcactcaggtcctttgataaaagggcatagtgcccttgtatggtggccattccaaataaggaagtaaagaaggagtaagatatttagataacaaatgttaagaagaaaataatagagtaatgagactggagtagggtagggcagtggtgcaattagcctggctaacgatgggggcatctctgagaaggtgtcattagaattgaaacccaaattgtgagaagaaagcagaaaaacaaggatcgggaagaatagctaaccaggtagagagaaaagccaggtggtagaaattaatttgctttgttcaaggaacagaacaaataccagtaagatgggacagagtggtaggggtacaaaaatgaggtctcagagatagctgagggctgggtatacactcaaactgaccttcgtttacatctacaagcactggaattgctgtttttcaggtgtgtcccaattgtaaatctaccattatttattgtagaaaataacttcacattgctctgcactgtaaaaaacctttgacatacattcgcattttatttaacatttcataacatcactttgaagtttgcagacctgatgtttgtttttggttttgtttctgagacaggatctcactctgttgccgggctggagtacagtgatgcaatcatggctcactgcagccttgacctccctgagctcaagtgatcctcccacctcaacacactaaggagctgggacttcaggcatgtgccactatgcccggctaatttttctattttttgtagagatggggtttcatcacattgcccaagatggtatcgaattcctgggctcaagcaatcctcccacgttggcctcccaaagcgctagaattacaggcatgagccactgcacctggccaagcctaatgttatttctgttttgtggataaggaaattatgataccaaaaggttacatgaattccataaaaaggtcaactccccttccctccccataccccacatgttttgacatgctatgcttgacacccattttgacttgctaggctaaatcaaaattttcaagctgggagcagtcgtgtgtacctgtaatcccagcttgctgaggcaagagaattacttgagaccagcctggacaacaaagtgagaccaccccctttcagaaagtcaaaactgccttttagcttggatagaaaatggatttgtgactttggtataactaagggctcattattgctcaaaacaggaaaacaaaaagaattgctgcaatgaatgaaaaacaggcaaccttggtttgttctaatagcacatgtgtgtagagcaagaatctacattctctgtttagccacattttttattctgctgggtggctagtttataaatcatgtgttggtcactgtcagatttaagttttaagtaattctctctgaaacatgtatttgaggagagcaggacagcttaggcctggtgagatatgttgacaatctgaactagggtaatgatagtttaggtctcctcgcttagccatcttagtcactaaggtgtgtctgcattgtataatcaataatgtttcccaatcttgttgaaatgacctcacatgtgatagcacttaaaaattcaaagaagtgagctatagttacttttcttctatttttcatatatttactttattgtaaacgtatattagattatatatgtctttttaggaatttcagttatatttaatacatatttttttctctatatgcttaaaattgcttttaattttatatcttttcaaatactaatgtataatttttagaattaaaaaatattttctatcaagaagtactattgtgctctgttctgcgttttgtgtgtgtgtgtgtgtgtgtgtgtcttatagcataagttcttacaagaaaaaagacaattttcttaagttgaaaaaacaatctagatacattaaaaatattccagtgttgaagctatcaagcctactttttagaggcaaaagatagctaatcctgtttttccttgtaaaaaaaatttttaaaaagatattatatagaagtatattatttactgactcaactattaactaaaaagccgtttcaccctatgcagatgataagatgaaggttatctttaaaattcattttctaaaaaaaaaaagtctttcctgtttcttgcttattgtttttataattttagttgtatttctacacatgtcattctctgtatggcatggccttgattgaagtttggtgtcttttcccttttcattcagtccttttcatatttttacattaatgtaattatttttgctttggttttctggtttattaacaccttctctgtctgaattattaaatccatgttgtaaatttttttttaccttaaaagtagctcattttcttaggttttttttttttttaacacttacacatttattaagcttgaggtatgtgtttaataatatctttaaaaaaattatttcacttttctgccaagtctcaaagctgctttcctgatttaacattgtagatccctgtaataattttttacaaatcactattaccagatcttaaacttgaggaaaaaattttgtggttattattcactagcgttgtgataaatatttcaaattaatttttaaatatatattataattatcatattttaaatgcatcatgattttaatgtgctcaataacttttgtaaagcactaggatatattttttcttatattatttaaaatattcgagtcctgaaaaatatgaaatgcttggatacatttcctctattatgtttcgatgcttttctccgtagttaacctctcgtgtctacaacaacctgtatctcaaagtacatgcacatgttatgcaaacaactaaaaccaaggcaaaaaaaagtacattctattaagcaaaattggattggaagcacatccgtaaagggaagaattcaggatagaatagtgatatttcaaaagaaaacttggtttctcacagattcctcatggtatatattcagatgttgttacataagagaacattccttccaaattatttagtttctggtgttttgagagaagagtagccttcgacatgtcttaaacttcccttgcattcattactttttaaatgtatgcattttaatatggagactctcccacaaaaatagtggaaaaggactggtgttttacagtggaaatactaaatgctgttgagataaggaaaatcaactttttgaaagaaaaaaagatgaaatgatagccatctgatggttaaaaagtggtaacgtgagatattctatatttgtgttttacatcaattctattatgtctgatttacccttgaatcaatgtagtggcttaatgatgatgacatcatcaacatatgaagatgacaaaaaaaattaagctaccgaactacccaaatgtttttagggaatctttctacttcttccccgcagccaagaagcaattatactgacatttagttctttcatttccagcaggaagcttacctactcttttttcggagatgattaaaacctcatgccacttagcaataaagagaccaccattactggtgggattcatagtggaaagcattaagcattttggcagtgagtcctaaagcctttaccatagcaggattgatataggaataagtggagattgagggcacaggggatccaccagctatcccttctgcaggtctgtatgattgcacttagcagatttcccatgcttactattacacagagagatttactacatagaattcctaactggactcctacctttcaggtttctccctgcctttccaatccattatccacactgccatcttaacagtatttctaaaacgtaaaattcattggttctctcctttaaaaatctttggagatttcctattgccttcttcatgtggtccaaactccttattatggcacatgtgggtctttcagggtttctaacctatattcctagaacctcctgttttctgtgtccttttcccaaagagctgacattaggaatgcctgtccattggattgttgcaagggttcgatgataaaatatatagaaatatttcataatagctagcatttattgaccctttatcatcttaccaggtgccaaagactgggcagggaatttatacatattctctcatttaatcttcatacaaccccaagagatgtaaatgcttttataaactccattttataaatgaagaaacagattttgagaggtcaggcaactttcccaaggtcacacctatagatagaaatggagttgaattttatctctccaactccaaaattgatgcttttatagattttactgttgcttggcacatttcctagtgtacaattccatttgattaaatattcattttttaaaaaccattactataaaacttacagtatctaaaaaatattttggtttgctttccttgccctccaaggttagctgatacctcacttcttggactctttctagatgtcccatcccctctctgctatcctcttccatcttcacacgcatcatacttcaagtgtaatggttgacctgtatatctaatgcctctgatctgttggcacttcacgtatgcagcactgtgtctccattgtcttcgtaccctcagggattagcatcttgatgttcagcattcaatatctgttgaacaactgaaggaataaaacagactccaaggataattttaaagtatgtgggctctctcttttctcacaactgctgcatttctgcttccatttaatgtttaactgcactaacacttcaactaacactcagctagattatgaaagagcaaagacagacttcagagcgtaacagagtaagagagaatgaagaaaagacaaaatcaccctcttttacttcattcctctcccccaccctccaaacttgagagattgtcttgccagatgaggaagagacaaagttgaaggagagaaaaggtgtgcttagatagtaaaataacatttaaatttttttaaagattagttataccttgtgttaagtctgctattcaagtctgtttttttttttcctcatggtcctttttaacaatattttgcaaacacaggaaaacctacattcatggcatttctgagaggttggcaaatgaggaaacactcccaaattctctcctgagaacttacaggagatcaactgatgagcacatggtcaccaagtgagtcagtgtaagttctatgaatagggcttggatcttctgactactcgtctagggtcctagtcatctagctactgccatgttccctgaagaatttggtaaaaatagcagatggcataactgacaaagtaaatcattgtcattgccactgtccatgttctatttttccatgttcagtagcataatttaaaaactcattaatgcatgtatgctattggttattatgtaataatatgtaaaaaacaccagtacagaaatacttctataatttacattatacctttaaatacagagaacccacataatatcaccacaaaggcatttcataaattatagaataaaacacataaatattcattctgcattattattctgctaaggaagagcgcaaacattatttttaacaaactgctctttaaaaaaacttgtgtggtaggattctccatctgtgagtgagattcaacaactataaggtccaaagcagatttggtactctgggagaaaatagtaataatgtaaaacaaaataatagtcaatgtgatctaaatacagtatatctataaagtacaatctctttcttaagagagagaaactcctgcctctgcctttacatttattagacaaacattaaaatctcaccaatttaccccctttgtctcttctttatatagggagattgtggcttagctttctctgggagattgtggcttagctttctctgtagatataaaaggcaaataaagcctgggtttgggtcctagcgctgctaccagacaaatgtggaacagtagaaaagtcctacaatctcctttagcttccgtttctttatctgcaatgtggggataatgttacttactgtccttcccctcaaggttgttgcagagatgaatgacataggtgtaaatagggctgaactcattcaatctctgaacagagaaggattcttacaacatggactctaacttcgccatttttcagctaagaaaactggggcacaggaatggtaaaggtcatgcgtgtctaagacacttggccagtgagttatacatctattataagactagaaactaagtattttgattccgtactatgttgttgtgttttatttttgtgttttattattgtgtcgctgtaaggtttctttgtcttttcacttactaggcacaacagaactcatatgcacgtgcaagaagtaaaagctatgataaaattatctggaaggggaagcgggttgtttacacaaagtaacatgatagcagatgagcaaagaggaaggtacaaggaagaatatttactagagagtttacagcatgccaaacatagagtaaaaagtgaaaaccttttagccagatttgtatacctgattaaatatctactaagggtattatttttaatgtatagagttatcaaaaacacattccttgctttctgtttctaacacttctagttctagggctcagtggctcttaacaatgagcaccaaaaccctgcttcatgctgtgttgctgcctgtgctagctgagggcagaaggtgcagtgagaaaatgtaagggacttttgggggttggtcggaaagagatgaggaatagttactgggcatgaagataattggaaaagaagaaaatattgactaaacatgtcaaatactcattcaataatgaaaagtaagaaagaccaacaatatgtgagtggttgagagaggagaggcagaaaagggaaccaggagagtggaagtgcttgaagctttttagatgagagtaagagctgacttaaccctgtgtatgtttgatcattactaatcctccttataccctagttccttcctttatttccttaatttccacatctatataaatagaatataaatacaaatgtaaatgtattatctataaatagagataaacgtaagtattacattatcacctgtggttttctcaaagctcacaactattctatggcagttcttgatggcattaagtgaggatgttaacctgttgttttacatgcatatggatggaacacaaaattaaggtggcaatgtaaagcctttagaaatattcacccttcaactgtttaagcaacccactttgcatttatctattagtcttttgtttagctgccataaaagccctattaaaatgtttttgtggtcttaatttttaagttgttgcaaattgaattgttaaaggtaaaatattttatggtgtaagcctatagtgagagcaataagtgaacatgtaatatgttttaattgcattctgttaccgtatttatttcacttcacagatatttattaaatggttactatatgccaataatgagctagatcatgttgtaaaggatcataatcagcctactaagaaagatttgattctaataaggtcatacagatgttcagtgaatttacttggagaacatattgctgagatagggatttaattgccaactgaaaaaatcccttcagtaaagttctgagaaaattgctatgtctgctatttattacagcaccttatatactactatatccctcatcaagatatagtacaaaaaatatactaaatacttagtttggaaactgaaatatgatcagaggccctgggaatattttagttcttatcctagacaaggagaccaaaaagtgtatactcattgagaaaatgtcaatatgctcgctaaacctaaatatagattaggaagacagaaagttttctagatatgaaatgaagaaagatacaacatgatccaaatagagctacccttcagattttaatgaaaggtttagagagaaaaaaatagtgttcttcaagcttaatgtgaaaacaaatattaccttcaagtggtgtcttcaagtacatacctagttttgcagtagcatccattattgaagtgattacataaaacatgttctgtgtcttttatctttatatggacagtttttggaaaactgttatggcctaaaatctgaacatgttttaaaaatgttattgtgtttgtttctggataatcttatttcatctaattcatttttatgttcagcttttaatcaataatttcaggttaaatgcaattaaatgtctgaaaatcaaacaagctgtcaaattaaatgctctactatctaataattgatgggtttttcttgttggctaatgcttcttctgtattgatcttaattttggtccaggcactcaaaagaggggaacactttatatacctctttttttttatttcaattgtttctgccttttgtcaagttagacataattttgtagcctgtcatacaatttttacttatgctttacttgcatcacaatgtaaatagtatgattcaaaatattgcatattccagcatgggcaactggcaaaaccctgtctctaccaaaaatacaacaaaaaattagctggacatagtggtgcatggctgtggtcccagctattcaggaggctgaggtgggaggctcacttgagcccaggaggcagaggttgcagtgaaccaagatcacaccactgcactccagcctgggtgacagagtgagaccctgtttcaaaaaacagccaaccggccgggtgcggtggctcacacctgtaatcccagcactttgggaggctgaggcgggtgtatcacaagctcaggagttcaagacaagcctggccaagatggtgaaaccctgtctctactaaaaatacaaaaattgccaggcatggtggcaggtgcctgtaatcccagctactcgggaggctgaggcagagaattgcttgaacccgggaggcagaggttgcagtgagccgagattgcgccactgcactccagcctgggcgacacagtgagattccatcaaaaaaacaaaacaaaacaaaacaaacaacaacaaaaaaaaagccaaccaaagaaaatattgcataataaaaaacactacaaaattatgttaatagcactactctactctgctgttattatatggccgtcttacaaataactcttcaaaagttattgattttcaaaatattcccttcaattattttactttggtcttagtgctctttgtcaattttaccatcgtatcttactctttgtatcattaaagtaagataatacatctctgaaagccatagtcttctagaaaagacatctgaaaaactcaagcccaaaaggaaaaagaaaagaccaaagtgtagaacaatgttgggcttattatctaatttatttttggccctgatcatctgagccagcagttgcttcttttgaaaggtggctcaaagttactctgtgctgatagaatttattacaaggaaaggaataatttcctcgtcatggtgtcaacttataattgcagacttcaagttcatataagtcatctgctatgttcctaaagtcataagacaattcagaatgtacattgctgttttgggtcatcctaggcttccttctctagcttcttagatttcccaaagtgtcaagtttaatttgaggatttgctccaaactgcaggagcttattaaacaaaagtaaggaaatatcagaggtcccatatgcttaacttcagcaatttccttattaataatgacatacaaaaaggctacataattcatattggatttacctgaatcgacaataatctcccttggttttctaatatccaccttaggatgattttgaaccattttacatagtaccattttgttacaaaatttccatgataaactatcagaactactactctttgaaagacttacttgaatgcgttaacataagattttttgaaagtcttatttgtaggctttatgagccagtataacgtgaaaggcaagttaaaacatgaaaaggaaatcctccaaaaactaacaatatgctccctctgagggtcctgcctagttctgtggcatgcaaagctatagctgatttataggagagcctcaaatgaacaaagggctgaaaagctaattttagaagaaaggtcccagcaactaaaatattttagctcagagtaaaaaggttacaaaatcaagttatagtagcatatatttattgaccacttgtcacatgccctataatgtaggtactattatacccattttacagatgagaaaactgaggtttagggaaattaagtaacttgcacatacaagtagtaagtgatggaggtggaagtggactaatagaaatatgactgtagagccctctttttaatgctacagttattacaaagtataaggatgatattcctacagatcaagtagttaactgaatcacatatctccttaataaattattcccaaaaaagatgagcttgaatctattcaagttttttagacttaacatcatttacttaattagaaattaagggtaataaaggaggaatatgttaaataataccacatggaagcaaacatgcaaatctagaccaggataactgacctatttctgtaacaagctcttggcatgcaaaaaaaaaaaaaaggcctttgctaggatcttgctagtgtggtccactttgagtccagcaacattggcactacctgggagatgttaaaatgcagtagctctagccctccccagaccctactgaatcttaagatccataagtgattcatttgcatattaaagtttgagaggcactggtcttaatgacaaagacttaatcagttataatatgtagaccttgtttaaatgatttaaagaaccagctgcaaaaagatatttttgccaagagaggagatttggtcattgacttgttcatcgattctaccaaagaatgactgttaatttcacgaggtgtgataatggtgcctcctggatatgaatgaatgtccaaatcttttaaaatttaggcatgcatagtgaagtgtatatgtctagaattttctttacagtgttttatcaaagaaaatagcaataagtgatgcaaatatgagaaaatcttgaaaattgttgcatatgtgtgattggccattctactcctctatttttgagtatattatagagcttttcataaatttgtttttattttaaagattaaaagaaatgggtttatgccttaggagaggtgcatttgtttttgtttttgtttttttgacatagtcttgttctgtggtccaggctggagtgcagtggcacaatcttggctcattgcaacctccgcctcctgggttcaaacgattcttgtgcctcagactcccaagtagctgggattacaggcatgcaccaccacacccagctaatttttgtatttttagtagagacagggttttgccatgttcccaaggctggtctcgaactcctgagctcaagcaatctgctgcctgcctcagcctccaaaagtattgggattacaggtgtgagccattgcacccggcctcgaattttagaaataactataagaaagaagtttcttatagtaagagtgattaatcacttaaagggatgccagaaaatctttctccaaaggattttttacaataggacaaattcattggtctggggcagttttagatatagtcttggtaaaagccagaagacttaaaaaactttcaagttctctttcacaagaaatgattccatggtagatgttatacttgtgaatactttgggccatttgcgtcagatttaatgccttagttatgattttcttaaaaagcagttgatgatggctctgttctagccctgtacttactctcatggcattcttcactggcagttcactttaatggttgaccaatggaatgctgagctacctacttgtccacatcaagcatttaatagagtcctgtactaatctcattcttataagtgcgaactaaggccttttgatgttatgtgatcaataggaaacactttaagctggtatgtgtttgtcatatagaaaagcattccttttaacatcatataaaccctttaatgtacttactcactgtaaagcacatcatttttttttttttatttctggacaaggagggcaaacaggaattccacaagctattaccagccaaacccttttgcaacttattaagtggcagtatttgtgctagtatgtcttatattttgtggctccttcctatagaaacccgagaatagttttcaaaaactaaaataaactcagccatcatccccagagatagacactatgctgtatgcagatgaaccactaatgcctgactggtttagtagatgccatgtatttatagagtgagtcagtgggacagcaaaaatttgcttccagaaaccttcctatttaaaatacaaatagtttctcctatatggttctatgttttggtctatttgtttgggcttcatgggataatacaaaggatctaagtttttctttaaacgaatacctattaggaggaataaatgagtagaataggatagtgaagggaattttggtttcaactgtgaagcagagtcactgacactcagacagtgctacttacattcctgtcatttaggtatgcccatggtgacaggctccctatttataggaagccgcattcttagatgtgtatgattttcaattttgtagatatttgtttgcttttcctcttctttattcttctagtcacctagtctctctctgttccatccacaagagcagctcctgcataaaattttctccattgctcattagccctcagtgagtacaaacaaaatctggtagtcaaatcgtaatcattcctttggcatactgcaaacatgccccacacacccctctactcctcagcttgtttgttttgctatggtacaatattatcatccttggctagagaattgtaattaaaataatttgttgtttctcctaaccttgttgctactgttaaagattgttcatgattataaaatataataacatttcaagatacctaaaattcttctactactgtaggagcatgatgctattttaaaattatgttatgtcaaaagaaagaactttaatgtgtgtgtgtatatatatatatccaaaatggattctacagtgaaataaaacaatgagtaccatttaaggatcattttccccagaaaacataagattaagacaaaaagatgaacacgtgttaaatattttatttcattctgtaatgaaggaaccagtaagatgttacagatagttcaaaggggaactcaaaaaccagacatatttataaatcaagacgactgaaatgaaagtatagacggtacattcttccaaccttggggaggaaagtcaattcaaagtctattgggttgaatttgcatagacaagaatgtcattgtttatagacaaaaaccgttttgtcttgctaccagcttttacaatttatagagttgtaaattagctcctatcaaatcagaatcagatagccctaagagtatactctagacactacatagtttcgactttttttttttttttttttagacggagtcttgctgtgtcacccaggctggagtgctgtggcgcgatctcggctcactgcaagctctgcctcccgggttcacgccattctcctgcctcagcctcctgagtagctgggactacaggcacccaccaccatgcccggctacttttttgtatttttttttagtagagacggggtttcaccgagttagccaggatggtcttgatctcctgacctcgtgatccacccgcctcggcctcccaaagtgctgggattacaggcgtgagccaccgtgcctggcccgatttttattttaaccagcagttttgtattcctaagggcaggatatccatagttagtccctcctgccaagaaaaagaagtccagcctccttaggctgacgttcacaatttagcttcagcttctttctaacattttcttttatgaatcccaccatccctatatcctattttattcagtcaaagttaactacatattcccaaattctaattaatctttcaagtcattgataaatcgtcaccttcaccaagaagccatgtcgtattttatctattctaaccgggaattactaccctccttttgatacttacgcattttttagtacttttcttctatattgactatctgctgttctcaaacttgaaggcatcagaatcacctagagtacttgttaaaacacagattgctgagcctcatctatcctctgtatcactggatttgaggtggggcctgtgaatttgcatttcttacaagttctaagataacattgatcctgcttctctgaggacaacactttaagaaccacccacccagggatgtcaaaaagcaaatacccggctgggcgcgatgactcacacctgtaattccagcactttgataggccgaggtgggcagatcacctgagttcaggactagcctggccaacatggtgaaatcccatctctactaaaactacaaaaattagctgggcgtggtggcacgtgtctgtagtcccagctactcaggaggctgaggcaggagaaatgcttgaacctgggaggttgaggttgcaagtgagcagatatcgtgccactgcactccaacctgggcgcaagagtgagactccatttcaaaaaaaaaaaaaaaacctataaaacaacacaacaaaaatcaaaaaaaaattcagtttaaaaatctaattggcttttttctttcagcagctcatgaatgggacagcatcccatctatgaaatagaaaggtgcttgaatgagttggctttataggaagaaaagggctaaagaagtggaaacaaaaagtagagtggtcattttgaagttactttccttatagagttaaaccagaggggactttcctatcataccacttcaggttgactggaccccttctgactggttgctatgaatcttccttttttttgtttttgcttttaaactggttcattttaaatttcagtctgattgtgcggcacctagcacatgtcactctattctgatttgttctggtcttatggggcctactgcaggtgcttccataaatggccttaaacaattgccattaaacaatggccaaccttccataaaacaatggccttctgtaaattttattttatacagagaaaccatgtaaaaaactgcagacaagaagatgaatgagacatatacccagctcttcatgagttcacaatctaacgggagtgttgaaagctggctccccaaaatatcactgatattacctttttggtaagacaaaacaagttcattgaggtatggagaataccacttcaacagagcctttgtagtgcctaaaaagaaggaaaagggtgggacatagttggaatatttgagattttcaagtctaatttaaggcagatctctcaatagggcaacttggctaagattgggtaaggatcatgatatgatagtttaggattgataaaataagatgtggcaagggattcaaagagtcctagtgtataaactattgattaatgctttctattgaagaattgatgtatcattccagatgctcctagaataaactaggagacagtagagtgagtgtaaggtcatgttaatgtagacaagtatattaatggtttccattctcagagacagacacataaacaaaaaattagtatggtaaggtaagtataatcaaggtagtcacagtgccctttgtgagcaagtatatcaaatcttgtaacctccctgccatctgccactgccaggaattccaagatggtgaatgtcttactttggtttatctctggtatatcaaggaaaaggcactgatttttagcaaggcaaagtttgtccttgtttctttctctttctttgtttatactgttaacagcctcagaactgatgtgtatactttcacatattttatcttacaaacaatatcaaatttgtggggaatgaaaatagttcatatttattaaagacctactatatcatacaaccaatgcaaatatatatatatgtttgcatatatacaaatatatacatttgtatatacgtatttgtgtatatatactaatacatatatttgcatatttgtatatagatgtatatatacacaaatatatgcatatgtatatatacatatatattaatgaactatattttatattttcatgttaattatgattttccccttataatgcagataatcatcattgagaccttaaggataagcaggcatctgtatggcgctctttttattttatctaagacatatggtctcttcttttgaggagaaagtagtgagaatggcagaggaatcctctctttaataataatagaataagtacatgtatatttaaagtgtgaataacatgtaatctttactttgggaagtaacttcgatagcataaaaataacatttatttctttgcaaatcaatttttagaaataccctaaactgattatatttaaattacatctgagaaagacaaatttaaaattttgaaattcaaattttgccagtgattcaatgttcaaattcttgcaataatagttacaactttgtttttaacaaatacaccctatgtttgttcacaatacttgaaagaatacatagcatgctttttactagttccaaaatcaaactagaacatatgcatactataaagtaaatttacttcatttatttatgacaagcttatatgcatgttgcagaaattcactgaggtaaaactcacttctatactttttaactaaaattttaagaaagcatctacatagacagtagtataactctacaagttatcaaatacatccaatcatgctaatgacatttacaacatataaatttgctagctaaagaaacatcattctgttagccataaacttttttgcacacagctgtcttcttctttttgccatatgagcttacaatcacatctttcattcccagatttttctgtgccaattgaagctaagtcaaactggtataaagaaggctttagagagtaggatgtcttgaatgggacctcatagcttttgaagctagtgagtgaaaacgtggggctgaaagagcaagcccagaaagatatgtcaggaagtggcaacagcctgccctgcatcttctctgtaaatgagatggagaagcatcaggatcaatagaagcatgttatctccacgcacagcatactaaagtacgagtgttaaagaatattgaatattgtgtctagatacaggatgaaataaggctttttacaaacagactataaaagttgccagaggtgtaaggtggttatgggagcgctgaatctttctcaacatccagtagaatagggtttcttaattgagtattagtagcatacccaaaaaatcaaactctggcaaacaaagtcatgagtaatcttaataagaaagcaaaatggggcgataccagtgtgatttggcaagctgttttctgagcttagttcttagaagaaacaaaagaggaacatattaccagggacaaaaaacaaacaaaaaagactggcataaaactgtgaaagagtatcaggccaaaacatagagtgaggttatataagcaccaaaaaaactagtgaaaaggaaagtcctacaataaaggagaacaagatggatgggtgaggcttgtgttgtttaacaatttattaaaagaaagagtaagtttaatgcctatttaattttttttttaagagatggggtcttgccatattgccctggctaggcttgaactcctgggctcaagagatcctcccagctcagtgtcccaagttgctgtgactacaggtgtgcacaaccacacttggccacagttttgctttatttttctcaattaagaagaatgagctacaaggaagtacaaaacaaatactgtaaaattgaaatttttaggctaaggcacacagggatacagtgaaagaacacctacatctactttacatgaattgaaacctcttggtccagaaaaccagaatattttcctatgtggtcacaaaacctttggtagtaaccttacaggaatcatagtgtatttttgacagttatactccctcctgtaacaaacttcaaaatatataaaatggcttaaatacaagagaagtttattcttgtttgagtctacatttggagttcctgggtggtggtggctctccactaagggtgggttcaaggacctaggtaccttctatctcaaggctctgtcatatttaataaatggcttctcaagtcaccatgttcatctgctacaagtatgtgaaaagaaaagagcatggagatcaccaatagggactctctggccaggcctggaagtagcacacaccatttttgcagtccttccattggctaaaaaataatcacttgagcactgctgcccaaaaaggaatctgggaaatgtaggctcactatgtgcccagaaaaaagaagaatcaggtttggttacagctagccattctgtagctggataatgagacatctgccagaaaactgtagttaggcgaatagcccgaatttttaaaatgctattgaaatggagttgaagggtatagaaacatcatagacttgaaaccatttcagaggggaaagcagtgatcacttggagtctgtaccttatcttctgcgtattagaaagatgtttaactaatatgtggcattgttgataaatgagttctgggtgatggtagcatttagtggattcatacttctttagattaatgtgttcaatgagtggtagtcattgtcatccttgaaggtgtcagttgacctgtgtcttgtgactttcctttctcatgtctcattaaatatttttatgaacaaccttaacagaggcaaatttatggttgactcagtaattagggataccgaatgtcactgtgggtgaaagaatcaaaatgatcccaacagtttagaatacagtccaacagaatttttctgaaaagggccagggagcaaatattttaggctttttgggccataaagtctctgtcacactagtcagctctgctgatatagtcccaaagcagccgcagacaatacataaatgaatgggcatggctgtgttcaaaggaaaccaaatttataaaaacagatggccggccagatttggttcatgggccatagtttgctgttccctggtctagaagaataggctgaaattctgaagggaatcaatagaattttttttttttttaatttacagccaaagaacaatgggcctaatacatacatcatgtcctttctaataatagaagagctccaagttaggcactatttgctcttattttacagatcagaaagctacatctcaatacataaataagtcaatagtttgacctagctttcacagccagaaaacccgctgtgggacatcatgccactttaaccaaatgtttgggtgaactgagagagtaacagttaattgcttgagtaaaagatggagggaaatgtcatgtggcagcatttcccatgggcaaaccctgcgttctggctctgttcttttccaagtgtgtgaccttgagaggtacacttgacctctctcggccttgatgacccaatccataaaaatgaaaggcttgactagataaacaccaaggccccgctcatgtcttatggttaaggttgcgattagtatgttaagggcattgtgtgaaagacaattgagatgtattctttgtagctcttaaagtaattattttcaaccattttctagtgtacttttatgggagaacagtatgtaaaacataaaaatggcattttatgagcctacatgtgttttacaagttcaaatttacattttgattataaagatatttattgagagaataaggctgataggaaaccaaatttttaaactgggaggataaatgatcgacagattctttttagcttcagcaactccgcattctccccattttgcttttgttgtttgttggttttcctctggttgtattaagaaaatacttattcacatacacaaaaggtaaatgaatagtttcgcaatctcagaatacttttcagaatatagacatggcaagagacaattgaaaagcaaaatcattaacaaatcaggtgatctttagcatattaatatatcattaaaaatgtaacttaatcatttgcaaaatctatcagtcaaaataagctaagcttattctgtgatgccaaatgaacccctaaacctaagtgacttgctgaaataggtgtatatttcttgatgtatttcttgttcctcttacatatccaattttgggttgtattgggagcaggggctctgatccatatagttacatagggatccagactgatggaggctccaccatcttgtagctgtaccgtcctgtgcacatcatatccttagctgctgaggcaggggctgaggcacctggagcgtaaaacactggcagttttaaacagcgcctgttctttgcacacgtatgtgaaacacatacatcactgctcggtggttgccagatctagtctcatggacctttttcggaagtcattgtgtgactcatatgaactaaatatgcaaaaaccatttggaagaactaaagtagcaggccgcaaacgtggcttataatttaaaaattgaggttcctgagttccccaccctacagccatggaaccagaatctctgcgtatagttggagaattttaattttttaaaaagttccacagctgattctcattatcaacaggcagctgctgctgtgaacaaggagtgtttttaaagcggagaaaaggcaatacttagattggcggatttaagattaccctggctgcagtgttggagatcgattaaagagggggtaaagtagaagctgggagatttcattttactacataatgtataggctctaatgagcaaacacaaatgcatgtgcttacatatcatgcagtgtgttagcagaactagctcaatctgagggcctaacaatgttgttgatgtctctgtatatttaagaatcttatccccaacccttccttccggactcctagaaaaccagtagggtaggtacaaattggctgccaaccagtccttgttcaatgcatttgataaattctactggtggtggtggctgtatagccagcttggcacccatatgagtctgtggatagtaggtggggctgaggtgcctaggcatgccctgcttctctcttgagaggcaattagaaatgatccaactttccttcaagcctgttagggcagcatagatttgagttttgaatctggttatattgctgtgtctactgttctctaggaagacttgagaatttagagtagatctgcaacagaagaaaatgaccagtgcatgattctgcttgaaaactaaacctgtctagtcagtgctggatcatttaaagattgaccatctaggtttgaatttctcttcctatatgctgactgcctttgggctgattcacctggggatattagcatctttcccagattgtgtttggtatggggaggtggggagttagggaactcccatctactttgggaagaggaataagttctattcctttcaaacattatgtacagcacttaggagtttgctgttcatgcatcatggctgaaacatttggacaattgataaaaatttgtcattgctgcccagcactttctctgagatggatgaacttataggtaggctctctttttattgtacttcatttcatcttgtattgacacagccccagttatagactttcccccaacagaaggaacaacaacaacaaaaaactacctaactactggttacaggttaaagctggaaatgtgctggcaacagatttaggtttttccaatattattttgcctgttcatcttcttttttctctattatcttttttttttctttttttgagacagagtctcactctgttgcccaggctagagtgcagtggcgtgatctcggctcactgcaacctccgccccccaagttcaaacgattctcctgcctcagtttcccaagtagctgggattacaggtgcacaccaccaagcctgactaatttttgtaatttttagtagagattggttttcgctatgttggccaggctggtctcaaactcctgacctcagggtgatctgctcacctcagattcccaaagtgctggaattacaggcatgagccaccgcgcttggccctattatctttaataaaaacaaagatagggaaattatccaaaaaattagctaaaagctatataactttaaaatatgtgaaattaataatttcaataaagtacttaatataccacaaaacaaatgttttcacttatcagcttttcagattaagtatcaaaattctattcaagtaacatgagaaggtacagcaatatgtgaagacccattatagaattaagagaggagaagaggaagaacaagggtaaagaagggcccagaaagataaaaagacagagggtaagacctccttatagctatgcatacagtaccttctgtagacacacactctctactgcaacctcaaagaaagtgcaggcaggaaaagaaatctgcagaagaaagaaaatgagaatgtttgtcttcatgatgtaacattattctttgggtgtcctgatgagctattgttcctcaaggtttttaaagctttattgagttttcagaactttaagcaccattggtaataccaattggcacttgtccaatgagctgagtgaaactgatccaaaagctccagaagctgccacattccaggtatggagtatttgggggctgtaattataccattgtaattactgtctttaataggattaaaaatagaactggaataattctatggtaagttgatgtcacttattgtgacccaagtttcaattataattgttaacgatgctattgctgagtccttgtttggcttgactgccatgcagtgtttttctgatgagtgaaggagttaacaccttttggacaattttcagaattgaaagaaaattacttggtttttagtagggtttgtaattattatatccaaggttggtatcttctagaggggaactttttagaaaattaatattagactctctcccagtctattgaaaggccgtattaaatctctatcatatactcttcaatgctgtgatcatgattatattcaaacgataacccacattcttcctctttgtggtcatttgggacacaggtggcagtctcacatatgataaggaatttgaatgttagcataaaccattttagtggcaaaaaacacacaaatgctttatataaaaaaagagtcaattttaagggtatcaaatttgtctatgaagttaagctttaggtttactggcagatgcagatgtagtgactgtataatagattcatgccttagtttctaaacttacaaaatctgtttgcttagtttagtgtcagattgtcagtctgctttattgattccatcagtggtttggcttatcatatcagaaatttgagtgctgacttctggcctcaagcgatcctctggcctcagcctcccaacgtgcttagattacgggtgtgggctatgatgcccaaccctaacatttctatcttatgaaatagttgacaggtagatataatttgttactggagaagattattttttcattttgttcttttaagatccaattgttattttctgagtttattaacatagctagccttataatgagaacacagctctcacttttaccattttgcttaaagatttgcagatgtgtcgtgctcatatacttcaatgtctctgtgttttctcaggatgttacagttctgcttcttttatttcctaaaattcaataattttatctgtgttaaaaagtattttaaaatgtaatgaacacaatgttgtggctactcataatagttttagtgaatcaggaagtatgccaggggatggttgttagtagaaaaaccatttcatgtcatcttcagtaaaagataaagaagtgagcttgaattcagagagcttggtatataggatgactgacagagataggagctggggcaggaataaaaagattgagaagattgaacattaaacagaacttcagtcattagccaatgtaaacaagcaatcaaagaatagtccccttaaaataggaatcatttaattcatctaacaattaagaaaatataaacattacaaaccaatgtttttgttaatctggttctaattatttttaggttactgatgatattcttttagtataaaaatataaaatcagagccatttgcctagttttcatgtcatttttcttcatattttcagaaatcattgtcttacttgaaagttttctacttaagattccacaattaaaagaacaatgtttcctttaaggaatagtgctgcgggggcaggggcagaatttcttaaagcattttggggagtggtttaactaaataacctacatatagtagtgcacaagtttccaacttattaatagttgctttccagtgagtttttagctcctacattttttttggaagtaaatgtgatgtaattaaattaaatattctagcaactaacaacaaaaggctttttcaacagataataataaattgaactcggaaactgtaaaaagaatgaaggagaactaatagaaattgatatggaaaggtgtctaagacaaagtgaagtaaaaatatttgtataaaactatggacattggccaggcatcttggctcatgcctgtaatcacagcattttgggaagcagaggcatgcagatcgtttgagcccaggagttgaagaacaggctgggcaacatggcaaaaccctgtctctacaaaaactacaataattagttgggtgtgatagcatgtgcctatggtcccagctacttaggaggctgaggcaggaggatggattgatcccaggaggtcgaggatgcagtgagccctgatcacaccactgcatgccagcctggacaacagagtaagaccctatctcaaacaagaaaacaacaacaacaacaacaaaattgtggacacaatatgttcccatttgtgtgggttttttttttaaagaaacacacatgcatatatacacatactaatccctatgtaaatatatgcatacaaaatttacagaaggatatacacaaagctgtggaggttgattcaggaaggatgtaacaaatttactattatatagccttctgtactatagttttgttttcccatatgcatgtacccagttatatattgtccttttaatttaaacatctagtaaaaaataataatttcaatgagaccagaaattactaagcaaaggaaatggcaaggtagttctacttttttggaaaaaaaaaaaaaagaaaagatggtcattgtatttgaaacttaagacaagataataacacgtattatctggttaatgaatgcctgtcctgtcttcacaaggatttttcctgacataaaattctaaatatctgtcaaaaatatatatatatatatacttgagatggagtctcgctctgtcgcccaggctggagtgcagtggcgcggtctcggctcactgcaacctctgcctcccaggttcacgccattctcctgcctcagcctcccaaatagctgggactacaggcacccaccgccacgcccagctaattttttgtatttttagtagagacagggtttcactgtgttagccagaatggtctcgacctcctgacttcatgatccgcccaccttggcctcccaaagtgctgggattacaggtgtgagtcaccgcacctggccaaaaatattttttaattatatacactaaataacaacataatgaataatgtcttcaatatcagttcctcacacaattatttcttgcgttgaacttcaataaaattcagaatataacactaatggtataacttgataaggtattttataggaagcattatagctcacatttaccaaggcttaatgttttacaggcactcttgtaggcatattgcttgcatgatgttattaaatcttcccgacatctctatatgatctctattttacaggtaaggaacctgagggagagagaggctaagtcagttactttcccattacgctgctagtaagtggcaaagccaggatctgaagttagactaagggcccatgttctcaatgatgagacatgccttaggtatactgactgcagatgacctaacttgatatgcctgtaactcttagacaacttaagaaagatcacatttttcttactgatgattgagaaatgcagtctatctcaaatgcctttcataggagctgaatgacagtcagattggcagtggacagtctagcaagctcctacaagatagaatgggcttatgggaaacaggtcctttttaacttaaaaaatcattttcgaataggtgatacatgcatattatacacacagtgaaaattaaggctctctctcatcacaccctaagccacccacttcttttctcagaaagcaaccaccattactaggttcttatatatactaacagaaatgttttatttgtatgtggataactacacatacttcacattgttttcaaaaattgaagcatacgacatgtggtgttctatatcttcctttcccccttaaaaatacttttctcaagattctttcataatcagttataccaggaactgtgtagttatttttaatggctgaataatattccattatatagacatgtcatattgtatttaatcatttccttattagtcaccacttaggttattttcaacattttgctattgcaaatagaaaattgcatcatttcatacatcagtaggataaatatcaagaagtgaggacactgagtcaaaaggagtgtgctttaaaaatgttgatagatcctgcaaaatgaccctctttgatgatcctgcaaaacggtagtaccattattcgctcccctactagtaatatatgaaagtggtagtttccacccactgttagcaaaatggcttgaaactttttgatcttcaccatcctgatagaagaaaatggtatttattggcagatatttgcattcctcttattagtaatgaagcaaatttgttgtttatgcctttggtgtaatctctgagtccactgccaattccaagatcatgaagattcaccttatgttttcttctaggaatttaatagttttaagtcatacacttatgtctttaatctattctgagttcatttctgtccacggtgtgaggtaagggtttaatctcattcttttgtatgtgaatatggagttgttactgcaccatttattgaagccactatttttccccattaaatggcctgggcatcattgttgaaaatcagtctgttttccctaaatgtatgtgtttacttctgaaccctgaattatatttcatcaatctgtacatctattcttacgccagtactacggtttttgattactgtagctttgaagaaagttttgaaattgggaagtatgagtcccccaactctgtttttctttttaaatattgtgttggttctttggggttccttgcaattctatatgaatttgaggatgggattttccatatctgtaaataaaacaggggaattttgatagggagtgtattgcatctgtatattgatttctgaattgccattttaacaatattaagttttctagtccatgtatatgggatgtctttccatttatttagattttctttaacttctttcaattatgttttgtatttttcagtaaatgtcttgctcctccttggatagatttatttctaagtatttttgtctttttgatgctactataaatggaattattttcttaatttcatttttggattagagatgcctttttgtaatgtgtctatttgcaggggtatctctttctaatcgcacaaaaacatcttgtgctggcactggtgatctttgggagtgtaacatcagcttgaaagtgccatagaaatagggactctctatcttagtgctgagtaggcatttactaaagctgaatgaatggatgacaatttgctgagagtgagcttgggtaggagcttaagagaggcagcaaatatggattttcaagaaattcagtgatgaatggaaggccttaaaaatgaaggaaatggaatattatccaggatagactataaactaggccataaaaaaactcaatgattttgaaaggatgggggaattgtaccaagtatgttctctaactacagtaaaattaagttagaagtcaaaaacacaaagaaatttgggaaattcacaaacatgtggaaattaaacaacatactcctaaatagccaatgagtcaaataataagtcataaggaaaattactttgagataaataaaaactaaagtacaatataccaaaatttgtgggacagaactaatgaggtatgtagctgtaaaaacctatattattaaaaaaaaagaagatttcaaatcaatagcctaaccttctgccttatgaaactagggaggttggggggcggcggggggaaatagaagatactaaacacaaaacaaatagaaggaaattataaagattagcatggatattaatggaataggaaatagaaaaacattagagaaacctcattaatgaaacctcaagttggctctctgcaaggagcaacaaaattgacaaagatttagatcgagcaagaaaaaaacagagatgactcaaattactaaaattaggagtaaaagagctgatattaatataaatcagagaaatgaacaggattataaaggaatactatgaacaacaaattagatgacttacattaaatgaacaaattcctagaaagacaaaactaccaaaactgactgacacaaggagaaatagaaaaaaaaaaaaatatatatatatatatggtaaatgattatagtaatttaaaatattaccagaaagaaaagcctagagccagatggcttcaatggtgaattctaccaaacatttaaagaatgattagtaacaatccttcagaaactcttccaaaaaagtgaaaaggatggcatacttctcaattcattgtcaaaggccagtattacccaaataccaaagccagacgaggatatcacaagggaagaaaagtataaaccaatgtaatatctattatgaatatagacaaaaaataatcaacagaataccaacaaaccaaatcaagcatcatattatacattctgaaggttatctaaggaaggcaaggttcatttaatatacaaatattaattaatgcaaacactatattaacaggataaaggacaaaaagcacaatattatatcaacagaagcagaaaaagcatttgacaaaatctaacgtcatttatgacaaaaaaattagaaattaggaatagaatggtgcttcctaaactagagtaagggcatctacaaaaaaacgatgtataatatcatatttaattgtgaaagactcaatgcattttctccaaattcaggaataaaacgatatctgctctcacaacttctatttaatattgtactgaaagttctaaccagggcaattaggcaagaaaaaaaggcacctgaattggaagggaaaaaacaaaaccacctttatttacagaaaacatgtacttatatagagaaaatgttaagaaatccatttaacaatgaatagaatttattaatgagtccagcaaggttgtaagatacaagaacagtattcaaaaatcaattttatttctgtatactagcaatggcaatctaaaaaaaatctattcacaatatcaacaaaaaataaaacacttattaatgtatgtcacaaaaaagtacaagatttatacaatgaaaagcacaaaacattgctgaaagcaactgaagatctacctaaatggaaagacatccttttgtttatagaagatatagcaatacttcccatattgatctactgatttaatgcaatccctatcaaaattacaactgacttttttctttgaagaaattgacaaggtaatcctaaaattcatatggaatgaaaaggattcaaaatagccaaaacaatcttcaaaatgaagaacaaaatgggaagactcacactttccaatttcaaaacttactacaaagctacagtaatcgagatagcatggtattggcatgggtttaggaatagaattgagagtccagaaataaaaccttgtatttaaggtcaattaatttttgataaagatgcaaagacaatgggggaaaaatcatcttttcaataaatggtgctggaacaactggatagccacacataaaagaatgaatttggaccacttcctcacatcaaacctgaaaattaacccaacatagatcaaagacctatataagatcaaagatctatattagacctatattagatcaaagtcctatgttagatcaaagacctaatataagagctaaataaaataaaactcatagaaaaaacataatagttaatcttcgaactttggattagtcagtgatttcttagatacaatgcaaagcacggatgtgataaaaatattgataaatttggacttcatcaaaattaaacctttttgtacattgaaagccaccattttgacccagcagtttcacttctatgtatatatgtgaaatgaaaacaggtcaacaaaaaaacttaattacctagatgttcctacattattcacaatagctgcaaggtatgaacaatccaaatatccatcaatggatgaacggatcaataaaatgtggtatatcttatacaaagtaatgttatttggtggtaagaaggaatgaagtaccaatacatgttacaacatgaagaagcctcagaaacattaagtgaaagaagccagaccccaaagaccaagcattatatgaaatgtctataaaaggcaaatccaccgaggcagaaatagactagtggttgcctagggctgcaagtgtgactggggagtgactacagatggtaaaaagtttctttttgtggtgatggaaatgctcaggttcaaagattacattttgatgatggctttataaccctgaattgttatcaggtgaactatataattttaacacgtgaattttacagtacttaaattacatatgaataaagttttttttttttaatgaggcaaaaggtagcgtgaaaaagcaggcatggcatataagcaagctttttttaaggctgagtgacttatgtggctgatagaggaaggataagaggaaaggaaatatagtgaaaaggaacagagaggaataataaagctggcaagtcacagacaacataattagactatcaaaagaaaatctggaagaaaggcatggacaggaataaagacctccttctaaagcaaggtagggagagcaacttgatgtagattgaagagaaaaaggaaagaaaaatgaatgttcatatttgatggcctatgattttctgggtcatgtagaaggcaaagtaacatgttcaagtgatgaatttggtaactttaggataatgatgacagttcagacaacaaatacagagaataaaagagaacactgactatatgaatagaaggattttagagacattacgactcagccgagtttaaatcaaagattgtaaggcattcagtcatcaaggttatacatttttctccagcagctctagccttctatgaaatagaagcagaaaaaaaacccaaaacagatgggttaactacctgtaaatctggatttgaactggtagaatgaagcttcctgcaaatgttggatgtaaaagtgcagatctaatcaggtaaaatctcaagcattaattggatatgcttataacaaaccggtaaatttttagaagatgtaaaacatatcttagaaaaataatttaaattattaatgagaattagactaagtcattgaaatttgatttttaaaacttaccgagcctctctttcattgaactcagaagtagtgtgaatggtaagtcttccttgtcaaatggaatgctacttagcagctgtcttagctcgttccagatgctataataaagcaccatagactgactgactggtttataaacacacatttatttctcacagttctggaggctagaagtccaagatcagggtgccagcatagttggtttctggtgaggaccttcttctggtttgcaaactgatgtatttttgtatcctcctgtggcagaaagatggagacagctctctgggtcccttttttataagggcactaatcgcattcatgcggcctctatgctatgaattacctcccaaaggccccatctcctaataccatcacattggggttaggattttaacaaatgaatttaagggaaagcacaaacattccgtccactgcaacatctacaaaataggtccttaggaagtgcagaagtctggaacagttctttcccaagccacaaccctgaaaacatggattgctgggtatgcagattctcctgggtccctttcccataaacaccgaattagacactctgaggatgcagcccagacattctgtatttttcaccaggcataatggtgatggctgatattagaatggtgaaatttatcccacctagtaagaatctaaactgaaaatggtgatgatgcaaaaaagatctgtcaaccagttaaaaaaaaaaaaaaaaaaagagggtgtgtgtttgtcaggagggatagtctttagtagtatggccaaaagcttaagcctgattttcagggctctattgttggagtgggtagttcatcaacttcctaagtaattcaaatctttttccccccaatatattaatatattggtgattccaagaaagagggtttaatttatttaatgcctgggaaaactaaaagaactacaaacagatgtgaaaggaagagaataaccacatctcacaggaagcaaaatttctgtcaaaagttactgttctttccctgtctaggttctttgtccctgaaaggtagatccgcaaactaaatccctcaataacgttgcctaaacaggactgggatcatagaatgtccaacactaacatgagttcataatggcacaacgaacttaaaatgttactattcatgttttaattatgattgcagtcttacgttgaaggtatctccgccgtccttaaacataaaaaaaaaaaaaggaaatacaagctgcaaaagttttatgtaatgcactccaccctcttttttccccaagccaacacacacccttcaaactttttgacagttattttcagacccctcctaggctcccgaactccatgcaactccagcagtctcccctgggccatttttagcctctgctctgacctggcgggaggctgggtgtccaccctttcccctgcagtcctgaaagtccggtccgagcgcggacggggcggggaggggctgggcgggccaggccagctccattggcgccaggcgggtgggggaatgcgctgagaggacccgtccagcttgcttaaaagccatcagttttctgaccccgcatcggttccaggaagaatacacctatgtgacaagctaagttctgcctcattttgcatttagaagccacaagaaaaacttttcgaaaacttttgtccgtcttttgctcccccgacgcgtggtttcctgatggtccgtccccgggcagagagagggacgccccctcctcctccccgcctcttgtgaggcgcgcggagccgcctcccctgggtcaggtctgatgggccggtgggcgcgctagtggtggccgccaccgccgaaaccgtcgacctcctgggccccagttccgcgtccagccccgcggcagcatggactacctgacgacgttcaccgagaagagtgggcgccttctgcggggcacggccaaccgcctgttggggttcgggggcggcggcgaagcccggcaggtgcgcttcgaagattacctgagggagccagcccagggggacctcgggtgcgggtccccgccccaccggcccccggcgccgtccagcccggagggacctggtgagcccacctttctttcgcctcccgcgcggccgacctgggctgagggctgtggggaggcggcggtcgtggcgccgggcgggggtcgctgcccggctctggcaggtgtgcctgggccggggcgggcaacgtggccggggtggcggccgccgggggcgaggaaggaaggactcgttcggctctggggagggaagactttcagctgcgtgccagctcttcctgctctgctcttcctgctttcctcacctagacttgattttctttccccgccaagtatttcaaggggacgatccattctctctttccctcccactgggaggtgaagactgaaccagttatgacgtccgtgttttcagtcttggattcttgaagagcgctgtgcctgctttggttttggtttgggtcagtctttccttaatatttctcagttgttaggattcacttcctaaccgaaaaataaaaagccagatacttctttgtaaaataaaacacttcattaacattggaagctagttgacattttgcgtcgtgtactttttgaacggctgcacgttgtcttgtggtggcagaacctagaaactttctcagttcctgtttattttgtgttgtgttggccgatttttttcaccacagtggctttgtaccattctttaaaacagtcatttgtagcgacatgatattgataacttaaagaatttttgaaagtgctgctgaacagttttagcataatgcatagggtaacttccagtgtccttggcttcgtttaacaggtagcagacatcctagccatgtctgatttttatttttgttaattgctttaatatttgagggttatgaaaataaatgagcattagagagtttagaaaatagagataggcacaaagtgtgtaaaatctgtttataactccacatcgtgccagtcattttattttaaattttatcttactttatttttgtagagatggagtctcgctgtgttgcccaggctggtcttaactcttggcctcaagtgatcctcctgcctaggccttcccaagtgctgggattacaggcctgaaccaccatgctgggccctgccagttgttttaaagcagtaaaacagtgaggacatttttgatctatgtgtgtaggtatgtaatttaagctttgaagaaatattaaagtctcattttagcatagccctttaaaataaattttccttactttacataaaatattttttatctttagaaatgctgtttatggaattaggaaatgaaaaggggaggggaatacttttgtttctgctctgaaggacgttaaccaaatgcagaatcctcttaaaggtgggaccaggcataggaaagggactttaaagtgttcaaatcaaggactttttaaaatgagttttcagtagcctaattgaaaacagttgatgtgtgaccagccttgaaatgggtggagaattcagaaatatgtggggtaacttaactaaaaaggaatatggttagtattttaataaatatggccaaacacgtgtatctgattcattcggtggcccgtgtctgtagttccagctactctgctcaggaggctggggcgggaagatcctttgagcccaggaggagaatccagactgggcagcagagagacacttatgtgtttatatatgtggagcacacagctatatctgacaccctccttcaaagtggcgcttctgaagtgatatgtattcctcttctgttgaagctgccttatgtattcattgcatattctttaatagtcatggtgcccccaaatctctgacacattagagaggcgttgtgaggtcaaagtatgaccacagtcatgtgggcaggtacgtcctagcattaacttcctgaaagaatttggacaagttacttagtgtctttgggcctatattttcttctttgtaaatgaggttggatttggtgatttcaaaattctctattctagagcattttcatttggagcagaattagtgaaaactagctgacttttgagaggcaacgtgtatatacacaagtgaaaaataaatgattcttcatatgtttccagctagcctttgtttaaaatgagaattctgtgctttgcagctgcttctcagatggattttggctctagggttgttctttgtgtttgtgtcctttagaatgagtgtctgtcagtctgtttgaaggatttcttctgctctttctactcttatttcagtttcttaatagctgcttaagtttcctgctatcattctttcttcagttctttaagaagccctgtgtattataggagtatttcttgttacagatactttcacacatgtaaattgactgcattccaggaaaccctttgttgttagtgatcttattcctcctttcatccactaagatgaaaaagtagaaccttgtttctgttccttctcacaacccaacatcggaggagttacgcatcaagaaggggtggagggagtcatgttcagcaatgatgttgataagatagtttcaccattgacagattaaggatagaccagataaaattttggtcaaatgtcagccagttgcggtggctcacgtcggtaatcccagcactttgggaggccgagacgggcggatcacctgaggtcaggagttcgagaccagcctagccaacacggtgaaaccctgtctctactaaaaatacaaaaattagctgggcgtggtggtgcgtgcctgtaatcccagctacccgggaggctgaggcaggagaatcgcttaaacccaggaggcaaggttgcagtgagatcgccctactgcactccagcctgggccacagaacgagactccatctcaaaaataaaacaaaaacaaaaattagccaggcatggtggcacactcctggaatcccagctactcaggagactgaggcaggagaattgcttgaacctgggaggtggaagttgccatgagccaagatcacaccactgcactccagcctgggtgacagagtaagattccatctcaaacaaacaaaccaaaaccaaaaaaaactttggtcaatgtttctgagtttaccctttctataaagaaaccacttactgaactgttaatgtctctccttcctttactcctctccaaggtggctgcttttgctcttaccagcttttagtgcttgctggctccatcattatagccctctcaggaaaaccataattgagacttagacatattaaggacattatcacaccattgatctagttaataacaattacaaaggaaacatcttaaaatacaatgcttgttcctgattaacgggtacattatgctttgattttaaaaaattgttttgaactttaaatatagctcttgtttgggggcataactataactcataatgtataatctttaaaagtactcacttcactagattatattgtaataaatatagataaattttactagtgtagactctcaacttactgtcgtataaacatgaaatcgtttttatcataagcgtcctattatatcaacctcattttcccacttggtgacaggattctttgagcacaactcagcccttttacattttcttttcatttatttttagcaattaaaactatctttcagttatttaagacttggtccatttatttaaaaatttcagtctcatattcaatttatatctccatttacctttctacctcagttcccattccaagttaggttggtagcggagaagaggtgtggtctagctctcacaaactcccctccaccccttcttgatgcattaactcctctgatgttgggatgtgggaaggaatagaagcaggggtccactttttcattttagtcctttttggccccttagtgggaggatgacaatggtggatagcagtagtagcagcagtgatggaacagttctgctaaaatggctactcctatgcagaagtgctgacttcagtagccaacagttctttcaactttgaatctgggacattaacatctggtaataccaaccatagaccttagttgcaaattgttgtactaggcacctaaaactgctctgcctcatagcatatatgttactggtatgtgtgtgtatatcaatagagttgatgaaaaatgaagttaagtgggaatgtattacatttttatgacttgaattatttgacatgtcaaggaaaaactatttaataataatatttttttaaatgattatccctgttgctgaagtttcattttaggtttacattaagcaaatcctatgtactgaatgtatgtaactgaaggagaagcgtttagaagcctgagattgatattcttgttactggttcacttttgataatcatggaaaatgtaaaccaagacatggaataataattataatagacaaaacatatagtgcttgctgtgtcttacgcacaagttaaccctcagcaacaaccctatgaggtaattaatagtagcattttcattttactggtgagggtactgaggttcattaatgatcctgtctagttgggaaaatagacattggacaaagaatttataactgtgttggttattgggcatggaatgtaaaatatattatgggagtatataagaagggtttctaacctaatattggggggtgtaaaatatcatgttttgcttggattgggggtaatgtctatttcagtaaatgggatgatgatgatgatgatgatgatgatgatgatgatgatacttgtagtaataacagaagtagtaatacaggttgagcatcccaaatcagaaagtccaaaatctgaaactttttgagggcctacatgatgctcaaaggaaatgctctttggagcattttggatgtttggatttgggatgctcaatcagtaatgcacatattccaaatccatcctatcctttaggaagattcaaaaaaatccaaaacactcctgttcccaagcatttcagataagtggtactcagcctatagcaagaatgatagctgtaatggggcaggctctgagcaaaagttttttatttaatcctaataaaaacctgatgacatagtactattattatcctattttccttttgaaaaatctgagccaaagaaagaagtgagaaattcagaatttatttgggtgttttcttagtatttgcaagagttacagtccttgagataggggaaaaatgtgagaagaattaaaattctatcatgtaaggtattaaagttaaattagttaagattgtaaaggatagaatggattgtcattgaaggttctttagagttagaaagatagtaaaatgacagagctggaaatgcaaaatccaatgagggtgtgagaaaaattaggtatatattaggttggaaattgccacctcagatgatgtgttaagagttagatgatggtttatcttgaacccaggaggaccaagtgcctctaaggcaggggtccccagccctggtccatggcctgttaggaaccaggatgcacagcgggaggtaagcagcaagcgagccagcattactgcctgagctctgcctcctgttagatcagtggggacattagattctcataggagtgtgaactttattgtgaactgcacatgcaaggtctaatccctgatgatctgaggtggaacagtttcattgagaagccatctctctccccatcccccaccccttgcccacatgtccataatccatagtcttccatgaagcctgtctctggtgccgtaaaggttggggaccactgctttaagagacctggagtgtaccagttgttacagtaactttttaaaacaaccaccaccaccacaaaacaaaaaactcacagtgttggtagaagataaccctagctggccccagttttagtctcttttcctaaagccggatgggaggaagagaatactctctacttgatcggcaacctcagtgggctctagtggtaactcccaactagttagcctttcttaatagtgtatcatttagttcagtggttctcaggcatgaggttgatttgcctgttttagaattgctgcttgtctcacaggatagctgataggaagttctgtattatctatgttgtagaacaaaactgcctctaaaataagctgatgattctcaaacttcagcatgcaacagaatcatctcctgaagggcttgttagaaaaatattgttgaatacctctcctagaatttgtgattctgtgtggctgagaatttgcatttctaacaagttcttaagtaatgctgatgctgctggtctggcaaccacacttttcttagtgggtaagtcttttatccatgggaaggttagaagtaaatatagaaatgatgaaatttattaaatgcttatattaatagttttgttttaagtctaggaataatcagtgtatttggtctttaaggtatttgttctgtttcatagaattaggcctataaaagtggccaacaaattagtcttaagagtataatttaaaatgcatacttgcgtaattgttttttgacttgggattttaagttgaaaggtgcaacaatttggctaaacttagaaaccactggaatgtttaagaacttaacatttattatatttaaaacttagtatagggtttttaatatttttctcaggaggtttacttgttagaagcaatgtgtttaaaatagaatatagtaaatttataaatgcagtttagtatagtaagtcctcctttgacatcatcaataggtttgtggaagttgcaccttttaagcaaaatgatgtgtaaagaaaccaattttaccataagctaattgatgtaaacaagagttaggttcctaccatatatttctggtcacaaaaacattagcaaacttgtaagtaaagacctaaaatacttccattattaaacattgaaataaatgtgaactatgcaaacattaaagaaagattaataaagacaagagaattatttactcagttattccagtcagagtcactgttggctggatcctgtcctgctcatggcacaaggtgggaaccagccctagacgggacaccattccacctcagggcacagtcacacacacacacacgcacacaaacacacacattcatactaggacagtttaaacacactaattaagctaatgtgcacatctttggatgtgggagggaactggagtacctggagaaaacctatacagatgtgggtagaatgtgtaaactccacacagacagtggccttgtctgggaattgattttttgttcttatcaaagttataacaaaacaatgataacaaaacgatgttattcaaggacctgtaatatatgtaagagaacttagttacccatgtttataacaggattatttagggatatttaattttccagtttgagttggtcagctatttaaagcaccttagaaagtgttaaaatttgctagattataaatagaatgcactttttatggtagaagacaagggaaagtaggtttttatatttttaacttcaagaaatctaacattaaaagtaaagtgactgcagatagtgtttttctgtgtgtgaaggcttatttcatggccactaggaaacttacattaggagactctttataaatgttgttcaataggtgatactagtacaaaaaggaatgtgttttagggtcaaatacatacattagagaaaggacaaaaattggcttttattttctagcagtaaatggaaagaaggaaatgtaatcagccataaatcacagtgtccctaggataaagataaacctgttgcttaggcagccaggagaaacacagttattccttatagtgagaatataacaaaaaaaaaactcatggaactctgtaataaagcaaaacaaaccaaaaagcttatttttatggtaagtacagacttcagtttcaaaaatctatttttaatttttttaaacccattaaatctttaatgtagttcaatggtgtagctctaaactgcaagttagtaaaagcacttctgtacaaggggaaaacaattaatccaaatatgcagttatctaacagtccatcttaactgagaggtaggttttacattttaaactatagattttagatagttacgactctctgttttggatttttttgagagtactactcaatagaattttttgaggtgatgaaaatggtctgtatctgtgatggccagtatggtagccactaggcaaatatggctattgagtatctgaattgcagctaatgcaaatgaggaactggattgagaaaattggattcaggattctgtatttgctctatctaatatggtagcaactagtgttaaaggaaaaattatttgataatacttcctaaagcacaataagacagactttattcaggaccattgcaatagggatagggactgtggcaatgagattttgtagttgaggagagagattgggctcaactccaaatacaaaatgggcaagtgggaatttctagccaaggagtagagtaaggatagatggatggacaattgctaagaggtaacgtcaggaataaggggtattatggtgaaactgacctaccaggattcttgctgaaggcaggccagagtaatcagacttcacctggacagtggaggatgagaaaactgatcagatacggaaggtaatcagatatccaggatcggggtgggggttcctgctacactgaccttaacatgattcttgctgaaactcggttttataaggaagtgaacagattggcataggagaaggttcagcagcctgactaaaatttggctatgcaaataatctttgtgactaggcacatgtagctattttaatgtaaattaatttaattaagtaaaactttaaattcagttttcagtctcactagagacatttcaagtactcacaagacagatggctagtggctaccatattatacaaggcagatataaaacatttttaccattgcagaaagttttattgggcagcattgatagcaatgagtcccaatgcagggtacacattagaattccctgggtagccatgaaaaaattttgatgccaagatctgattataatcaaagatttgatcttgaaatctctgtttaagatctccacttacagtttcttacggaattctaatatgtaactagggttaaaaaccactgacttaggatgtgaaggactctacatcattctgttttccttaatgatatttctctcaatcaaactcttgctgaatttagcaggttattatttatttatttttctttacaagtacttggggcatgcacctattttatgatgcaagttaataaaagaaatgcatgtttaagttttctgccaacctctggatagtattgagaccttaggaaagttgaggtgacttacaatgaaaagttcctaaaaggaagacatgtttgtatgctgagagaaagatgctgaagataaaatgactgtgtggcaaggtccttgtggaataaataaactactggaattatgatcattcttttttcacatgccacaattaagagccattaatattgtggaatatttgcttccagtcttttatacgaaattaatttttaaaataaacctgatatatactatatataaataagtcatatgttgcaaatactgaactttaaaaatcacctctaatccagtcacccagagatactgttaatatttgggtaggcattactgccaagtaatgtacatcacttctatgtgtatgtacatatagaaggatggatgggtggttagaaggagggagtgacagaatgaaagataatacttattcaccacaagaggttaattcctaaggggtgtgtctaaatttaagcaaattctaaaaaaaaaaaaaagaaaaaaaattacagatactgttattacaatcttgtttcagttttaggtgggatatatttaaccatgctttggtatgacattagcagtttcatttctcatttttctcctcctcacatcctaatatttactcattttactatttttacattgtccatgtttgtaacattcatacttagtttttcaaccacttttttataacttattattgttctatattctctagtaaccttttagaatgtcctccttgattctggagtttttgatacaattggcataatttcagtcttatagcactgagtaatgtttcagtagagaagtctcatgcaagccagccagattcttttccatttcccctagtagatgatttgctttttatgcatgaattgttgaataattttttaagctcccaagcataataatttaactaagagtagaaatgggaatagcctgactcatgtgcccacatgtgtctatgtggaataatcttttaggaattacacctttcttctggaatacatgttgatggagcagccactatatggaagatctctggttttgagatagaaaagagagctaagaagtacaattttggctccaaacacttccacctggaagacatatatggttcattgggcaaagcaagttggccatgtctgacatcaataggatggtgaggtatattttatattcctcaacaggaaggaatacaggcttagtaacaataatatagtctatcaccatgactaatttagaaaccattatattagtttgacagatttgaaaactgctggtgttaactgtcacaaatatgaagttatgtagggaagcccatttcttctgtcacttacgcagtctgcaggtctttgatctcttcagaagctctatttgtatgtctctcaaatgtgttgtgcgtgcaaatcaatagtaaatctgtaggtccggactgagcctcagatcttacattcacagtaagcttctgggtgatgtcaatgcagctggtccctggaacacacttttaaatagcaaggctctatagctctttaatatcatggatcttttcacttagaagagagccaactttaaggtctagatggaggaaaaggggcagtaaaaaggaacattaatgggtatgagaccaagaggagtgtgaaatactttcaaataaagggaaagaggaacatgcagaagaagtctcttggatgtttcacagagatcagataaaaaaaaagtggaaaagcccatcaaatttgccatttaatttattcattttagggtggggattgtgaactggggaagagaagatattacaatacattgtggattctgtaggagataatggagtaaagacagtaaaagtagatttctactttcaaaaattcaactgaaaagaagcagaaagatggagtagtatctagaaaaagatagatactagatttgagggaaaattgaggggttttgttttgtttttgttttgatcgtggataaggagtcaatagtgaaatgttgaaaatacaggtttttttccctagtatctcattattgagagaattattagaaaagctacaatcagcaatctgttttttttttagtttagaagatacttttaaagtgtttgaagttttagtatctatattactgtttttgaaaatactgacttgcagctcaatgttttaaatagtcaaactttttatacatagctattatcaatattgtaatattcagttattataggagtcttttattacattaaacctgatctcatagtacgttcattgatgatttccagactttctacagcatacctttccatttctttaccaaaatgatttttttaaaggttttatactgctctgttaattctctgcttgaaagtccttcaggagttctgagtctagtaatagcaagctaggtaattcagactatcctgctgagaacaatttaaaaagctggacacaaagcaaacattttattaagggtatcagaaagctaagtggtatgggtaggataggatctgaatgaggacaaaggtctaaggagggagaactccaatttgattgctttttaccccaggggtagtgttgattcctgaaacaggaactgagagaccaaaaggtgcatttgacaggctgtgggtataatggaaccgggccagagtgcaaggcctgtcacaggggatgggtggccctagtgatctcttctcactttggaccccaaaatgttgtacattagggagaaagataaactgaagtagctaggcctccctaggaagatacttcaacttcaaattatcaaaatttctgtaacttaattaataagatctggtattactagtgtcctcaggcacttgacagaagcaaacattaattctttctggagaattaccagtttctacatgtaaaaatgttttgtcagacgattttgcaaattttatgttctgcacacaaaataggcacatgacaagatatgtgacacaatagagaatagaaacaggcccacggtaactctagatattctagttatcagatttaaaatagctatgttgagaattttgacctgattaagaattttgtagaaagttacaaactatgagaaagaaaaatggatattctagaagtgaaaaatacaacccctctaattaggacctttgtagatggatttagcagcaaattagacaccgcagaggaaagaattccctaactgaaaggtaagtcaaaagggaatgttcagagtaaacaggaaagaggaaaatataggagaaggtaagttcaatacaagatacagtgagaagttctaatatgtatgtacatatacatatgaatcctgaaagtagatgagagatagaatgggcaaaagcattatttaaagagagaatggctggccaacatggggaaaccctgtctctactaaaaatataaaaatcaggcgtggtggtgcgtgcctgtagtcccagctatttgggaggctgaggcacaagaattgcttgaacctggcaggcagaggttatagtgagccaaaattgcacctctgcactccagcctgggtgacagagtgagactctgtctcaaaaaaaaaaaaaaaaaaagaatggctgaaaacgtccaaactaaagaaaaactttaattcagattcaagcatccctatcaacctctagtggaaaccacaccaaaggcaaaaaaaaaaaaaaggaaaaaatagtgtttctaccttcaatcatacagcattaagatggacattgatttctcaacagacacagtaaaaactaaaaaactgggaacctatagatttaaaatgttaaaagaaagtacctgccacctagaattctgtgacctgtgaaatttcccagagatacaataataatcataaatatgagagcaaaactaaatcaaccttgactatcttaaaaataatgttttttaaatacgcatgtattcagcgtgtaaaactgtttcatatatcttggcagtggcagacagtttttaacatccttgcattgtctgggaagaggataaaagtaccagttaatattaggctgtgagcatatgtttattgcagcactattcacaatagcaaagacttggaaccaacccgaatgtccatcagtgatagactggattaagaaaatgtggcacatatacaccgtggaatattatgcagccataaaaaatgatgagttcatgtcctttgcagggacatggatgaagctggaaaccatcattctcagcaaactatcacaaggacagaaaaccaaacactgcatgttctcactcataggtgggaattgaagaacgagaacacttggacacaggaaggggaacatcacacaccagggcctgtcgtggggtggggggaggggggagggatagcattaggagatatacctaattgtaaatgacgagttaatgagtgcagcacaccaacatggcacatggatacatatgtaacaaacctgcatgttgtgcacatgtaccctagaacttaaagtataataataataataataataataataataataataataataaaaggctgtgaggagtcagtaattcagactttttatctctgggatgaccactaaaagaattgtttaaaaaaatgtgtaactttcagatatgtggggaaaaaccggagttaataaatactgaatccaaggaaggcaacaaaggagagaagtctaaaagaacaggtagacagatagaaaatagaacaaatagtgctgggcacagtggctcatgcctgtaattccaacactttgggaggccaaagtgagtggatcgcttgaggtcaggagtttgagaccagcctgaccaatatagtgaaactctgtctctactaaaaatgaaaaaaaaaaaaaaattagctggggttggtggcgtgtgcctgtagtcccagctactcaggaggcgaaggcaggagaattgcttcaacctgggaggttggggttgcagtgagccaagatcgtgccactgtactccagcctgggcaacaaagtgagactccatcaaagaaagaaagaaagagagagaaagaaagaaagagagagagagagagaaaagaaaaagaaaagaaagagagaaaggaaggaagggaaagaaagaagaaataaacaaaaaggacctgcttagatacacaccagaaacataacgtcatatggttaggctttgtgtccccactcaaatctcatcttggattataatcccgataatccccacatatcaagggagaaaccaggtggagggaattggatcatgggggcagtttcccccatgctgttcttcttgtgatagtgaggtctcatgagttctgatggttttataagtgtttgataattcctcctgcctttattctccctcctgccaccttgtaaagaaggtgccttgcttccccctttgctttctgctatgattgtaaatttcctgaggcctctccacccatgcagaactgtgagttagttaaacctctttcctttctaaattacccagtcttgggcaattctttatagcagtgtgagaacagactaatacagtaaattggaactacaaagtggggtactgctataaagatacccaaaaatgtggaagcgactttggaactgggtaacaggcagaggttggaacagtttggagggctcagaagaagacaggaagatgtgggaaagtttggaacttcctagaaacttgtcgaatggctttgaccaaaatgctgatagtgataatggtaaatgaagtccaggctgaggtggtctcagatggagatgaggaatttgttgggaactggaataaagttggctcttgctatgctttacaaagagactggtagcattttgcccctgccctagagatatatagaacgtgagagagatgaaatagggtatctagcagaagaaatttctaagcagcaaagtgttcaagaggtgacctgggtgaccgtaaaatcagtcagttttatggattcacaaagagatggtttggatttgaagcttatgtttaaatgggaagcagagctaaaaagtttggacaacttgcagcctgacaatgcaatagaaaagaaaaacctgtttctgaggagaaattcaagccagctgcagatacttacttaagtaacgaggagacaaatgttaatcaccaagacaatgggtaaaatgtttccagggcatgtcagagaccttcgtggttgcccttcccatcacaggcctggagacttaggaagaaaaaaatggtttcatgggccagacccagggccttgctgttctgtgcagtttcaggacacagtgccctgaatcccagctgtggctaaaaagggccaacatacagcccaggccatttatttagaggatacaagtcctaagccttggcggtttacgtgcggtggtgtgcctgtgggtgcccagaactcatgaattgaggtttgggaacctctgtctagatttcagaggatgtatgcaaacacctggatgtccagacagaagtttgctgtaggggtggagccctcttggagaacctttgctagggcagtgcagaagtgaaatgtggggtcagagcccccacctagagtctctactggggccctgcccagtggagctgtgagaagaggcctaccttcctccagacctcagaatggtaaatccactgacagcttgcactgtgcacctggaaaagttgtaggcactcaatgccagctagcgaaagcagctgggagaggggctgtaccctgccaagccacaggggtggaactgctcaaggccatgggagctcacctcttgcatcagtgtgacctggatgtgagacatggagtcaaaggagattattttgaaactttaagatttaatgactgccctgccagattttggacttgcgtgggacctgtagtccctttggtttgcctaatttctaccatttggaacagagacatttacccaatgtctgtacccacattgtgtcttggaagtaactaacttgcttttgattttacaggcttataggcagaaggaacttgccttgtctcgggtaagactttggacttggattttagggttaatgctggagtgaattaagactttgggagactgttgggaaggcatgattggctttgaaatgtgaaagggacatgaaatttgggaggggccaggggcagaatgatatggtttggctttgtgtccccacccaaatctcatcttgaaatattatccccatactctccctgagttaagggagaaaccaggtggaggtaattggatcatgggggtggtttccctaatgctgttcttgtgatagtgagttctcatgagatgtgatggttttataagtgtttggtagttcctcctgagttcattcttcctcatgctgccttgtgaaaaaggtgcctggttcccctttgccttccgctatgacttaagctgaggcctccccagccatgtggaactgtcagtcaattaaacctctttcctttctaaattatccagtcttgagcagttctttatagcagtgtgagaacagactaatacataaggatacagaaatgttgagagtagaaagaaaaagcagaaactaatgaaaagagaattggtacattaatattagacaaagaatactttatggaaacagtattctgagaaaaagtttaattttccaggaagatataattttcgatttgtatgagcctaataacatggtcccaatgtataaaaagcaaagtagggagacctactgggaaccaaataacccataatttagagtgagagatattaacaacctccattggtaacagaataatcagacaaaaacaaatcaatacaaatatacagaatttgactaacacagtccacaaacttgacctcatggatatgtaaatacatgtgtgtgcatgtatgcatacacatatataaaacactaaaccctgcagtgcagagtatacattattttcaagcatatatggggcatttacaaaatttatacatcttataagtttccctcttaacactatcttagctgtgtcccagagattctggtatgttatatctttgttcttattagttgcaaagaacttcttgatttctgccttaatttcattatttacccaaaagtcattcaggagcagattattcagtttccatgtaattgtatagttttgagtgaatttcttagtctaatttttctaatttgattttgctgtggtccaagagactgtttgctatgattttagtccttttgcatttgttgaggagtgttttacttctgaatacgtgatcagttttagagtatgtgccatgtgacaatgtatattctgttgtttttgggtggagagttctgtagagattaggtccatttgctccagtgctgagttctggtcttaaatatctttgttaattttctgtctcagtgatctgtctaatattgtcagtggggtgttaaagtctctgagtattatcgtttgggagtataagtctctttgtaggtctctaagaacttgctttatgaatctgagtgctcctgtgttgtgtgcatatatatatctaggatagttagatcttacgaattgaaccctttagcattatgtaatgcccttctttgtcttttttgatctttgttggtttaaagtcttagtttaaaactagatttaaatcctagttttgtcagaaactagaattgcaacctctgcttttttctgttttccatttgattggcggatttttctgcgtacctttattttgagcctatgtctgtcattgcatgtgagatggatctcttgaaggcagcatatcaatgttcttggtgtcttatccagcttgccactccgtcttttcattgggacatttagcccacttacatttaaggttagtattgttatgtgtggattttatcctgtcatgatgttagctggttattttgcaggcttgtgtatgtgatggttttataatgtccctggtctgtgtacttcattgtgtttttgtagtgtctggtaatggtctttcctttccatattttagggttcttttaaggcagttctgatgctaaccagtactcttggcatttgctcttatggaaaggatcttatttctccttcccttatatagcttagtttggccagatgtgaaattctgggttggaattttttttaagaatgatgaatattggccctcaatctcttctggcttgtagggtttcagctgagaggtctgctgttagtctgatggacttccctttgtaggtgacctggcctttttctctagctgctctcaaatgttgtgattatttgattgtactttcatattgatggaagaaaacaaatagtttattttatgtgctttggtatttagatctgtgaataaacattttaatattaattattaaaatttagaactgtttttataatatgtaattattgcataatattttataatttttaattagtaaagagaatattttccatttgtttttcaaactttaaagtgtagaaagttagtacattagttttcttgccctgaactgcattctgtggtgagcttttgaaaattacagagcaattgcaaacttgcaaacatgtttaatgaattattgggatattatgaaacacagatcgaaaagctattaggcaaagtaaatacaaactaacggttactcctaaaatcaattaaggaagggtatattattagttaaaggtaatctgtaattgtatattgcattgcttgagaagtttaaattgcaagtttaatttgctattcaaagaaatcatttaaaaattatttaaaacataaattattcaaaaataaatcgaattttattttaatacattttcagttgtttaaaataaaaataaattctttaaaacttattttatcttaaaatagttttaatgtttgcattttctcattagagaagcaaatttaaatataaactattcagtgtagaagaattagaatactttgataagcaaaaataatattctttataaaaattctaccatattgcattgccaccaggaatgcagaagaatatctcatttcctactgtcaaacagtatgtgaccaaacttcttttgagtttttaccaacccgataggtgtgaaatgatatttcagtatagtttaaatttgcatttatctaattatgagtgagattgaacaacattattacatgtttaaggacatttttacatcctcttgtgaattgtctgattatatcttttgtgcatattttcacctgcattattttttccctagtttttaagagttctttaaatatttaggatacaaaagtagaatatgtgtatgtatgcgcacgcgtgtgtgtgtgtgtgtatctctgcatactatttttcctagagttgtaatggatgaaccataattctttctctacttttctttatggaaaattaatggcagttcataatagttttggtagttcaaagtatagttcaagttgttgcttcagaacattactttattagatgcttgccatgtgtcaggcccctagttaggcactgaggaggctttgtggaagaaaggcaatgttttggaggttacaatttagtggaagggatttaaacccaaatattaacttaacactgtgtcagatgctgtgaaggagacataaagatgctatgtgactaataacagggacttgggttagctgggtgatcaggaaggttttaggatagttttttaaagcattgcagaggtaattgtcctttttggggattttgatattattattattttttagtgcttgtttagaaccattcacccgacagctgagatgattaggtcaacataaactcttgtatggtcaaaatgccatttaagtttagatagagggagaacaatgaaatagatattttctagattatatggtcttaggttgaaccataaattttctttgaaaactatagtttttaattttggtaaattttgagggtaaagtaaatgtagcattttgccatgtttactatcttatttaattttgtgatttatttagttttttagatttcattttaataatttttatgtttaggtaggagtggtgttttattaattcagtgttgttattacatgaagtatagatgaaaaggttaacactaatacaaaatttaaagggaagcagtttcgctaatcttgatgataatgaaacattcaaggaagtcttgataagcaaatgaaaaatattaataattggcattcaatctgaaagtaaatgttcaaatgtatgtttctatatgaaagcacaccttgatttacttcatggcatgttaatatgaaagttcataatttaatcccatagagaagactatttttcattatgacttgtagaaaaattttttcctgtgagaactaatgttacaatttcttatttggaaaataatgatatatatcttgaaagatgtattttaaaaatatataatgtatcttaaaatgtgttggtattataatcaggttaaatctgttgaaataaattgtaatttagtttttaatgacttcctttctgttgacaattatgttttgcgttgacttgcaattattctattggttcatactagttaagttcctaaagcaagcaagtaggaagttcagttccttttttttgacagttgcttgatttttacagcagagcatcccagggagtaagctgtattactagtaaattagacatctgcccaaagagctctattcagtagtccttgacattactctgaaagaaagatgaatttaataggaattttgcctttttttcccagacactggccaaaagaagaccctagacaagaaagatggaagacgaatgtcttttcagaaacctaaagggactattgagtatactgtaagttatttgctttcgaaaaagctatttttctttgtaagagtcttctttaagacattctctgtttatactataaataagacaagcattgttaattgccttatttttaaaaatctgtatttcactttggataattgttttattttttagttgttgtttttttctttaaagagaaattttactgagatataaaggtagttatcctagaaaatttaatttaatatagatgatagtttactgagagagttcccatgggccaataatttttattaggttaggcttttaggaaaatttttagttctttagaaatgtgatcttcattatattcgcagcagtgctagtgatagttataatggcagatgggatacataaaagaaaagttgatattaatcttccagtataaccttccacattaaatcatttgtatttatttatagctaactccctttagctctaaacattgagcttttttttttttttctgtattcttgaaatgaacttcaaatcttcctgcagtcagctggcttttcacatttctggttactctgggaaactgaagtgagaaatcagctttggtatatggtatgctgcatatttgattgaatgtaaagattgtttatttggataatgttaacgtgttgtaaagcacttttaactgagcttaattttgttattctgtgtttttctaacataactgtattaaggagaacagcaattttaaacattaatttagcatttgtatcattatgaaaccgtccagtcttggtttgactcttattttccatgcatctttaaaattgaacaaattatcaaaattctaatttatactctattttgatataccattcatatatagcggacagtgtgagattttaaatatttttaaaaggaatcagataatttaggatgaaataaaatttactaatatcaagataatctcacagcatattttaaactcaaattgcgtgtgtttgtaccttctctgcataattgagaaaataagttcaaataagttttttataggtaacctttaaaatttcttcgtctttacaattctgcagtgccaatatgaaaaatttagatatatacatgtttttatcatgtttattgtgtttcttcagcctaagaaatcatgtcactcataaattctagaaaaattcttggtaattatctttgattgccattttctcctccttcctctattttgtttctccagaactctaattttttattgaaactaattgtactacattttgctatcattatgctttgttgaccttgctattattttgattgtatcttctgtctgctttgctgggtgtttgcctcttcttaattcccaatgtgagtggtcccttgtttctttttgcttttctattgacattctattacttggagtgcttaagaactttataaactacgtggagtgagacccaaactttttttctatccctccctttctagttgcttgcatttcctactatcacttcatactaaacaaattatggaagcctcttaccaattcttcttcctccatccttccacaattcctgattttctcatttccgttccctttcagtttgttattcattcaggttgcagtctttagagtcagcatcagtttgctcattcacatttgcttccctgacctactgctactgctgtcaccacaactccattcaatccatgaatgtcttctcttgagtcttagttgaaatcttgtaccttaatttctttctttacatttttattactttaaaccttatctttgtttttctgcatcctttctctttcttgttccagtaatcctagccctgatgccagtaatatgagatgccacttgggctgttttgttaccttcatcatctcatttaatagaatcactgtgagaataaaatgtgttattattaattatgaaagtacttggtaaacttacagattttactgcaaaatatcatttgtttacagagaccttttatatatattatctcggtaacataggttttatatcagtacattgtgtagatggggaagtttgcatagaaggatgtaggcagaactagattattattgtattaacccaaatatttggcataaatttggttttataaaaccattaaggaaaatatgtatattattgttttacatacacaaacaaatgcacacgcacctgcttttcctgacttttgaaatcttctataacctaattctaaatgcctctttttttattttattttattttgttttctggagacagggtcttgctttgtcgcccaggctggggtgcagtggtgctatcacagctcactgcagcctcaacttcccaggctcaagtgatcctcccacctcagcttcctgagtagctgggactacaggcatgcatcaccacgcccagctaatttttgtattttttgtcaagatgggattttgccatgttgtccaagctggtcttggactcctgggctcaagtgatccacctgcctcagccttccaaaatgctggaattacaggcatgacccaccatgtctgacctctgaatgcctctttatcgtttttagagacttaactccatgtaatcaccttcccaaaaatttgtgcttcatgagtctactctggatggtttaggaggaagaggacagtatcccacaaatatgttatgcttttctgtctcttaactatgtcagttctgttatcttcactttgaaagttcattcctttctctctacttttcaaattcccaacccttcttcaaggcccagctttaaatcatttcttttctgtagtcttttctggaaaatttggattacatggtgcttttattcatactcaaaacttctattgcattcattattccattttaaattgttcatcttttgcataaccttttctatcttagtttccaactagattgtaaattccttgtgcaaaatgacttttagttgcacttatttgtgttttcttcagagctctctctttttttttttttttttttttgagacagagtctcgccctgtcgcccagactggagtgcagtggcgcaatctcggctcactgcaagctcggcctcctgggttcacgccattctcctgcctcagcctcccgagtagctgggactacaggcgccgccaccacactctgctcatttttttttttttttaatagagacggggtttcaccgtgttagccaggatgttctcgatctcctgacctcgtgatccacctgcctcggcctctcaaagtgctgggattacaggtgtgagccaccgtgcccggccttctttagagcgctcttaatgccttgtgtaatggggactttaagtggttatattatattggccaagtgacattttcttttagggtaattgatgaaatctcattatttatgatttctacacatatgatcatggaaacgtacgaatgattcagaactaaataactcaactttagttcaaatatttttctaatttatatgtgcaatgacagaatatatgcataaagatcattttgagtttaatacaggtgtactttgcaaaaatgaaattagtatgttgctagaagtcacatatattttagaaactattcaaaggaatagtgtattattttaaaacctttgtaaaatgaaaataatcagtttttgacttttaaattatgttttgtattttgaaattacttgaagtagagacctacatgtaaatgtattgtgatgaagcctttactctgtattgtaatagattaagagcatttgctaacaaaacacagtgtttcttgacagttattttcaaagatgacaataccagttgttaatcaaatgtaagctggtccctagatatattaatgctcattaaatattatagtttagtttttctgttttaaacattgaaataatttattttttcttttaaacaggttgaatcaagggattctttgaatagcatagccctgaagtttgatacaacacctaacgaacttgttcaattaaataagttattctcccgagcagttgttactggacaggtagtatcttttttttaatgtgctgatgtttagaaacattaaacagaaaggcagaaagtatttattgtactgtagttaataatatagaaaatttgagaataattttatatgtgcttttaacaaatcatattggccatgtaagagaaaattaactgttttatgtctgtattagtttcttttttaatacatattgaaaataattgtagatttttctttttaaatatagttacaaagagctttttaaaatattcagaacaatatatgcatatgataaaaaattactttatcaaagtaaggcatccctccatctcaaactttcagtttcttttccagaagcaaccagttggcagtttgcatttctttcaggaataatctagcctacttttgttgttgttgttgtgttttaatttaactttgattcttggaaagtgttgtatttaatcacagttctagttcagactttttcacgcgtgcatggtattacattgtattgatatatcatacttatttaaagcattagactatttctactcttttgctaaggtcaatagtgctgtagtaaacatgcctgtacacatctgtttttctttaaatgtaagtatttctgtagggtgaattcttagaagtaaagttactatatcagaggatatgtgcactttaaattttgctagctattgccaaattgtcctttaggagtgacacctctatagtgtatgacaattaatgtttcctcaccctattccagccgtatatattatcaaatgtgtctaaactgattttaaaggttcttttttaaaaatgtttttatattcttataatttgaaaatttttatgtttttctgtttaattggtaattgttaatagtgcttgcttatagaacaccatctaattattaacacttcattttaactaaatctttgtgtgaatgttttcttacaggttctgtatgttcctgatcctgaatatgtctccagtgttgagagctctccatctctaagccccgtaagtcctctgtcaccaacatcatctgaggctgaatttgataagaccactgtaagtatctctgctttgcaaagatggcgatgaagaaatctcactttgtctacattgactgtcttgttttttacattccattttgactatggttagaatgaaatatttcctttttattttgttgcttaagtttgtaaatcccagctttaaaaataagacattcttatgaaaccatatagcttaaattgacttacctttgtaggtggtggttgtgggccaaaaatattcatcaactcttattttttaaagaacatatataatttaacttacaaaggaatcttacccaaaaaacatgacattatcacagtagaggaagttcatgtccaatttgatgtttatttcatctataaataaatgagtatatagtacttagaactcttgagtttaattttgacacattgccttttaaaaaataatttatcatcttagtcatccaagaattgacatagtagattaatttatctagcatttctaaggaatgagtgttctaataacttacattttacaaatgaacttcagggaactaaacttcatttaataattttgattaaaatcttctgaaaggaattatatattatatatttctttgcctttcatagaataaattacatgatattattaataactatttttctccttgcctgggaacttttttctgcatgtgtgtgtgtttgtgtgtgtgagaaagagagagagaaatgaggcctttttcatttatttgatggatatcttctttatataattatggcaatactatgctttagaatgcagtcacatgaaaggaatatattacatttgttgtcatcattgataagaataaaagtcaggttttaatggtaggtattacttaccaaatgacacaatacctttttgaacatagccatgccattttcccatgggacttacaaagagatgtactcataaggggcaatgacaaagtaactacgtagccttaggttaatttagcctgtgtttcaaaccctaaagcagaatgatgaaaatctaagctgtagcatcatgcctgactagaaacctgtggggtctcttcctgttcctcggctttaacctaaatctgcctgtctactggctttcttggaaggtataagatcaaagaaaacaaaatgttgaaagttaagggagcaacaaggccaggcctcaacctgtgtgaaaatgtaccccttcttacttttgccatttgactgaaagagatggagaggataaagttatgtgaatgatcttttaatcctcagtgacttagctactgtcaaagatggaccaaaaaacttcctgtaatttggccagtgatatgagtaaattctttgtccctgggatagattaaaaaaaaaaaaaagaggtgagagattccttaaagaactaaaagtacacctaccatttgatccagcaatctcactactaggtatctaccccgaggaaaagaagtcattatataaaaaagatacttgcacatgcgtatatagcagcataatttgcaattgcaaaaatagggaaccaccccaaatgcccatcaatcaacaagtggataaggaaaatgtggtatatatataccgtggaatactactcagtcataaaaaggaatgaaagaatggcatttgcagcaacctggatggaattggagactcttattctaagtgaagtaactcaggaatggaaaactaaacatcgcacgtactcacccataagtgggagctaagctatgaggatgcaaaggcataagaatgatatagtggactttggggactcaggcaaaagggtgggagcagggtgagaagtaaaggattacacattgggtacagtgtacactgcttaggtgatgggtgcaccaaaatctcagaaatcaccactaaagaacttactcctgtaaccagacacacctgctccctgaaaacatattgaaatggaaaataattaaaaaaaaaaaaaaaagaggtaagagaagagtttgtaaacttctctttacatggaatgatactctttacctgccatcaaagagattatgggcaatagttagaaataattcttacaacagttgattgtgtaaattttagttgtattttttttacctaggattatattcattaccaggctccaggataatatttctatgactttctgcatatctcaagtgcctatatttctatatttctaattattgggttttatgtctcccatgctgtataaatcccttagaaataaggatattatgttttattagatatagtttacattttcattacactaattaaaataatgtctattagtattgttattatatgtttttcccagaaattgtcagtttatattaccagcaaccactgataaattttttgaatgtccagcttagtagtggtttactatgaagctaaaaatatgttcctggctttgtcggcataaagactttcattggtaataattcgttttcacttaaaaatattgcattttgagaatttccatggaaaactattttttctttatttttcacttttttttgttcacatatggaggaagaaatatagaaggagatagaaccaaagtaatggtaaaaatcataaaaatagctaaaatgtagtattgcaacaggtataattctaagcactttaaaagtattatttatttcttatctcaaatttatgaggtaggcacttggcctgggtttctgtgtttgtccctccagacttactctgtattctctagtgtcctttgggtggtagactgcatcagtgcactctctcttgcccttttgcttctgttggtggttttctttctggagcagttgcagaagataagggggaaggaaagagagaataagatggggacatatttattctcctagctccttccctgtaaggttactccagagtgaccacattcttcagcatctcatcttatcttttgtcagccctttccacagagccatctctaaatttaggtatctgtttctcccccttacctctttagggatagaggagtcttctgttattgttcaccctgggtttttgtacaccatatgtacctttgtaaatagttccataattaaatcctcttaaaattattcagtttctaccgggcatagtggctcacgctggtaatcccagcactttgggaggccgaggcaggcagatcacttgaggtcaggagttcaagattagagcggccaacatggtgaaacccatctttactaaaaatacaaaaattagccgggtgtggtggcgggcacttgtaattccagccactcaggaggctgaggtgggagaatcacgtgaacccaggagtcgggggttgcagtgagccacgccactgcccttcagcctgggttacagagtgagactctgtctcaaaaaaaaaaaaaagctcagtttgatgtgccatctgttttttctagtacctgaccaataagtattgtatccattttatagaggaggaaacagaggaagagaagttaattattttgtgtttaaggtcactcagctagtagctaagctaagattctaacccagatgggcttggttcggagcccatattttttattactactttatagctggaaaatgataactcagaaacactactcttgcccaataaataattggacccaaagagttaagtaatatttaatcattataaaagtcgatatagtaatagctaccatttcgcactatcatcttcctaagattctttaaatctctcattttttgaataaatatagaaacctgcttttgttttgtacacctttggtttttctcctttgtactgtaagttcacccattatgctaatgccattttagggtaaaactgttaatgtgttatattcaggatgaagttcagtggaaaaatgtttaaaataagtaatatgaaaaaacgaaataattttaaagtacttatgtttatattaatatactctattgaagggtgggatatgcagatagtcatattctctttaagataaaacatggtataatactctaatcaatctaaaatatgataaaaatagaatattaataacacttgaattggatacacatgatgataagacaatataattttgaaaaaaaaatacttttaagagattctgaggaaggcctaggaagtcctaaaggaggaaagaggaaaaagtataaaatagcaatagaatgtaggcatattaaatcttcctttttaaggataggctgtgattatactgctacagtagctattgtttttttacttaaagagtgcttactatgtatttactgtgttcatttcagaattttaatctttaacactttaataacattttaattactttagacttttaattaatctttaaccccatgaggtaggtacaataatcatgatctgtatttttaaaaatgaggaaagtaaggcatagagagaagaatgatggttagtaagtggtagaactgagactgaaaacctggcagtcaaggtctagattctgtgttgtgttcttaactactttttgtactgcctaagtaatgaaatgatgactactagcaagtgcaggtactctataactgagacatatgatctaaattaaatatatgtgtcacaatttataggaactaggaagtttgtagtaaagaactgtgtggaagtaatgcatgaaatttttgcttggccaaagcaaaaataaaaatgtagaagatttagaaatgttctttaattacctatattagtttcctagtattatcataacaaagggtgacaaattgggtgggttacaacaaaagaaatttattaccatacagttttggaggctggaagtctgaattcagactattggtacgaccatgctccttttgaaacttgtagaggagaatcatttcttgcctcttctaactggtgtttgccaagtatcattggcattccttatcttgtaaatatatcaccactttctgccttccttgtgacaagtggccatctacttcctgtatgtatgtcttcacatggtggtctcttctttatataaggaaaacagtcagattaagggcccaccctactcatgtatgaccttaccttaaattaataattacatctgaaaaatcctattttcaaataaggtcacattctgagatactggaggttagggctttaacattatcattttgggggagacagtcaaaccataacattgcctcataaaattataattatagagaatttatattatggagctttatttatattctagaattttatattttttgtctttgaaggaaaggggaaatttagaaaactttctaattctagtcaagtaagattttctaagagatgtttagttaattttcttcatttaagatatgttgaagggttaagttaatttctcatagggttttgggaagcttgtgaatatttgtaaaatattgtgaaaacttttttaaaaacgtctcttttttaatcatgatagtcacataattaattggcatcttgaagtggtatgcctgtatacctgaaaatagacattaattacaagtaatagcagacatgcaagaaattaaaacaattttagttaggaatatcaaagtagtttgaaaaggttaaatatcgcctgtgcttcaggaattgctttcacatatgacatcctttaacaattcacaaacataacctctcttttctctctgtgcatatatagaatatatattttttaacttaaaattaaagacactaatatctatcatatacaatattatatgttatatataaaacatgttttatctcttttatagaatatataaatcgtaattttttctaaattatgattttaacttcaatgcttttagacttcaatgttaatataaatatatacaacttatgtgatatataacttatatattaaatgtaagcttatgtattataataaaactataaatatcaataccactcaaatgtgtaaataacacataaatcatatatactacattcatattattacatataatttagctttgatgcttttaaacctattttaaataacaacttagtaaggaattgttttttaatatgtactttttaatagattatactgtaattatacctcggtcttatattcttagaacaaaattttatggttagtatctgaaaaattaaactttataataggacttagtgtttgcgaagattttaggaaacaaatattttatatagaagaaatccctgtatttttaacatcacaagaaatgggtaaattactagatgagagtttttttttttttcctagattccagatggaaacattatttccataattagaattaaaaattgatcccgatattttaattttattattttattctgtatttgattttaaacattcttaagttcttggtcccaggaagtagagattattgaacataatttatagacagtaaatggcaatcatcgtatatattggattgaaagaaaaatacagcatacactgcttcaaaagtaaatgttttctttaaaggatatatagtatatacgttgcatgaagtaaatacaaatgttggtatttctgtgcctgtatggattttcctcctcaatcttcctttgccctacctatgtgttactagagaacatttctacaaattttcaatcgcaaaagaggaaaaatacaataaagccaaggcaagaagggaagtggacagtttggagttgctaattcatttatggtaatggtttataataacatacaaatcatattgtataatatattctacaaaaaaagataactctaggtgattattaaactttttgtaaatcatttgccctagcaatgctttgcttttttacatttgaatatttggggcaataatgaggctagatagatagatatagatgtttatatttctatatttttaaggaccttctctggtggctaaaacaaaattatgcagggaagcatcagcaagccatcaaatgagctgcaaaaccacctcattaataatcacagtttaaaaatagcattcaaaaccatctacatagagatactaatactttgaatagtgtacatttatgtaagttacggtgaggtctggtaattcctctgaacaactttgatcttttttgaaagtaatctccttttttgtgctttgctttgagcatttgctaatctcatattctttttaaaagaattacattgacaaattggtattgctatagatactgagttcagactttcaggtaacctcagagatcatatattgttcaaaaaggcatatcttcatttaaggaaagcatatgacaatgtgcacatatatatacatatatatatatatatatatatacacacacatatatttatatttgtgtgtgactaatgcggttaactcagttttgggggaattgaggaatcacaaaatttgttgatagctttttgccagtttgcaggggaccctcttatagctctgcatcagctatttttttcttagcatatttttgagttgtttggtagaagatttgaaagggaagcgatacaatattacagttaagctcactggtttgtgtgttgataacataggtttgcatcttagctccttactcatttgtcaagttattgaacttggctaagcttaagttcaacaaaaaaaaaccaagaagcgtatatatgtgtgtgtgtgtctatatatatacacacacacacacacacatatatatatacacatatatatataactatacctctagtttgtttttaaaaaatgttttaataccatgttgtttccatttgtttttccttataattctctattttattttgaccattccaaaacattctgagaagctggttcataggcttcactgtaagaatggtcagtagcaccaaaaaagttaagaaacttgtgatctagtggaatgggatttatcaactgtagctcgagatttaaaaggctattccagtgaatgggttctgctgtatgcttaggtactaaggtaagctttccacctttttactgctcccagcacctgatggatattatattatatggtcttatcagagtcagtggtttaattcaggagcatctgagtgtgtgtgcacgtgtgtgtatgtgttgggtgtgggtacaagagatgtagtgttcactgttctccagattattttattttttaaatttatagatatgtgtatctccctattaaaaatcactataaatgtaagtttaacctgtgtttgtgatctttattgaatatgaaaatagtgccacttttgtcctataatttgtacgtaaaaatatttcgggctgacttccagaatgcggtgaaatgaaacaacacttattggggaaagctattcatttgactttttaatagtgtgctcatttttattttgttttctgcttttttttttctttcctttaaaaaaaaaaaaaagaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaaggtaaagaatgacactttagagaagacctttaatcatgctttagttattactaatgtatgatagtttggcatttacattttaagtcatcaatgtcagaaaatgcttgaatattatagaaaggtactagtgatactattattttgggttagtatggatgttgcttataacttagagtctggtgatctgttgtaattgttaaaagtaatggaatataaataaattcactaaggcacagctaagttgctgttggtaggatatttcaaaagtgtgaataaaatgactgctgccaggtactgtgtggagtgtgaacttctgtataactagtatagcacacaaataggaagatatctagtatttattgagtaccttctatatgccagagagtatttgaggtatcttaattattttatcaattcaaaacaatcttgtgaaataggcagtcatatttcttttccacagggaaaaacaaaacaggaagggttcataggaaaggttaataggtccaagatctctctataatggccagaattcaaacctagtcagaatcttttttttttttttttttttttgagatgaagtttcgctcttatcagccaggctggagtgcaatggcgtgatctcggctcactgcaacctctgcctcctgggttcaagcaattctcctgcctgagcctcctgagtagctgggattataggcactcgccaccacatctggctaactttttgtatttttagtagagacagggtttcaccatgttggtcaggctggtcttaaactcctaacctcaggtgatccacttgcctcggcctcccaaagtgctgggattacaggtgtgagccaccgcacccagcccagaatctattttgtctgcttcactttgttgcttttctaagcaaaaacttctaatctgaaaagagaatatagtaaagtaatagagttggaaaataaactccagattttgctcaaaaaatgtctataacatgatactgcctttagaattcacacatgagaactatttctttgaagtataattcataaatttatgagtatttgaaacacataataagcatttagtggtatgcattttgccctaaatattgttttaaatgttgtgttttcattttcatttactttaaaatattttctcttgatttcttctttgacccatttgagagtgttttatttttctagataactgtcttttactaatttctaattcgattctgtgtgatcagagaacacactactatttgaaggctttatttagacctgttttatggtctagaatatcgtatgttttaataaatgtaatgtgtgcactgtaagagacacattatatttgtgttgggtggaatattccacaagtgtcaatcaaatcaaattgagtgatagtgtcctgtatttctgattttctgtctgtcagttgttgatagaagaattttgaactatctcactgttattgtggatttatctgtttttgcctttcagttttatttatctgtttttgccatacattatatatttatatatatatttatatatatatttaatatatataaatatatttttatatatatttgatatataaatatatttatatatatatttgatatataaatatgtttttatatatatttgatatataaatatgtttatatatatttgatatataaatatgtttatatatatttgatatataaatgtttatatatatttgatatataaatatatgtttatatatatttgatatataaatatatgtttatatatatttgatatataaatatatgtttatatatttaatatataaatatatgtttatatatttaatatataaatatatttttatatatttatatatatatttatatattaatatatatatttaatagataaatacatatatatttaatagataaatacatatatatttaatagataaatacatttatatatataatatatatatttaatatataaatacatttatatataatatatatatttaatagataaatatatttatctatttacatatttatatatatttatatatatataaatataaaatatttatatatatttacatgtatattataatatatatctttaatatgtcacattctcactttaagtagcattatatatgccactttacatatagtacacacaccttacaacagtatacttttatttcccccttccagcctttgtgttcttatcgtaacacctcttatttctacatgttataaacacaattcattgttattatttttgctttaaaaagttaatttaaaataatttttaaaataagggtaaagtctattatatttatccacttacttattccctacacttgtcattccttttttatagttgcagatttccatttgtatcatttttccttttatataaggacttctaaatttcttacagtgtaggtcagctagtgataaattctttcagtgtttatttgccttgaaaaagtctgtttttccttattttattaaatgttactatcatgtttatgtatattttcttttttttttttttctccgagacagagtctcactctgttgcccaggctggagtgcggtggcctgatctcagctcactgcaacttccgcctcccaggttcaagcaattctcctgcctcagcctcctgagtagctgggactacaggcacatgccaccacgtctggctaatttttgtatttttttagtagagagggggttttaccatgttggccaggctggtctcgaactgctgacctcgtgatccgcctgcttcagcctcccaaagtgctggggttacaggcgtgagctaccgcacccggcacgtttatgtacattttcaaaattatatgtgtgtttataaaaaaggatccctaacttttaaattttatgccactttatctttttttggtccattgaattttttttaattaatatactttcatttttagagcagttttaaatggacggaagaattgagcagaaattagaattcatatttatactctccccctttccccagtttcccttattaacatcttgcttttgtgtgctatatttgtttcaatcaatgaagcagtattcaggcaccaaggaaagcccataagattctctcttgtacattctgtgggctataacaaatgtatagtgacatttatctatcattacagtattaccagattagtttcattgggctgaaaatcctctatgcaccacctgttcatccctccttccctttctttccctgaactcctgataattaatggtcgtcttactctctctgtagttttgcctttttttagagtgtcatatagttggaatcatagagtatgattgaatgaattcatattggcttctttcacttagcaatgtgtgtttaagattcctccatgtcttttgcggattgacaccttaattctttttactaatattactgaatattccactgagtggatgtactgtagtttatccattccactattaaatgacatcttgatcactcttaagttttggcacttgtaaatgaagctactttaaacattcatgtgcaggttttgtgtggtaagttttcatctcaggtaaaatatcaagaatcatgattactggatggtatggtaagaccattgttagcttagtaagaaactgaagaactctcctccaaaggacctgtgctattttgtatccaataagcaatgggaatccctattccacagcctcaccagcatttgatgttttcagtgttttagacttcagccgttctaatagatccgtagtggtaatatctcactgtgttaattagaaattctctaatggcatattatattaagcgtcttttttttttcctattcagaaatgacaaattctttaaatcgacaaactcatcttcctcaagccccagaccatggtaggcagccctccctctccgtcccctcaccccaccccttagccacagtgaagggaatggaaaatgagaagccatgagggcctctgccagggaaggctgccccagatgtgtggtgagcacagtcagtgcagctgtggctggggcagcagctgccacaggctcctccctataaattaagttcctgcagccacagctgtgggagaagcatacttgtagaagcaaggccagtccagcatcagaaggcagaggcagcatcactgactcccagccatggaatgaacggagggcacagagctcagagacagaacaggccagggggaaaaaggagagacagaacaggccagggcatggcggtgagggactgaggcccctaaattttgatcccaggggaaaagaagaggccagttggtccagttttgatgggtatggggaagggaatgtattagtaagcacgggggagaggctgccaacaggcacctcagaggtgataggacaggctgaacccctcaccctgacagaagggagcttaagagctctggggctctctgggaatgtcactgctaaaatatatatctacatgtatattaaccactcgtgggagggcaggggcaaggcctggggtgggatcaaaggatctggtgtggcatccagtagccagtcatgcctgcctgagatgccccccatctgtagcccgatcacgttcttgccctcttgcagctggttatccgagaagttccgaggattctccttggatttcttagggaaccagttgggatccccagagaagagcccatcatcccaggctactgccaacccacccagattcctcagcgtccgctgcacacaggccatgttctttccttcccagaggtccacagtttggaagatgtcagtggtgttaatgccatagcgctcagctgcttgcaggaactgagagatcttctccatctgcttgaaggccatggtggaggcctggatcttctttactgggacctgccccttggggtacagtgcattattgagctcacataacaccgtgccatccttgagccagttctggaagttctcgcgtccaggctgggaccggcccacatcctttcggcactgggtggtgatccactggatcaggatctgctccagatctgcatcatactgtttctcaatcttctgctgcacctcctggctcaggccataatgcaggtcccctgttggccattccaatgggtggcggtggctgcggggagcgttcaaacgggctggagagcggcacactcactcaaggcaatggctgcagctgccgagcttcttcttacatgcttattttctacccagatatcctcttcattttcaaaggatattttcactagacagaattttcagttgatgaggttttatttcttttcagaactttaaaaatttactccattgttttctggcttgtgtttttctaaagtgaagtcttgcattatttttatgtttggtgttctgttaaaaaatgtgtctatctttggttgcacttaagatgttctatttatcactgattttgagcaattttattaggatgtgccctggtatatttttttctatttgttttgctgggggttcctttagcttggttctgtaggtttatagttcatgccaaatttggaaaatatttgaccagatttcttccaatattttttgcctcccatcctctctttcctcttctttgggaactccaattctgcatattttaggctacttaacattgggtctcacagctccctcatactccattcacttttttccttctcttttcattttggataattttaattgcttgtttttaaattcaccaattttttttctgccatggctaatctactcttaatcctatccagcatatttcatctcacacattgcaatttttctccctgtaagttcatactgggtcccttatattttccatatccatactgtgtataatcttctatattgttgaatatggttataataattgttttaacgtctttttttttgtactctgttacttctgggtctgtttgcgtttattgatttttctctttaatgtggttcatttttttctgtttatttacatgcctggtaatttttgattggctaccagacatcatgaattttatgtaattggatactgaatatttttgtattcctacatatattcttgcactttttatctgggacacagttatttcttgatcctattgtggcttttatttctttgatgatcacttggtaatggcttgttcataagttttgttaggaccagaatagcctttagtgtgtagctaatttttctccttactaagacaataatacacttgtaagtattctgaggctttgtaaatacaagatttttttttgctttaatgtttagtgagaacacgaactattcttactgtgtgggcgctgactattgattcttctgctcctttcaagtactctcttcttatcgttggatagctgcgatacatgtaggtggtaatcagtactcagttcaaagctggaagggaaccctttgtagacctctaaagctttctcactggacagtgctcatttctgggttgtttgtttgttttgcttgttttttctctgcctgtggactggaaactttctccactcagtatgcttcggtaatcaaagagctgatcttatgtgtttctccttattcaggtatcattgcctagcattccggtgtctgaaaatattatgtcacatattttgttcgtgtaagtttggtgtgtgtatgcatgtgtgtgtttattgtagttttaggcagcattagttcttgactagaagcagaagttcatttgatatctgaataaaaattttatttaaagatcaaagcaaagataaggtcattggcaggattaggaatgatctgcagcctagtgtttttggaacgtaatcccttgttataggctggctctgtgcattctgctgcacaaaaggagataagcaggaagtggtgctttctcatggaagtcgttttttcttttttcatcttcctacaagttgattatacaaaagattatttatgtaacaattatggaaacttattaacaataactataatggctaagttattgtggatgtaagactgaaaaaatatcagtacaagcttttctctttgctaggatggattcccaattataatgattttatctcttagtatttgcagaaatattgtaatgtaagtggtaatttttcttttgcagatagactttattttttttactttattttctaatagaaataatttctctttagaagattagtcaggtaattgcacgtaaggaaatggaagttgttaatacaaaagaataatctgtgcttaaagtttctgaagttcatgtggattaagtagatactttaattgaaaacgtcttgctcataatagtcttaatataatcctgataatatgtaggagttatgaaatattttaaaaataatgagatgggagtgctttggtataagcttatgattttcaacttgatcaaatgaatttgagaatttactttttcaagacattttcatgaattttatgttgaagaaatgtttctcttggcaaactcttgatttatggagaatgatgtctaacagattaccgcagaaagccccagctgtatgggaactttgagtgtgtagcagagggaaagaaacttaaagaatatatcagtgtgtctttttagtaatagcacataagggagattcctggaaagtaacattagcagattgatcagtctagtgggtaggacttcaaactctttctaatccaaaaagtagactcatggttttgagatgcttttcaaatgatttgtatagttacagtactaggattaaggtattaaggtatatagagaattaaaagcattatcagtatactgaggcttttctgtcatacatagctagttatcactgtctttgtgaaaatcttcctaaaagataaaatgtagtattatgctagtgaaccaaataattggttaaaactaatgcaaaagtgaaatttatgaaatggagagtaacctgaagtgtttcagagaatttagagcttgattttttttttatttctagttgattgcttggtttcctttctcaaataagtttacagaagatgggagagagaaagttatgaaagatcagaaacctttaaagttgtttttttttaatatcaaatatactctatccttgattatctacatcttggattatcctagacaatgtaaatgttctctacaatgtactttaccatctctcattgacttgagttggtatgtgacccaggaatacaaactgatgtgtatggatctcattaaaatattaattgaaagagaaataggctgtagtttatataaagttactccttatttaggtggtccacgtcctcaactaaaagaggtgctattcagagtttcatatggattccctctccctcaccaaactgcacacacacatatactcttctctccaatattgtgtgcattaactgtatgtgatcttgaacatccgcagtaactttttttcacttgtgattggatgaccattttctgtagatttactttttattttatcatttttaaaagcaatatctgccataacttaatttttatattcttaaagttgaaccaggtgaattcacagagctgaatatggacttgggaggaggatgtgatgccaaatcaatcaggatttgagtttttctttttctttggataagaagctatttagtttatttttaaaattctttctggctcttcatttttacagttacaggatatatagtggactgaaaatttgaaaatgaaattaaggaatgttgcacccttggagtgattatggattgtgacttggatacagaggaattatatatagcataaagcatgaactagctggacttcaaatcctagctgtttaggacaagtttccaggtgtttctcaccattagtttctctatcagtaaaatggaaatggttttacccatctcagagctatgattgtgaagatcaaataagcaatatgcatataaagcatggtacatataaagtattcaataaatattcatgttagtatgatcagctgcctgtggaccctagtttgctcatttataaagtaagaaggttaaacttttaagatttgtatcactatttatttatttatttgttttatttttttgagatggagtctcactctgttgcccaggctggagtgcagtggtgtgatttcagctcactgcaacctctgcctcatgggttcaagcgatttgcatgcctaagcctcccaagtagctgggattacaggcacatgccaccaggcccagctagtttgtgtttttcagtagagatggggtttcaccatgttggccaggaactcctggcctcaagtgatccacccactttggcctcccaaagtgctgggattacaggcgtaagccaccgtgcctgccctgtatcactatttatataaatatatttaaaattttatagcttttcatggtgagttaaaagtatatatacactatatactttagatgtcatataatctacttaattttacagatgaagaaataagcccagagactccttgcccaaggtcacaaatctaggtagtagtagagtcaagtggaaacagattttttaaagagatgttttaaagatattatactcttttccttttataatattatcaacattatttattgagtctgcactgtatacatgacactgtatttggtacttgtagtgagggaataacacaggaagcagtatgcaaattaacataaaaggtggcgcttcttaccttactgaagttacctttctgatatgaggtaactcagtattttactcagtttgcacattttatttccttacttgattgtctttggggaaatatgatattctacctctcctaaagaggagaatttactgggaaaacttgggttttaataaaaatggtttcatgagaatgccacagttcctgagtgtactatttttatatatggcctaacatcagaagaaaattagtaaaaatagctagataatttttgaagtatcaaccttgaggattaaatgttactttcttttttcaccttagggcacagtcagtggtgtgctgctagttacaccaaataatataatgtttgatccacataaaaatgaccctttggttcaagagaatggctgtgaggaatatggcatcatgtgtccaatggaagaggtgatgtcagctgcaatgtacaaagaaattttggatagcaaaataaaggaatctttacccatgtaagagtgatatttatattcctttgcaactttattgtatctagatagttgacccttgtctaataccttaactatttttactagttttcttatagctgccttttattttgtcaataatgaaacgaaaatatatgcattattgagaagattattcttaatttgcacctgggatagttatgaattatcttagatttgtatttgtgtatgtggtcagagaaccagatatttgaaaagtaacctatagtgcccatttaattcagtgtttaccagcctttttattcagacacagcttccagtcttctaaattacccctgtgagcaatcactgttgggataattttcaaatttcccttggaagtgactgaagagctgtgatttgagagaggccacatgagcaaagagctgacattgctgtgggcaagacagcttttttttttttaattgattgatttatatgtttgcaatcttctctcccagtataaaatacagtgtaaagtacagggaagaaaacccacaacttgctcaaatataaagagttaactttggaatatactggtcagaggatttgtgtgatatgttaagatagctgtgagactacagtttggacacagcttttgaaagtaatatgcttgtccaaagtaatggccagaaagaaaaggaggaatgggaaataaaaggagaaaaagataaaagataggtataaaaagaaaggaaggagaagtagcaaggaaggaaattgatatgtactaggaaataacctcctcattccttcatacatgactaccaacattttaaaattgtcttcactttaactgatactgatatttatatccctgtattagcccacaggaatgatagctgttttaaaattaacccttgtggggcagagcaacttacaaaggaaaaaagggacaaattatttttgtttctgaggaagactaaatgaattggtagaatatctgtgacagaataaaatcctttgctcaaaagtctccactgtaccttccacccaacagatattattttgacttggtagactaatctttagagctgcagataattcctagaaggtgttagtatcctctgtattagttatatttgtagatcatcatccaaggccagtttcagcaaataaggattattgggaggtggataatgggatgagacaaaggtaaaagagtgaaggattacattcaaagaagaggaaggatatatacatatatggagagagagagagagagagtcattggtgagattctgttgtcctccttttctttctttttctttttctttctttcttcttctttttttttttttttttttttttttttttttgagatggagtctcgctctatcacccaggctggaatgcaatagcacgatctgcaacatccacctcctgggttcaagcggttctcctgccttagccttccgagtagctgagaatacagacacctgccaccacatctggctaatttttgtatttttagtagagacggggtttcatcatgttggccaggttggtctcgaacccctgacctcaagtgatacactggcgtaggcctgccaaagtgctgagattataggtgtgagccacgatgcctggctttgtccttttccatttgcaatatggtactttggggttctcttattctgaacaatccatcactgttctacaaggatgctgtatagctcttccctttcaaatcactgttttgtcattcattgtcagctggaaagtgtcacctggatttaaatatttaaagatatttcttcagaaagaaatatctttaaattctgccttatggattgattaaaaacaatatttggcacaaaattagataaataaaacaaatgtatgccaaaaatgaggtataagatttgattgcttttcttctgtcttatgctccttgggaggttgatttcaaaggtattattatggtattacattcaacagtagtaacatcattgacataaatgtttagcctttcagcatattaaatctgaagagtatagcacttttctaaatatatatcctgtcacgtttgttatgtttatctcttacctaagggtcttctaattctttaaatgtacagataaaatttctcaaaacttttgcccggttccaacaccctatagatgcagtatgagtgcatcaccagtagatgacactattgtatatttaataacaaactagattcttgtttttttaagatgaatcagatacaaaggcagcagagatattgacttcaactaattaatacttcaaaaatttatccatcctagttatagaaattatgcatacttgttgcagaaaaattggaaaatactgaaaagcggaacaagacaaagagttacccagcttcaccattcagagatagccaattatttttgtgttgacttactttacaatctttccttttcagcatattttacatggttctcaaactatgtatgtataaatgttaatgcttttttcattaagaactcatataattttcatttatcacagacttcttgtaaccatcattttaaattagcaacttacatttcatggtatagaggtttacactccctctttccagaacttaacttttgaacattagtgtttacatatacaaatgtcattaaatctgaaagtctagacccagttatgaaccattcatttgtctagtatctaaacttttcacctgaacaagttctcttagaggtattaaagagtatagttgttagcctgaagattttctctatatacttttgcttgagttttattcagattggttttaagccttacatttgagccatatattttaatttaagctctatttgaatgtaaataagcactgtgtgtgtgtgtatatctatggaaatcagtttatttttactttattgggagatttaaaattttaattaaacatttctctgtgtttattttccatattccatcagtgagtaaattttagtttagaattacagctttacccagggtttatgtcatcaagttcccttcaagtggattacttgcaaggaaatcttactttgatatttcctaaatattaagcaattgatataaaagtttgacttaattacttgatttatagaattacttggtctataaggttaattatttggtcatattgaataaatcagattttttatattctttggagatacgtgctacatccttttgttaaaaagtctttttagtgatactaattctgtgttcagtgtgtgaaaagtaaaataccacaattttaaaagtctaattatttttaattttgtttaatgacagagatatagatcagctatcaggaagggacttctgccattcaaagaaaatgacaggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagtaagtgttatagagtaaatgaagttagttcatccaattgtatggtgtctccgtctttcctcactgactcaaaagccgctgtaccttagggcaacctgaaggataagtgagtgacccttgaccggtgattctctggggacaagtatatacagtctccagtgtctactgtcttttcttatcccacaggtggattgtacacataatgagcatcattgctacccaccatgtttaaacattcttggctcactacatcgtatcattaaacaatttatttcttgagaaattgcacaaaagctgtataatacctttgatcactccattttctcttaaaaagtttttggtgtgttaccattaaaaatgtcttttttcatatataacattttaattgccaaagttgtaatcccatcttttataaaatgtacagttaaacctaaaagtgtacttacagaattcttccacgtatcgagaagtttcatcatcatcatctaattattttcttttaaaaacctgccctcaggacaaataaaaacactattttatctgtcagttttctggtactgtttacttctgaaaattacactattttcagtcttttatttctaatatactgtgcttctgttaataaattatgggttaaatggggtataacaactaacttagctaacatttctgatattctattagaatgtttatcccagactagtccattcacatgtgaacttttctttcattttttaaattcaaagatttttgttttgctgtaatacataaaataaaatttaccatttaactttttaaaattatggtaaaatgtaacgtaaatatattatttgaagcatttttatatctacaatgcagtggcattagtacattcacattgttatgcagatcatcactactgtccatttccagagcttttttcatcttctaaaactgaaactctgtaccccttaaacaataagttggccaggcatggtggctcactcctgtaatcctatcactttgggaggctgaggcaggcagattgcttgaacctaggagttggagaacagcttgggcaccatggcaaaaccctgtttctacaaaaaaaaattacaaaaattcgtcagacatggtgatggtgcacacctgtaggcccaactactcgggagactaagatgggagaattgattgaacccaggaggtcgaggctgctatgagccatgatcatgccactgcactccagcctgagcaacagagcaagatgctgtctcaaacaaaaaaataaaaaacaaaaaccagtaacttgcttttctcccttcctcatagcttttggcaaccaacattctactttgtttctgaatttaactactctagatacttcatgtgagtggagtcatacaatatttatccattgatgtttggcttatttcacttgacataatgccttcaaagttcatttattctgtaatatgtgtcagaatttcctatctttttaaggctgaataatattccattgtatgtgtgtacattttgtctgttcatttgttgctggacattttggttgtttcaaccttttggctattgtgaataatgctgctttgaacattagtgtacaaatatctgtttgaatccctcctttgagttttttttgggtatattcccagagtggaattctggatcatgtggtaactctatgtttaatttcttgaggaacctccgtactgttttccatagtggctgcaccattttaccttccctgcggcagtacacaagatttgggtcagtttttaaaataccgaattttcttttcatcatgcagttgagatatcctgaagacctaagggctgtgttcagtagatattaaaataattcatatattaatacttgaaccaagttctataaaagatttaatatttttcttctgtaatatttttttaattcaaaactaatgcatgttcagtaaagaacatttggcaaacataggaagattctagaaaatttataaaaatcttctggaattcatcacccagagatgatcattgttaacattcaatatatctgtctttcttatagaacaaaatcatatgtgttaatttgttatttacatcaaatcaagattatactatactgttgtatcctgcttttttatgtcatgaaccttttcctatgtgattacagttctttgaaaacatggctttaaaggccctaaaatttatttaaccatttgcttattaagacatccagttgttattaacgatctgtattgttaagacattttaaagaatgctgcccagcattcttcaaaacatcaaagacagaaaatgcatctgatagttatcttatattttgaagatctttgactgcatctttgactacatctgatagttaccttatattataaaacctttgaaaaagataaaataatctgtttaagctgatgatgtggtggaccaattttgttgtgggggttgggggtttaatggggttaggggaggttattataaccaaatattaaaaggacaaaaattgatagatgtttttaaacagtcatctctaaactgttaccatttggtttcttctttttttggaataattagttttaagtaattttaagttacttaatattctgtaatagagaaatattcaaactttctgatctttatgactttataataaaattatgtaataaatataaaagtgtctagtccaattatgagaagaatggtgaaagctcatcgttttaaccacatgaaaatagtggggttcccatagattatctaccttgtgtaatactgcacagaaaaagccatgatgagtacccaggtctcctgactataagtgctatttcctccagtgtgctgccttggtaagctaatcaatgtctgggttcctaaattcacctatatattcagaccctcagtatactctatcagcacctctggttgaaagagttagaactaattcgttcttaattaactgtccaaacaggtggcagaatctaacatattattgactgttttattacaattttgtatacatgtaaaagcattagaaacttcattaaatttttgtctgaaacaaccatgttaagtatacctttaaaacttctacagttatttagatgtcattcaaaaagactgatagagaatatgtagaaaattatatatatattatgtgtgtgtatatatatatgattgctttagtatgggtgttgaaaatgtaacaatgtttctgaaacttttactttttttcttaatgtccttagacataatttttattcattaacttggctcttttgttaagtttagtcatgttgtatctgtgactttacctttgaaggaaaaaaaatataaattaagaaaatgtactttagcaccactaaagtgaggttttattctgtaactatttgtcagaattttgaaggtaaagttaactaaactacctaaacttggtgtgtgagaattgaataaacactgtttgcatctcaattctaggttctgcacttttaaaagaaaagcaaaggcatcgattacataagttcttgtgtctcagagttggaaaaccaatgaggaaaacgtttgtatctcaagcaagtgctacaatgcaacagtatgcacagagagataagaaacatgaatattggtttgctgtgccacaagaaaggtaaaaaacccatacgacaccttgagagcattattgagattctttgaactaaaattattttgtgtgtcaaaataccaatgataaactattgaaacatagtttatgattaaaagcagacaataagtctatttgaaaccattttgcccctactttataatttgccccatttttaattgcattcccttttgtagtttattatttaaaaatgtgaacaaatatccaatttgggtagtaaagagacttaagataccttggagcaagaagattcatcaaaatattatttgatatagctccttcctgaaggcagctaatggtgtataattcctttatattaaaaattcttcaaatattcattaaatatcttctatatacgtgacactaaattagctactaaaaggatgtagtggtcttcacaatatttgtgtgtaccctttgcacaattagatttttcatcataagttttaagcggttgtaaaagatgtctattgtactatcttgtcaatttttacattttaagtaaatagtgttacttatacccagtagaactgaaacattataacaactttccctgtactattattcacttaaaattactttaacagttagacattgcatcattactttttctctttaaacttctatttccataataccacctcacacaaactcattacaacgtactatatttttatccccattatagttctttgcaacaaactacatatacttaacacatttacatatctgtgtgtgtatattgaaattgcatttattttaacattttctgtgacttttgtaaaaacagtaaagggtttaaggttttaggctacctgcaagccaacaacttagtctgcctccatttggtgcatgctgggagaaagcacaaacatctgtacaacagcagtaatcagaacatcagcaattgtgtgatttctctgtacctcctttcctacaaaggatgtgaaaaaggccaagtgacagctgcacatacctggggttattttacagaagaggaaccataagtttagggaacctgaatttttataacagacagtaagcatggttaccctttgctagacagtaagatactatctctacttctaagataatgctacactaacatacttgaaaagatactgctgagcaaaggtattacacataaaaagtaaaatatcataggaaatgcctgtcttaaggagatagatagacctttcctatatccattgatagattaatatgtttcattgaaaggatgagataggactcagcatcagttctgcctctcccttttatttttctttataagtactgagaagctttgttcatagaaaagtcagtgagactgaagagagtttcattttaataatgtcattcaattatttaaacttgtttctatataattccaaaaattaatcatttttgtcacaatatttttagtgatcatcagtggacaactccattgaaaactccttcagttttgcggaaatcaattaatgagaaacaacctgacatacagaaggacttattacccagtctttataatcatttcctgtctcaacaccaatcttgggcagcctaaaagtttttatactgtagggcatatcccattgtaaattctgagtaggtgaagatatgcccttcttttataaattagaaaaagtgctttagtgaaagcagataacaggaaatctgtaaaatatcttgaccatactgtttttaggcagattattatgagcaaagagtaacatatggaaattggagatacgcgaattgattcccttagcaccatcttacacgtttgtgtacctcttggaaaatctttatatgttgctttggaagactacagcttttaggcataaaatgataatgctcttttcccttttcccactccaccatatatagagtaagtacaatgtgtgtcttccacaacattggcttaatcttaaaatatgatttgcataattgatgaatacctgaaagggacagagcctgatattcaaacgttccagtgatgttgaaatcactacaatgagaaatgtaactatatttagttaaaatggacataaaaatttagtttttctcattattcttggttttaatgtttacatggaattccctattttaatattcattcttttatcttggttaatattcattacaaattagtattattaggattctgatctttattgtagacataaaacttaggaaaactgctgcatagatagtgagaaattgataaaaaggtaagatgttacattgaaagataaaatgtagcaccttttaaatatgttagctgccacgtaaagaatggcaattttaaaaatcattatattgaaaatataatttctagaaccatggttattaactggtatatgttagctgaaagttatataatcaattttcaaaaacatgttaattaaaaccaataaaacgtagatatttgaaatgtgtgtgtgactctcaaatacatttatcagggaatgtaacaactggctttagtgtagtaaacaaaacattgaaaaggggaacctgagatttctaagattagatcatctgtctctcaacactgtatgttcctagtatcatttaaaatttaaggacattacatttctattaacttggaaaattgtatataatgtctcaaaataggccattaataaattgtttacttgtattttagatcattagattattgtaggaatgaggtcaaagttgtgtatctaatttccttttccatcactagtgtctttaaagaagaaaagctttataatatacaacatctgaactagtcaaacacatgccaaggaaaatcttaatttggttttctaaagaacaacctgacagaatatagccaaataaaatgtttaagttaatgccttcctgatagtagaccttttatattaatataaaacaatatattttgtgtatattttaagtcttcaagatttatcaagatattttacaaatataattttttaattctggcagcacagaatactaggtatattaatagtcacttctcctaacaggacagatcacttgtatgccttcttcattcagtggagtccagaaatatatgcagaagatactggcgaatataccagagaacctggatttatagtagtaaaaaagattgaggagtctgaaacaattgaggattctagtaatcaagcagcagccagagaatgggaggtaaggagaaaaatatgaagattttagtcatctttttagtttgtatgaatttatagctttatggtagtacaaagtataagtgatgtttccacaaaagaggaatttttttaaaggtcaggttcactatccgtgtttatttgtggttattgaatgaatctgaatagtgactttaatactatatttgtcattctgcttttgctttaaaatactagaaaacccactagcaataaaatgacttttattgagtgtcttatagaatatttagtttaggaaagattaacattatggcaaagaaggaaataattttaattttgctgttatattaattttcataaaacatcgatttcacatctgatttgttttaatttcatctcctccatggaggaggtacggcagtcatttaacacatctgtgcatagtatttgcatagcatctatacaaattactactcctttctatgtttcagacctaagcattatcttgacttaaatttttcaataataattttaaggaaataagcaggtgctaattttataaagtagtagaaattttatatgctcagatttactgaacttgtttaaatggtcaaagttatactaacaaactttttgtaactcctcttagatatatcttaagattacatattaccttttacatgctttgtcttataaggttggtagggtggcaatatctgttggtgttgcctagattagtctcttcttgatgcattagaaaatgtagagcagatgctaaaatgttataataaatgtaatcaaatttttttattcattgggtgttaatgtttgtggctgttaatgtgatatgaatgtatcttgcatgcacttaacatgtatagtaattgaaggtatacatggcttgtcttttgtttaaaatgcaaactgatttggaatgtgtctaatgtcattctgtgtagtatatacagcatcagtttctactgtgactccaatataagggagggaaagaagaacatatcgaccatgtattttgggttattttaatacttaaaccaacattatcaatcttcataccagctttattcataatggccccaaattggaaagtctcattagcaggagaatggatgaatacatttttgaatacttacagaattccaaataacaataaaaaagatctactggtacaggcaatgacatggatgaattttacaaataatatgttgagtaaaagaagcctgacacaaatgaacatatactatgtaatttcatttacacgaagttcaaaagggcaaaactagtcagaaatccatcacactacttgatactgggctgtgacagggtggctcagggacaggagggaactttattgcgttctggggatgttctatatgttactctcagtggtggttacttgggtgattacatatgtaaaatatatataatatatataatacgtatataatatatatatgtatcttatatatatatatattatatacatctatgtccctgagctgtgtttttaagattagctttagaaggtacttaaaatagcccaggtgatcaaagatacgtacctaactaaggcagcaacagttgaaggtagagtggaaggtgatgaaataaagctagaagaaaaggtattagctagctaattacacaggattcagtgacaacctggtaaccataaagttatctccagcttgggtggcacggtggatggcagaattgtcagtcatgaacgggaattgagagctttctctccattggggttggagtacttaactttggaaataagagactattgactattttgattcaaaggaactgtctcagtttctgtgcaagactctgcagggtataatttctaaaggaaaaataaatctcctcaccagtcctttgaccggaattggtgcagttcaaaagaaaatggaagagaaaaaaataattttggaaactccttgctacattgtctgaaaatattaccgcagtatccagtatagcagcactagccatatgtggctattgagtacttgaaattcatgtaatgccactaagggactgcatttttagttttaattattaattaaaaaccgatacttggttccattattggacaatttttaaatatattaggaataacttagatatatgatctactttttcaactgtaaatttcatgaaatctaaatatgatctaaatcagtctaaatctaattaaggtcaagtatttcctatgaaaatttagtgcctgaattgagatgtgctgtagtgtaaaatattctacttcctatagccactagccacatgtaaccattgagcatttaaaatgtggccaatctcaattgaaatgagctgtagtataaaatacacactggaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggtgggtgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaatacacactggattttaatgacttagaatggaaagaaaaaagaatgtaaacatcttgtttgtttatactgattaatattgaagtgataatattttgaatacattaggttaaataaactatattaatacaattaatttcacttttttaatgtggtgtctagaaaatttacaattgtaatgtatcttacattatattgctcttgtgcagtgcaggtctatgcctcatggatactaagtgcctaaaaaaatgtttgttaaactagggaggccgagggtaacaaataaaaaatgttaaactagggtggatcacgaggtcaggagtttgagaccagcctggccaatatggtaaaaccctgtctctactaaaaatacaaaaattagctggacgtggtagcacacgcctgtagtcccagttgctcgggaggctgaggcaggagaatcacttgaacctgggaggcggagattgcagtgagccaagatcacaccactgcactccagcctgggcaacagagtgagactccatctcaaaaaaaataaataaataaaataaaaatgtttgttaaactaatgagtactcatttaagtgaaagagtaattttaaatgttaacatgatttattttaaaacaggaagaatttggctaaagcccttatataaaacagtagtacttcagaatgtgccgtgatgttttttatttttttgttctacaaaggaatggagaataggtgtcctagaatttaggatgaacttgttatggctaccaacttgggcatcagttagatttaaactaacacctctactcactgttattctgctttagtgatacttaaaaaagatctttattatccctgactgttactcaagcagaaatatattgctagccagaaatgtatacattgactggggaagtttgtatatgataaatttggtaaacttattgtttgcttttttctccctttccctatgtaagtgtcataaggcagggatttgtcaatttcatacactattatatcttcagaactaagaattgtataggcatatagttcattctcaatatttattaatggataaacttgggcgtagattaaaattaaggtataaagcttctaatctttcaagattgctctatttcctgaaataagttcttacatcagttgtagtaaatattttcataaagccatagattctggacattttaactaatagtccacagtctgtcatttacatttttttttgttctgtttaaacatattcagtgaaagggaatttgttacctcaaagggcaatactttacattttaggacagctctgttagaaagttatttgttacaataagcttaaggaaacatatctttgtaaattggattcatttatctttattctgtcttccaatgcaagtcaataacaacaagaaacattttctatttactgcgatagtgtgaaaatgtttgtcttcccttttaatcttgtttcagaattattttttccagtacttcaactgtttaactttatgaactctattcagatcttattcatatcagtaccctaaaatatgttaaaagagttcataaactatggcaccccaaattactaaaatgtacacttgggatagcaggaaaaattccgtaatatttttaaaaattttaatttccaaatatgaacattgaagaccagtcctattgaagacagacagaaacatatatttactaagaaaaagaaaatttagccaaattttaaggtggtcaggagtaaaagttcctaatgataaatcagttcctaagtatttggataaaggatctgagaaatactattcttactgctcacgatgtgtaaaggactgaatttcctctttttgtagtgttactttgtatgccacatgataaagagtactttggtgtgggtcgggcgtggtggctcacgcctgtaatcccagcactttgggaggccgagacaggtggatcacgaggtcaggagatcgagaccatcctggctaacatggtgaaaccccgtctctactaaaaatacaaaaaattagccgggcgtggtggcgggcgcttcttgttgtagctactcgggaggctgaggcaggagaatggcgtgaacctgggaggtggagcgtgcagtgagccaagatcatgccactgcactgcagcctgggcgacagagcgagactccacctcaaaaaaaaaaaaaaggagctatgcctgaattaattgcgtcaacatggctgctattgataagaaagcatgtttttaaacaatcaaggcacaaaatgattaaggaaacctttcttcatagtgaaccaaacttatgtttttggtgtgatacccaaataaaagaaatatgcattatgagtcttgcttttggggatctgataaccttatttgataactgagaaggaactacttattacagtctttcccctgatttctgccggtattcaacacaggaagtcaataagtatatccagtgttgtgaggatactgtttgatgtggggctttgcagttctgtgataaatattactttctgttttttgatacagattttttatgccttttcactgaaaagggaagtgctctaatggcattttaacaaattgtcaggcaagtcctgaggtgaagatgaggcagaatgcctattgacatctgctatttcgtgatgatcgcacttttgttcaataaatatacaaaaataaaagattaatagtaaaacaaattcacatgtgccattcagcttcatcagcttatttcttctgtgtccctccttttctccaattgttcatagttattcaaatgtcataaaaatatttagaatacatgtaatatgtacagtatgtatttttacaatttgttttttgagtcatgatccaactaagttctcaaatgctgcagttagttaaaatatctcttaagtctctctaaatgtaggttcctcctccattgctttgctttgcttttttatttcagtttttaagaaatcagattttttttctgtagaatgtcacacagtctggaatatgctgtttgcatccccatagtgtctgttaacatgttattctaccacttgaatgattgatagatctagagcaatacacttaagtatagattatcatctttattttacagataatttctttgtatttttttatttattttattttttttgagatggagtctccgtctgtcgctcaggctggagtgcagtggcgtcatcttggctcactgcaagctccgcctcctggattcacgccattctcctgcctcagcttcccgagcagctgggactacaggcgcccgccaccacgcccggctaatttttttgtatttttagtagagacggagtttcatcgtgttagctaggatggtctcaatctcctgccctcatgatccgcctgccttggcctcccaaagtgctgggattacaggcgtgagccaccgtgtctggcccagataatttctttaagctggttttttatttggctaaaattctcttagtggttaatctctaattcagagcctataccttttccaccataccaagtactcaactttggcggaacctttgcatcatgatggggagctttcaaacatatcattgccaaggtcacaaatcagaccaattaaatcagaataattggggctaggacctagttatcagtgttgtttaaagctacctaggtagttacattgtgcagtcaaggtgcgaaaactagtataccaccatgccacaacttcaggtgttgtgttaaacatatacaatattaagactgtggaagactctttagactatattgattataatatagatcagcttttgagttcctgtcatgcaagttatatgaaatacttttcatattcctttcatctgggctgctgcatcaaaaacataaatttggttcactatggaaaaaggtttgtttaatcattttgtgccttgatttttaagaaaacatattttctcctcagtaacagccatgcagatacaattgatgttgtcatagctcccttacataccacaggacttccatcatgttgtgtactcagagatactacaaggagaggaagatcaaaaaacataccaggctgtaagtcaatgatctttgaactttgtcttcttcaactttgtccatcaaataccctttaaaatttaatatatttggcaagtgcctgaggatccagtagtatagcttaaaggagtgaccaccacaataagctcagattcatgtaaaacttttcattcagctttataatttatttgttgtaatataaagatgaatttggaatttcttatcatgaagtcaaaatggtaatactgtaagttgaatcgcttttatcctgccatcatttatcatgagacattacatgctggacaatatcagcatccaccccaagtaccaacttcaagaggctgtatactagaattttctgaaagtcaaggattcattgtgtcacatgttcagtatgccagtcttgctgcttgaccacacaggcctcaaaggtggagctttttatgctaacattgctttttggttcctttcctttggattgacttttccagtccttttgggataaaagctggcagagaaagctttccaaaatttttcatctctaattttataccacatgtacttcagtatctttcatactacaaacctaattaaagtatccagttctcctaggatgataaataaaaacagctaagaaactggttttattaaatcaactttacttgatttatttagtctcccacacatttacttgattaaattttaagaacgaatttactaagattatgtgttgatagggtgtgtaacagtatttttcattcttaaaatgattcgtatttgaataaaattgctctggcttccctcttgcttctcacctttgccaaaatactgataaaaagacattctgtacagttttggggttttgaaacaacctgtatctttttaggtacatgacattagtcacattttctcaataattgaagtttagattatttaagtataaatgtaaatatgttaactacttactatataaacctctatactattattcaaaatatgttagaatctgcctttcagcttagtttttaaaataatttatagtctttccattttgactttagtatttagtgctgtcccttttagttatataagtgtaaaatatgtaacccgttcttagcattgtaggccataacatttatcacattatgtcattgttggatttggtttttcactactatgtggtgattgccttgtggagccagttctgttttcacagctatcattaagtagagttatggtcaggatcattcattaggtttcccagaaaacttctacaaccgtggttattgctgcaacttttaagaaacaccttatcaggagacttcccttgtttggttaatatcttatttcctaagctgacaggcagtgagtattctggtgatcattttattaaacatatgttttctattattattaaggtacaagtaacaccaaaattaaaactgagttaatatgttaaacgcacaaaaccctcatgatctcttctcagtctagccagcaaaatccacatagaattaattttgtccaaaagtgaaggaattctttgtgtataaagtcactacattgagaaatcacatttctcagataaagggaatttttttaagtattctttttttttaatactgatcgaataatcaaataatattacaaattataactccagaagaaatttaataaatctaaaaaagaaatcagaaggattaaacacttaattagaatttattagttgataggtactgactttcataatacggtcatgcagcacataatgacattttggttggtcccctgagattataatggagctgtctcttagtgatgtcataacatcatagtacaatgcattaccctctctatgtttagatatattttgatacacaaatccttatcactgtgttacagtcacctatagtattcagtacagtaacgtgctatatggtatgacctagaagtaataggccataccgtataacctggttatatggtaggctattccatttaggtttgtgtaagtacacactgtgatgttcacaaaacgaaattgcttaaagatgcatttctcagaacatatccctgtcattatgtgatatatgactatatttctatgttgagaacctgtatagttacaaatgaaacttttagactgtttatgttttcttttattagcatttggcacccaggttttatgcctaatatggtctgttttgactactgattatgttatcttaaagttgttatcgaccttaggagagttttgaactagtgttttgctttccctgttaaaaatattcttcaattgctagcccaaagttatgagctataacatttccattaaaaatctttatctaggccaggcgtggtggctcacacctgtaatcccagcattttgggaggtcaaggcaagcagattacctgaggtcaggagttcgagaccagcctggccaatatggtgaaatcccatctctattaaaaatacaaaaattaggccaggtgcggtggctcatgcgtgtaatcccagcactttgggaggccgaggcaggtggatcatgaggtcaggagatcgagaccatcctcgctaacacggtgaaaccccgtctctactaaaaatataaaataaaatacaatagccaggtgtggtggtggatgcctgtagtcccagctactcaggaggctgaggcaggagaatggcatgaacccaggaggcgaaccttgcagtgagccgagatcgtgccactgcactccagcctgggcgacagagcaagcctctgtctcaaaaaaaaaaaaaaaaatacaaaaattagccgggcgtggtggcgcacacctgtgatcccagctactcaggactctgaggcaggataatcacttgaacccaggaggcggaggttacagtgagcagagatcatgtcattgtactccagcctgggcaacagagcaatactccatctcaaaacaaaaaacaaacaaacaaaaaacctctaatatagactgtcagaagaggatttatgggtgacagactagtttatgattttaaatattaaaattctaaaatattactttatttttaaatttattattattttttgagaaagggtcttgctgtgttgcccaggctggaatgcaatggcacactcacagctcactgcatcctcgaactcctgggctcaagaggtcctcctgcctcatcctcctcagtagatgggactacaggtatgtgccacctcatccagctaattttttttttttagagatagagtcttgctgtgttgcccacgctggtctcaatcttctaggctcaagtaatcctcctgcctcagcctcccaaagcactgggattacagccacctcacctggcataaaataataaatagtgagtagggtaaattatatattatagcttctatcataccattcccaactcaaataggaagagatataaggtaatttaataacttcagttcgaataaagtaaaggaaaaggattattaaattgaatatctgaattatgagaacagattatgttcaacttgtaaactggtagtgttttcaaaagtgctttgttttatatcccatcatgttataataataacaattgacatctgcttcaaattcttggatatctaggcaaatttaaatgacttagcaatatgtattataaatactacaaaaacagaaagggcaagaaggagacttactgagctcattttatgtttgcctgacactgtatttataaatttggatgacttcgagaaacagaaaaccacactcagaatagcttaaacctgttgtttctcgaagtgtagttcccagaccatcagcagcagcagcacctgggaatttgttagaaatgcaaattctcagaccccatttgagtctgattaattagaaaccatttttggagcccagcattctggtataacaaatactccaggtgatattgatgccggctaaaacttgaaagccactgatttaggtctctaatgactagttctgtccagagatgagagccagcctcctcagaaacacatggctggaaggatacctgagcaaaatcaaggccacttcaggaaggagttgtaagggtggatattgaataggcaaccaacagaatagactatgccatgcttggtggtttttggttttgtttttaatatctcatttaaacctcattttggaacacacgtcatatttgttattttagaaaatgtagctggaagttatgacaagctttcaaaatgctgcttccaccaccaccaccaccaaattatataatattgctgatggttgttaggagagtctgtgatggaggggtggagtgtgaccacaatgcactgtatgtagaagagaactttcctggtgtgaagataatgatggtgttcctatgagggactgtgggagagattttagggtaaatgtagtggggctgaatgagaggaataggggaaatggttggtatgtgggggaggtagggtgttactgtggggtgtgctgtgccctgtgtgagtgcatgctggaatgtggaggaaggagatgggagtgggggtttggttgggatgcagtattgcgtgttagaaaggtagtgtgtgtgtgaaaaggtggcatcatgtgtgcatacaacaaagtgaagtggaaggagctgctttaccttaaaatggaagaaattttcaaatgtatcatcatgatattgatattctgattaaaactgaattctagatagttttagtttatatgtatttgtagtttatatttaatctttaaaaaattcacttctttgcttatattcaaaatatcactggttagtgaagtatatgtaggcatagtgaatataactaccttttcaagaaattagatgttagaaaatgcaatttaaaaacagactgtgtaacaggcagagggattttcaggtcactttgaatatttgtgtaggatttatttgtagcatattggcttggtttttacacagtcattctgtaaaattttagggtggaagagtccacaaaaggcatcttattgcttaaaaaatgttcacataaaagatacaatcttatagtactgttagctgtaagtaaggaacataattttatgactatatgaacaaataacaaaatgttcattcaaatcattcatgtgctttaagagactctggaaattatatttactacttttttgttactgggttacttttagtatattcatgtactgatgtttggaaatataggctctgtgtctttaaacttttgagccctttctttgcacatttgggtacagtgcaaccaaacttaagcatgggaaattctctcttccctccccagctttacagcctccactcaggactatcattgctatggatactacttagtgattagctctctctcttgtcaatcaaatctttgtctctagcaaactgttttgtcactgtagtaaggctctagtgctggaaatttatctttgacagaggaagaatgcttttgaaaacagttcttacgtgattttatgtaacttaatttgccctggaaaggaaatgtctcgtctctggtatgggaaaaaagggagaagacatcaaccaattaatcataaatacactctggtaaatcttagtcaattattttaatttgtatatatactagtcttttcatggtgacattatgaaaaattatacaatttctgaaagtttaagcatagaggatatttatagaatacaaaattttatgattgtacaaagtaccttgaagttgtttctgttaattctgagtatcttcaaaaagggaaattaataagggactgtaattttgtttcatattaagtgttttgtatgttctacaccaacaggaagatatcaaatcttaattgttgccttaatgttttttattttagcttaactttttagaaaaatattcagaattttctcttgcttgaaaataaattgaatagaacagagtaaattaattattattgactggatctcaaaccagattcttttatgatattgtttacttaagggtataattttaagaatctgactaaaaggttttttaagctgttcaaaaagttttcaggcaatgctacctaatacaaatcttcaaacgatatcctagtaaggaaattcagtcaaccatactattgtaagaattttatttatttttctgtacgtgtacattgttataaaatgtattgtccattgctctttctgtggtaatttgggattatattttgcttatgaatgtttattttattttcacttaattgtagatgatttaaaatccaataaggactttggaagatgcccccaaagcagcttgccgcccttaaatgttaagtgtgtcaaaatattaaaattttaataggtgttatttttaattgtaatttcaaaattcatttatatgttacatcagcacagagggatttaggcacctgaaatgattgaatttttaaaatttgtgattagatttaccagataaatcagttaacaccgttgttttttttttaaaccaagaacaatgaagctattcatacattttttttatttgaagtttgaataatcatttattcttagtttgcaaagacttcaatacagtttattacaaatacaagcaaaataaattgtggttattctgaaatttataggtcaatctaattaatgtgcatcaaacacttacatttattacagtcaccacgtccaaggcctgttcattctttatttttatttttatttttgagacagggtctcactttgtcacccaggttggaatgcagtggcgggattttggctcacttcaacctgggctcctgggctcaagtgatcttcctgcctcagcccggcaagtagctgggactgcaagcatgcaccaccacagcccgctaatttttttgtattttttatagagactaggtttcgccttgttgcccaggctggacttgaactcctgagctcagctcaggagatctacctgccttggcctcccatagtgttaggattccaggccactgcgcccagccaagttctgttcattcttatgggaggctatataattttgtcagatactttatttcatgcctgagcaagaatgcttcctactcattggtcattagctctgcccatacatatatgttatttaattgaaccctcacagtaaccctgaaagtttagtagaattatttcccattttgaagactagttgaagcatggagtggtcactgaactaagttgtcatgtagtacagagacagcttgaccctagcacatattgtagttcaccaggatgactttgaagtttttctgaaatagaacaatatgatgtgttttgttgtgtagacaagctgaagtcccagttttctagttgttttctttgttttaaagcagagattctaggagctgtagggcaggcagctcttaagaaaattgggatgaaaaggattagcagttcttttacctgctttgtagattgagagccctgtaagattttgcctgacaaggggctcttatgcttctaaactggaaaaaaaaaaaaaaaaaaaaaaaattctaagagaataaccagtatttcagaacaaatgaaatttgactttttggagtttataatgtgtagctttttagaattcttcgtctttacccaacaaataatatggccatattattactacctctgtaagagagattatcactgaggtatctatagataccttgacagttttccaaatgcctatgtatgtagtatcacatgaccttacagtaaccctgtgtgttaaccagattgttttgttttataagtgagttaatttacatctcaaatacattaataactaataagcagcatacactcctaacaaaatgcatggcatgaaattaaccttttgccagttagcttcgatgagaaccatattgatcaagcatgcttaagttttgttatcttttattttttaaaggccgttttatagtttattctgataacttaaactttaatcattcatttatttgaagctattcatgtatttgatatattcatgtgccatactctaccttgttagtgtctgtcaataagtcgtaatttacttgaaattataagcccattttataataaggatttagtcttaatcaaagtcacaagtcattaaatagcatcagtgtttcattgcctttatcagtagtcactaatttcatcaccattttcttagtttaggccgtcatatatgaacagactttttttaaatttaggctttcatatatgaaaacacaggagaaaagtttgtatgtcgaattgtttacatctgttcaagaattagctgacaggtggatttttaggaagagctaatttaaatgtaaaaatctttccagtgacttcagcctgagataataactataatgataaaaataattacttgtactgacagtgtataccaaatattgttctaaacacttaatatgagttaccttatttaattctcacaaccctgtggaatattactttatcatctccattttacaagtgaaaaaacagggacatagcaatcatactacaactagtgcaagtcagagctgattttttaatctaggcattctggctctagctgatgcccttaaactctttgccatacttgccctcaaaaatcttcagaatataacaagaggaagagaattatttatttcatatatttaatgtatcagaacctattttatatatactttatacatattatttatttctcataaaatgtaaagtatttccatttgaagaatcagaaatggggaaactaaatgaggctccctaagttcacaaaactaataaaaatcagaatcaaaattaaggtagcagtctaaaaccaaagccagtattcttcaatattatgccgcctatctatagtagatagtcataagacatttattaaccagtatttatgtatgtcttatggtaagtgaaacatcttctgctctccagtcacaacctagttgaaaaaagtatacacatatattcaatgtagaatattttttcttaatttatttgactcaattgttttttatttttcatttaaagaaatttaatagcatagggggctttccagtgaaatttaatagcatagtggtcttccagtgaagaccagaaaacctgctagataaattctaagagagctgtaacactgactcagtagttgaaaagcatatatcttatgtatgcaagttatgaggcataatagtaaaatgaacatctgtgatgtaccactacccaatattagaactagaatatcactaatgtagctgcatctgtctgtgtgttttttctcatcttgtgtcaccctcatattggtaaccacctctctggattttttgttttattatccccctaactttttttaattataatagatttcattttttagatcagtattaggtttacagaaaaattgaatggaaggcatagagagtttccatatactctcttttccccaaaacacagttttccctgttattcacaaatgacattagtgtgatatatgttacagtgtatgaactaatattgatatattgtcatgcagagtctatagtttacattaaggttcattctttgagttgtatattctgtgggttttgacaagtgtataatgacatgtatctagttgtagaatcacatgctataatttttctgccctaaaaattccctgtgccacagctatttatcactcattcccttccagtgaacacctggcacccaccggtctttccactgttttgcgttttgcagagtgtcatatagttggaatcatatagtacgtagccttttcagattggcttctttcacttagcaatttttatttaagactccttcatgtctttttggcttgacagctcatttctttttattgctgaataatattctattttatggttttatccacttctttacccattcacctggtaaaggacattttgctttcttccaccttttggcacttatgaaaagaaactgttacaaacttttagatgtagattttgtgtggacataagttttcaactcataaataccaagtaacatgattactgtatcctatgttaagggtgtgtttgctaggccagtgtggtgactcacgcctgtaatatcaacactttaggaggctgaagtgggaggagtttgcgatcagccagggcaacatagttagaccttgtctttaaaaaaaaaaagaaagaaagaaaaaataagaaacaaagaaagaaagtaaaaagaaactgccaaactgtctttcatctggctgtacccattttgcatggcatccacaacaaatgagaattcctgttctccacatccctgctgacatttgctgttgtcagctctttggattttagcttttatttaaatagatgtgtagtgatatctcaatcattttaatttgcatttccctggtgacatatcatagtgagcatcctttcatagtcttattttccatttgtatatcttctttaatgagatgtttattcatatcttttgtccatattttaatcaggttgtttgatatcttactgttatgttttacataaacatagagatagaacagaccattgtctccttccttcctatctgtattccttcatatattttggataacagtcctttatcatttatatatgttgcagagattttctagtctgtagcttgtctttttcattctcttgacagtgtctttcacacagtagaagtttttaattttaatgaaattcaacttaataattttctttttcatggattgtacttgtggtattttatctaaaagtgcaccttcagacttagggtcaccaagatttttttcctgtgctattttctaggagatccatagttttgtgttttcctctgtagtccatttggtataaagactttgtctcaattgactgttctgcaggtggatatccagttgttccaatactattggggtaaagaccattatttctcctctgaattgtctttactcctttgttaaaagtcagttgactgtatttatgtgggatatttctgagtgttttattgtgtatcattgatgtatttgtcagttcttttgccaaaaccatgatgtattgattactgtagctttatagtatagtaagtcttgaagttgagtagtgtcagtcttccaactttgttctttttcttcattgctatcttggctattctgtgtctttgcatataaactatttctataaattttagaatcaatttgcctgtatctacaaaatagcctggtagaattttgattgaaattgtattgaatccatacatcaagttgagaagaactgacagcttgacaatattgagtcttcctatctatgaatgtgggatatgtatttaaatcttttgttaatcacagttttctactttttttcacgtagatctctatgtattttgttagaattatatgtatttcatttacattatgctaatataaatggtattctttttaactttcaaattccaagttttcattgctgatataaagaccattgacttttgcatattaatcttgcactctgaaagcctgccatgatcacttattccagtagagttttggttgattctttgggattttttataccaacaatcatgtcatctgctaacaaagacagttttatctctttcttccctatttatataactttaattttctttgaatttaatttatataactttgtcttattgcattagctaggacttcctgcataatgtcaggtaagagtactggcaagggatatcctttccttgctcccagtcttagtgtgaaaggatcttgtttctcactattatgtgttgtattaactgaatttttttaatacatgttctttatccagttgagggagttcttctttattcctaacttcctgagcatttttattagtgttggattttgactagtgcattttttgtatctgttgataagatcacatgatttttcttctttaccatgttgatgtaatagattacatcaattgattttcaaggctgtaccagtcttgcgtaggtgggataagttctacttcgtcgttgtatataattctgtacatttgtacattgctcaattcagtttgctagtgttttgttgagaatttttgcatatatgttaatgagagataattgcctgtagtttttctttcttgtaaagtttttatttctattagagtaatgctgtcctcacagaattagttaagaagtattccctccgcttctgttttctggaagagattgtggagagtttgtataatttcttcgtaaatgtttggtagtattcatcagtgagtctatctgggccttgtgctttctgttttaggaggttattaattattgattaattatttaaatacatatctttctttctttttttgagttggagttttgctatgttccctgggctggtcttgaactcataggctcaagtgatcctctcacctcagcctcctgagtagctgagataataggcatgcattatctgtttcttcttgtgtgacttttggtggtttgtgtctttcaaggaattggtttgctttatctagattatcaaattagtgagtgtacagtttatagtatttcttcattattcttttaatatccatgggatcagtaatgatggcccctcttcatttctgatatttattctctcactctcatctatcctggctagaggtagaggtttatcaattttattgaccttctgaaagattacaaaattggcttctggttccattgctgtttttctattgattttgtttttaatctattgatttctgctctaattttattttcctgtgcttcagatttaatttgattccatattctttcatctcttagcatctcagttatacttttttaaaaaacttttttaaatggttcctctagaatttgtaatacacattttttttagtatagtttacatggtgaaaccccgtctctacaaaaaatacaaaaattagccgtgcgtggtggcacacacctgtagtcccagcacacatctgtagtcccagctacttgggagactgaggcagaagaatcacttgaacccaggaggcagagattgcagtgagccgagattgtgccactgcactccagcctgagtgacagagggagactccgtctcaaaaaaaaaaaaaaaagaaaagaaaaaaaaaaggatatggggatatggctccctcccctcttccttcccttttttttccttttcccagtattgatgaaagacaggaagtgattttaaatgcagattttttcaaatcaaacttcactaatagaattaattctggatttttttttttttttttttaagacaggattttgctctgttgcccaggatggagtgcagtggcttgatcttggctcactgcagcctcaacctgctgggctcaggtgatccttccacgccaccaggcccggctaattttttgtatttttttgtagagacgagatttctccatgttgccccggctgttctcaaactggaatgttattttgaaagcagtagttttaatttgggcaaaatggggcaaagtttaacataattcaggtcttattttgtaataaagactgttaatatatgatgagatatagtagaacaacggcttatgtgacttcaaggatgctgttgtatgctctttttgtttgatacagaagctcagaattatatttccttctttaacatattttttgagaccaaagtaagtgtaagtggcattgattagatagtatttctttttctcttgcatttccatttactgagaaagtagtaaaaatggcacattgacatataactagcagatttttgttagtgtgcaagacattgaagaaagggagatttggggtttgttttggagtaatcttggggaaacactggaacgtccataaggtattgttctttatatctaagagatgaacgtgttcttaatcatgggattggcagcaactgtgaattttctctagtctctgtttttgttagtccatttgtaatagtgatgggtggatttacccctgcctttccattggtaattctgtagaagtaaaggcttaggaaaatactttctctttgtgagggtcctttgtcaaagactgaaaagactagagagtggcatttaattctgcagagtataggtcatggtacttagttcctatagataggagttagcagtatatccaaatactttattccttaagaaacgattttttagccagtgaatgcacttttaattggaaggtcttggttttctcaactgtttactcctaataattcagagcgtgataagggatattttggagaaatgtattcattttttatttaggtttaatcttttgggtaaagtaataaattgtatacatggagtatggtttaccaagggtttaaaattaatgtaagagtaattccagtttcctcatatatactgggaatatatagctcttttatccctttattttgagagaaggaagtatatttctgtactcaaattcaaatctcttttttctattaactcacagacttttttttttttcttacagttttctgtatcctcacccatcagggcatgagtaaatgtttaaggttaaggaagcagaaagtttttaagtcctagaaaaaaatataattgaaaaaaataaatttgaaagagtagatttgtgacatgaaagaaactatgactttatcaagtgttattaagataagcttagccttatggcgatttattgttctcttattagtaactcctactctcagcaatgctgatacaattaggttatgactgatctcttttgtaagcataatttaatttcacttccacccaggaagtgtttttcttatagtaaatgaaggagttttagaatatagatataagataattgttaactggagggatagaaggaaagcagagaattagataagttatttttgacaatccttgtctaggagactattggattgaaggccatgaaaaaagaaagaaaaatataattggccattaaatatttctagagacctgttttgctgggcatagaaaagcaagcccatgatgttttttatttttagtacctaatttttcttttatctttattgaaatcctattgttcttaattgaaagtccttcattatttttatctaatactgaaatataaaaattaaattcagaataatcaaaatgttaaaaatagttgagatgtcaaacctgaaatattctcattcaaaaataaaaaccaaaaattaataaggaggctctttggccattatcatttagtctccagggtaattggtgaaaagtaatcaagtaaaagtcatatgaataatagtagttctcattaatatgttctgggcactatactcagtccttaatatgcatttcctcagtaattcacataaaaccagatttgatatgcacttttactattttcattgttttataacaaaattgataggcaatggggaacccaggtttatctgacacccccccccatccgcccccagagctagagagaataacagcttctggtttctaagtacagagtcagctaacatattgtatgctttgttgcttcacaaaattcaatataataataatggccagaatggaaatctgtccagcctcttttccttttttctattctcatgtctttcagaactttcaacaagtttacatagcttttcatagttaccttaatgtttactggtagccagttccttttagttggctaaataaaaagcctttaaaacctaggttcaaaatctaaactctttatgagccagttggattaactcattttgtggtcagagcctctgtgcatttttgattgattacaagaggaactagtcatagctcaagagaatcgtcacatatttatcacaccattagcgttcactgtagtatggtaactgtttttagaattatgtcatgatctgaaaaagctgtaactattatgtcaacctgaggaaacttacctgtttttgtgggctttctgtaatagtgtttatctgtcatttatggctttcaaatttaatactgtgcaagagcctggtctaggcaattatagaagatagaaagttttcctttgaaagttaaaatgtaggaaagttgttaaattttagtcacaaataaatgatacagtaaaaaccataaagaaataaaacaggagagaggcaaaaagtggaaaaaaaaagtcatttaaagggctgaagcagacatacttagaaggtacttttgattagacatacttttgaaaatctaattttctactttctagagcttatttttcttattgccataggttttaaaatgtacttctatattgttttcttgctcttctctcctctgttgtttctgttatagatgggtatgtttgtcacctgtgcctagaagaaattcttccagcatggccattaggatataatgtttgagctcacctgatttggagggggtagttgaaactaccacttcctttgtaactgcaagaccgtttagttttcagacgttatctttaatgttagcaaagtatgtgttttatatagtgttttctgtataaaaaactataatttctatttactaagttgaatctatatggaatagtccataaaataaaccttacataccaactagttggatgtagtagtgaaaatcattcatggatatttcactctagtttgatatataaatctcttggattttcaacatagagtggggaagaaatcctaattacagttctcttcccattttaatttctcctcttttttttttttttttttttttttttgctgtttttctcaactgtcagtggaattattgtcttcctgtctccatatttaggtagtgtcagtggctgagtatcaccgcaggatcgatgctctaaatactgaagaactgcgcacactctgcagacgcctccaggtgcccccttcagtagtttaaacccctccagagactaaatactccctgtttttagtgttctttgtcatggcaaatctcatttgaagaatttgctttgactgcagcactaaaattaaattcctttttgtattaaaggttatagtattgccgtgaagagctgtggattatcttttctgtcatcttttcatttgaaaaatattctgaagaatgttctgtcacttcagaattattctcagtattgtgtgtttctttcagcgatgaggagttttcattcatttaacgttggaagaatggtgttggttttgagattgaatcttttctaaacaaaatctgaaagatatggtactataggaaaactaataaaaaatttaatagcaaggcttaaatattttatttaaggctatttcatttatatcagcgtcacatcaaatatctcaataggataaactgttcttgaggcattcttggttggtattaggagtacattggaatagtacagtttagacacagaactggataaattacttaaaattctgtgaaataatctttgtgattttttttttagaaacaagaaagcaatgtaattgaaaactcatttttaagttgtgtctattatactgtgtttctttcttcttaataagatatgctttcatggctctgctagacctgaattttttcttttaatgcttctaatgctgccttgggtttctttttctttttctttttacctttcacatcatcaaaataagggtgaaacatgatgatatgaaagaatgagtatttagcttcttgtcaaaaaacaatacacttatagaacatgtattggttgcaaatatatgctgctcaggtttgttaagaaacctgttaaaggaacaaaataatttagcaagaatttcattcccatatagaatcacagttgctgagcgttgctgcattttagttatctgctccaatagaattctgcatattttccaatttaaaagtttcataatgtttcatttcttttattttctaatattattatgttttatatattaaaataaaattaatattaaaaagtaagcaccaatagaatatattgtgcagtagtaagctttatttttacttagttaacattcttatcgttttaagaataccagtgaaatcatttccaccaagcaaaaaagcatgtattctttgtaatgcaacacattaatctaatttaaaaaataaatttatgaacaaattaacagtaaaatttattgtttggtccaagtagatgaaaaaaattaaatgtttagaaagttataaaaagaaagcatttaaaaaaatggtaacgtttgtcagtgaaacaaatacatgcacaactcacagaaaatagttatttttttttattctactattctttacattaaaattttggcacccaggaagttttgttcattatttttgacaaattttgtgttagcatgaaagaattctattttaaatagcatacacacacacacacacacacacacacacacacacacacacacacagcgcaagccagctagctgacttttgcccttcaagggcttaattaaagatgcatgcaactatcttctttacacagaaatatggggatttatcattcctaccagtcgttcctcatgtagtggatgagaaaacgtctgcttatattgttataaaatcttttcctacattggctacatcatagatattagatatgggccatcttttgccctataaaatcttaaggttaaagatttagccacattttctacgatataaagctttatttatctgaaaagtctgacaattttgaaagcatgtcacaagtttacattaatgcactacctctatttactgttttagattactacaagggaagacataaattcaaagcaggttgctacagtgaaagcagacctggagtctgaatcttttcgaccaaacctaagtgatcccagtgaacttttactgccagatcaaattgaaaaggtatgacatgctcacatatgtgcatttctgagtgtgagtgtgtacccatgagagtaaaacagcctctttttagttgtttctgaagcaacagcgttaatgctattactattccactccagtgaaaagaaagagtaagcaaaacatagcaactagtgttaattaagatgttaggagatttaggtaagcagacactaaaagccaatatttgttttattgttgtgtgcttgttacttgctttatgtggattatttcatgtagttgttacaacagctgtagaaattggatgctcttattatgcacattttttattaagttaaaaaatcgggagcacagagcgattaacttgttcaaggtcacacagggagaagtattaaagcttgattcctaacttggatagtctgtctccctagcctattatttaagagatattttaataatcaagctaatagtctatcaagtatttttgttaattcaatatggaaggcaaaagcattaagtaatctatgtttcttatctctgttctaatctgtgtctggttcagggtgattctttattttcctaatagacaattaatattttattctgagaaatgtgtaatacttttcaatcatcttagtatctttgagaataataatttctactgttaatttatttttatagcctatattatataggcaccattacattccagctggcattagtattctacataatgaacaacaagctatcaagtaaatactaacactttgttttctaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtatgaaacaccaactgcatagattgcttatcctttaagagcagtaacagtaacttttagcatatttatttgataaacattactttattagtgcattttattgtttaactgataattactgggtacttttaatatgcaaggcaatgttgagtattacagaggatagatatgagcatgatgattaagaattactgccttcaaagggattatagagtggtagaaaagaacatttgcacataccaacatctctaatggtggggaaaatggtaggtttcttagaacctagaaaaagtgaggaaataagaatgaggttcatgggaaaggtagaaattgacagaatcttgaataatgggtgaagttttgattaaagataattgtttgaaggtgatagccagaacaaaagcacaaataagagtaatattggtttgttcttcaaacagcaagttcaagtcagttgtaattggaaactaatgagaaggtaaaatagcaatattagaacaaaacactggtattactaacacttttagtgttttatgtgtcaggaacttgactaatcacttatgcattatgttatttaatcatgaaagccctatgagattgatactgttatctttatattaaagaatgagtcaactatgacataagctcatcaacttgcccaaggttacatacccaagaaaaagtatttgcaccaatgaaaatgaatgaactgctgctacatgccatggcataaatgaatgtcacaaacataatattgaattagaaatcaaacaccagagagtaactttcttatgatttcatttatagaaagttttatcagtgggccaaatgaatctatagtggtattaggctagtaactccttcaggtagttgagactattgatgagaggaagcacaaagagagcttctagaactagtagtgttctgtttcttggtctgaatgaatgttgcatgggactttgccatgtgatagttctaaactgagctatgtgtttatgttttgtgtacttttctataatgtatatgtaaaataacctttcaataaggaaatattttcaaaattaagactataaagatagaatgtcaggatagacagtgactgtacagattatctgtcagactctctgcactcccatttctgatgtggaaacttcagcccataacactgaaattacttggtcaatctcttattcatcaattttctcattagggtactgtgtgtcttgtataagatcatgcacagggttaaaggacaaaacaattcacacataacacctgccctcatggaatttactgtataatgataaagaaaaaatatcatattttaaaagtgatagaatgtttccctatactgaaggacttattttattaagcaccgcaatcccatagcatcatgttatccatatcatacatacattgtacatataagtcgtcctgaaatgtgttaaccactttttaagattgtctgcttaattactttaaataaaatcccaaaatttaaaaactaggaaaaaatctgtatttccattgaaaaaccaatatacttcatatttgacaataatgtaaattatatagcagctaaccatttttccctttttaagtatgattagattaaactataccagatttctattttttgcattttatttaaacatatatgatgaaataatgcttactggaataaatttgttagtcgtgtcattgaatatgccttttttatccttaggtttttggtgcgttagcatctgagccactgaaagtgagtgatggcttttatggtactggagagacctttgtttttacattctgtccggagtttgaggtaagaaccactatttcaatattttatttataaagagttgacataacatactgcccaaagcaatttatagattcagtgctattcccattaaactaccactgatattcttcacagaattaggaaaaactattttaaagttcatgtggaacccaaaaagagcccaaatagccaagagaatgctaagcataaagaacaaagctggaggcatcacgttacgtgacttcaaagtatactacaaggctacagtaaccaaaatagcatggtactggtataagaacagacacatagaccaatggaacagaatagagaactcagaaataagacctcacacctgtaaccatctgatctttgacaaacctgacaaaaataagcaatagggaaaggattccctatttaataaattgtgctgggagaactggctagctatgtgcagaaaattgaaactgaaccccttccgtaaaccatatacaaacattaactcaagatgggatagagacttaaatgtacaacccaaaattataaaaaccctagaagaaaatctaggcaataccatttaggacatagatacgggcaaagatttcatgacaacaatgccaaaagcagttgcaacagaagcaaaaattggcaaatgggatctaattaaagagcttctgtacagcaaaataaactatcatcagagtgaacagacagcctacagaataggagaaaatttttgcaatctatccatctgacaaaggtctaatatccagaatctacaaggaacttaagcaaatttgcaagaaaaaaaacaccattgaaaagtgggcaaagacacttttcaaaagaagacatacatgtggccaaaaaaacctgtgaaataaagctcaacatcactgatcattagagaaatgcatatcaaaaccacaatgaggtaccatctcactccagtcagaatggctattattaaaaagtcaaataacagatgctggcaaggttgcagagaaaaaggaatgttttattttgttgttgttgttgttgtttttgaggcagagtcttgctgtgtcgcccaggctggagtgcagtggcatgatctcagctcagtgcagcctttgccttccaggttcaagcaattctcctgcctcagcctcccaagtagctgggattacaggtgtacacaccatgcctggctaatttttgtatttttagtagagacggggttttgccatgttggccaggctggtctcgaactcctgacctcaggtgatccaccctcctcggcctcccagagtgctgggattacaggcgtgagccaccacgcccaactgaaaaaggaatgtttttaccctgttggtgggagtgtaaattagttcaactgttgtagaagacagtgtggcaattcctcaaagacctagaggcagaaataccacttgacccagcaaatcccattactgggtatttacccaaaggaatgtaagtcctcctaatataaagatacatgcacacaaatgttcattgtagcactattcacaatagcaaagacatggaatcaacctaaatgcccatcgatgatagactggataaagaaaatgtggtacatatacaccatggaatacaccatatacaccatgcaaactaatgcaggaacaggaaactaaacaccacatgttctcacttataagaaagagctgaatgatgagaacacatggacacatttcaggggaacaacacagaccttgtgtctgtcgcagggtgagggtgtggggagggagaggagagcatcagaaataatagctaatggatgctgggcttaatacctagttgatcggatgatctgtgcagcaaaccactgtggcacacgtttacctgtgtaacaaacctgtgcatcctgcacatgtactcctgaacttaaaagttaaaggaaaaaaaagagaaagagatggcataaatgaaaaaaccatgcactttggagtcatgcaagttgcatctgtcccctatctttgccttttactccctggtaacttttctttgaccattttgaacttcaactttcctgtagatagaatgaggaatcataaaatatggcatgatcatttaataattaaatgaggatcatttatatataatacttgggatggcaccaaacacaaattatggacttagtaaagaatatacattatcattactattctgtttacaaattgtcattgtgaaatttccagaaacatttaatgactaagcttaatgatgtaagtcatgaaagcataaaaaataaattatttggatttaaataacaagttattgactggtttctttttctttacctgtgtggctttactgtggcttgactaacacaaattgaatacattctcatgccaataaaatctaaaatgtaaaggtataaatgaattttagtgaatgtgtgactattcttaaaacattgagtgcaatattagtatctcgggcacattggagtgtggcatgtaaaaccttcattttaatctcaagaaaaggaatcaacaccattggttataaaaataaatgaagaaaataggaacgatttggtaacacaataaaaattcttttagcaaatttgtacttaactagctcaccagaataaccaatgcttttcattccttccataaaatatgtcaactgatagcaacagctacttgaaagcttgtagttattacagattttctaagcatcagtggtgcctattctcaaactttttatgttactgctacctgataagtgtaataatgtagtcaattaaatgttacataactatgaaaaacgagtgctaaaagaaagttttattgaaaactgtaatgaacacattttaaaaacttgataaaagtaagttgctagaaattgctactatgttaggtttaggtaaaacacccataaaaggttagaaaaagatatttaagaatattcatgtctagtttgctcttggatttctcaaatgattttaagttctcactgtttaaagaaattgaaactgaaaatcataaatacccattatggtcatggtttatttaagaactgtgatcagtaaatatatatgcaaagaaaaggccttggccctatgttaaaatattatccaattaacatacatttctgtttaatggtaaaagttaatggcatttgtgtccgattttttttcaactcatttacttctttctcaattttttctattaaccgtccaactcttggtgtctgtagagtcaggagaaagaagtatgtgtgaaaagttaacaaaattttgagaaattggaattgaaagttaagtgatagagtgtgtgctttcaaatttagtcatataaacactgaaacccaaaccaccagagccttctgtgcggagctttttgtggtgttcttattcttatactgccagtcttggctttgttaactcgtttgagttttggagaactaactctctataataaccatttcatctatatatttaaagctttttttaaatttatataggtctttaagtggacaggagataatatgttttttatcaaaggagacatggattcactagctttcggtggtggagggtaagtctcttgaacatttcactatgagatttttgaagaactttaaaaatgcatttggattatttataaattcagttgtctttagaaagtgttgacgttagaattcaaatttgtatattatgaaaaagagagtataatgtatttgcaagaagtagctcaagtgtagttattgaaactattgatggagtatttgtttcttcattttaaaatactgttcagtttattcactgtttattaagacccatctttttctttagagcacagtggctctttgataatataaagggaaatatctcagtacctttgaacttctctaatttttaaataactgtgatggaatattttatttctcccaatgcatagaacaagtccaattgttttcatgttattctactctggagaccatttggaatgatattttagacaataatggaaatggggtttttgcttgcttgttttttaacaattatgaatcagacaataatgtgattatcttggcattgcaagtactgtgaggagctttgttttttatttggtatcccagcctcctttaatctttgcattgttgggaggtaggctgctctggtcccacctagcctgggcttagcaagcaacaactccttcctttggtatttctgtctttcagtattagacatgggtatgctaaataattttcagacttgtaaaagtgttacattatttgtatcccacagttgaggatatataatgataatttattcagaccaccaaagaatattcatcatcccaggttattctattattaacaaattttcttacaacttctctgtaagtaggtgtttggaggatataagtagggtgattaaaaagtgatcatggttattgtagccttctctgttagttttagttgttgaactcagcatgtatttacatggtccaattataccttttggggggggtatcattcagccctcccctaaacagtagtcttacatgtgattctgttagctctccaacaggtccactcaatctagtggcttataatttcaagattttatgggtgctttaagtcttcaaaaatgtcatacacaatgccattagatgtctgctggaactagattttattgtacaacatgatttcaccaagctagagtaaccactgggttatttgataataaattaatataagttttcagtgtttaaaggagagtacagcttcagaaagcagaaactacagggagttgatattccagaattccaagggaaaagcaccccaaaagaaaaatgatgtagtggacttaatgtaggctttggagtccaatagacatgattcagattctcacttcaacatatgctgtatgtggtaccttgagcaaactccttaacaaatctaaactttccttagctataaattggagattaaaccagttttgtagagagattataaggaattcacaaggatataatttttgtgcaaatcctagtatagtatctggcatatagtaagtactcaacaactgatagccacctaaactgatagccacctttactcattttctttcatccaacatgatctgttcccttctgataccaggaagaattctgcctgcagtatcattggctgcatgagctataagacattaattaaagatttagaagactacttttattccttccacttccttagccattctcttttcagaaagtcgtatgaatcatctttgaaagcattgctcatataaaaatacactttctggctttctgggtgtttcacctgggacagatctgtaacctcttaaatacatttacttaaatatttggatatcacatacctttttgaaatgctgatgaaatgcagaggtacccattgtcctaaaatgaatatacaaataatccaattttatatgtgatattaagaaattgacaaaaatgttgaaagcttctactcagggcttcagaaaattcaggttaccttggaaaaaactattcatacttggtaataaaacttactgcagcatcagtgacattcatgaatcttgaaggtcaattttgaggtactacttagatgcagtcatctgagattacaactagatgtcttaatcttttattaaccctttcatatttagcagaaggtttttatgagcaagtctgaccctttcatattctcctttctaatagattggctatgatagtctattcgcgcttttaaggctcatggattcagatatctctttaaaggcatgttgttgccagtagagttagagtctctagaagtctattgtcataagaccataaactttttaattcaaatgcgtttctaatttatctctgtattttccagtgccagtgtctgaaacatgataaatgcacatttaaagttgaacaaattagacaaatatgaatttcaatttgaaccttaacaaatgatggcttcctcatgggacagggggcattttggggacgatatagttttgcagtgcttctgtatcacagactctggattgttatgattttcagggtgttcttgtatcttagcaaagtcccattttcatttatagaagaggttcatcagaacgtcatcactggttatcccattacagtttttttgtactgtcaactctcttcttgagtgacactggatgatctctttacctggtcattgtgaattactatactgatctgtcttttctgttttgttgtgaagtaccaactctttttttttttttttttttttttttttttttgagatggagtttcactcttgtcgcccaggctggagtgcaatggcacaatcttggctcactgtaacctctgcctcccaagttcaaatgattcccctgcctcagcctcccaagcagctggaattacaggcgcccaccaccacgcctagctaacttttgtattttttattagagacagggtttcgccatgttggccaggcaggtcgcaaactactgacctcaggggatccaccagcctcagcctcccaaagtgctgggattataggcgtgaggcactgcacccggccccaactcttaaaggaaccattctacatggtcactgtagccaccttctctacttagaaacacatctctatacttaaaatttgtatatgtaattaatatacattatatatttgatgctgttttttattacagagtataaataaatagttcctttcttttgttctaagatagtgttaaaaatagatcagttccaggccaggcacggtggctcacgcctgtaatcccagcactttgggaggctgaggcgggtggatcacaaggtcaggagatcgataccatcctggctaacacagtgaaatcccatctctactaaaaaacagaaaaaattagccgggcgtggtggcaggcacctgtagtcccagctatttgggaggctaaggcaggagaatggcgtgaacccaggaggcggagcttgcagtgcgccaagatcacgccactgcactccagctagggtgacagagcgagactctgtctcaaaaaaaaaaaaaaaaataggtcagttcctctcccacacaagtcagttaactctgtaatgccatgtgactcctgatggcaagcctgaaggtcagaggttatagccacccaaattatagagttgtgtaagtctttacaattacctaatatgcttttcttttttgtgtgttttaatataattgacaaactctaccccagagaggttaagtgacttaactaagtttgacataagttgtggccactgagttgacagacaagtcttgatcccagaccagtttttttctttcaatgaaatataactgcccatattttttaaaaaagcctccgcctcctaaactctggctcaattctgctgacttgatatattactttagatttagagaatcccaagggatagctctctggatattatgttaattaatagtctttgccccctctcctcttctattaggtaggaaaacattttctagagaatagaaagaagtcctctcataacctggtgttttcccctctcggttatgtattagataattagataaattggaccttataatctatctgttaagttcctgttatacctagattatatcttggttcttctgcttgaatctcaacatcacatatttgtccatttaaagtcctttcaaactgagctcttttgcaaacagcttcctatgcaggaaaccagagttatttactaggtccttaacatgaatccccaaattttattttagatgatactgaatttttgtgcctttgcgaaagtcatgttaaatatgttaaaaccataccgaaaagataaacacacacatacacaaaaaaaaaaccatactaaaaaaaatacccaaagaaaaactcataataccaggcaaaaaattacagcgtagtacctgtctcaaaagctaatcctatataaagttcattatagaggacactgttcctggtctgtatcataaataatttttttcttttcttttcttttcttttttttttttttttttgagacagagtttcactcttgtcgcgcaggctggagtgcaatggtgcaatcttggctcattgcaacctccgcctcctgggttcaagtgcttctcctgcctctgcctcccgagtagctgggattacaggcatgtgccaccgcgcctggctaattttttttgtattttttagtagagacagggtttctccatgttggtcaggctggtcttgaactcccgacctcaggtgatccgctggcctcggcctcccaaagtgctgggattacaggcatgagccaccacacccggcccataaataattttttaatggaataggagtaaaacaaaattgtgtcagtgtggaaaggagtagggaaggatttgagaaaattaataactttagggttgttaggtattcaaagtctcatttaaattgttttataacttaaggcataaatattaacagattattatttatgtattgcagaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtgtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttccccttcggtcttccacagcagtattattgtctttgtggagttgactaatgataatttaaaaatcctgtaatggatttctactaaaataaggtcatagtggcatataccaaataaaatcaaatacagaaatacaa

SEQ ID NO: 1465 - DNA, 26587 bp, Homo sapiens
aaatctttgtctctagcaaactgttttgtcactgtagtaaggctctagtgctggaaatttatctttgacagaggaagaatgcttttgaaaacagttcttacgtgattttatgtaacttaatttgccctggaaaggaaatgtctcgtctctggtatgggaaaaaagggagaagacatcaaccaattaatcataaatacactctggtaaatcttagtcaattattttaatttgtatatatactagtcttttcatggtgacattatgaaaaattatacaatttctgaaagtttaagcatagaggatatttatagaatacaaaattttatgattgtacaaagtaccttgaagttgtttctgttaattctgagtatcttcaaaaagggaaattaataagggactgtaattttgtttcatattaagtgttttgtatgttctacaccaacaggaagatatcaaatcttaattgttgccttaatgttttttattttagcttaactttttagaaaaatattcagaattttctcttgcttgaaaataaattgaatagaacagagtaaattaattattattgactggatctcaaaccagattcttttatgatattgtttacttaagggtataattttaagaatctgactaaaaggttttttaagctgttcaaaaagttttcaggcaatgctacctaatacaaatcttcaaacgatatcctagtaaggaaattcagtcaaccatactattgtaagaattttatttatttttctgtacgtgtacattgttataaaatgtattgtccattgctctttctgtggtaatttgggattatattttgcttatgaatgtttattttattttcacttaattgtagatgatttaaaatccaataaggactttggaagatgcccccaaagcagcttgccgcccttaaatgttaagtgtgtcaaaatattaaaattttaataggtgttatttttaattgtaatttcaaaattcatttatatgttacatcagcacagagggatttaggcacctgaaatgattgaatttttaaaatttgtgattagatttaccagataaatcagttaacaccgttgttttttttttaaaccaagaacaatgaagctattcatacattttttttatttgaagtttgaataatcatttattcttagtttgcaaagacttcaatacagtttattacaaatacaagcaaaataaattgtggttattctgaaatttataggtcaatctaattaatgtgcatcaaacacttacatttattacagtcaccacgtccaaggcctgttcattctttatttttatttttatttttgagacagggtctcactttgtcacccaggttggaatgcagtggcgggattttggctcacttcaacctgggctcctgggctcaagtgatcttcctgcctcagcccggcaagtagctgggactgcaagcatgcaccaccacagcccgctaatttttttgtattttttatagagactaggtttcgccttgttgcccaggctggacttgaactcctgagctcagctcaggagatctacctgccttggcctcccatagtgttaggattccaggccactgcgcccagccaagttctgttcattcttatgggaggctatataattttgtcagatactttatttcatgcctgagcaagaatgcttcctactcattggtcattagctctgcccatacatatatgttatttaattgaaccctcacagtaaccctgaaagtttagtagaattatttcccattttgaagactagttgaagcatggagtggtcactgaactaagttgtcatgtagtacagagacagcttgaccctagcacatattgtagttcaccaggatgactttgaagtttttctgaaatagaacaatatgatgtgttttgttgtgtagacaagctgaagtcccagttttctagttgttttctttgttttaaagcagagattctaggagctgtagggcaggcagctcttaagaaaattgggatgaaaaggattagcagttcttttacctgctttgtagattgagagccctgtaagattttgcctgacaaggggctcttatgcttctaaactggaaaaaaaaaaaaaaaaaaaaaaaattctaagagaataaccagtatttcagaacaaatgaaatttgactttttggagtttataatgtgtagctttttagaattcttcgtctttacccaacaaataatatggccatattattactacctctgtaagagagattatcactgaggtatctatagataccttgacagttttccaaatgcctatgtatgtagtatcacatgaccttacagtaaccctgtgtgttaaccagattgttttgttttataagtgagttaatttacatctcaaatacattaataactaataagcagcatacactcctaacaaaatgcatggcatgaaattaaccttttgccagttagcttcgatgagaaccatattgatcaagcatgcttaagttttgttatcttttattttttaaaggccgttttatagtttattctgataacttaaactttaatcattcatttatttgaagctattcatgtatttgatatattcatgtgccatactctaccttgttagtgtctgtcaataagtcgtaatttacttgaaattataagcccattttataataaggatttagtcttaatcaaagtcacaagtcattaaatagcatcagtgtttcattgcctttatcagtagtcactaatttcatcaccattttcttagtttaggccgtcatatatgaacagactttttttaaatttaggctttcatatatgaaaacacaggagaaaagtttgtatgtcgaattgtttacatctgttcaagaattagctgacaggtggatttttaggaagagctaatttaaatgtaaaaatctttccagtgacttcagcctgagataataactataatgataaaaataattacttgtactgacagtgtataccaaatattgttctaaacacttaatatgagttaccttatttaattctcacaaccctgtggaatattactttatcatctccattttacaagtgaaaaaacagggacatagcaatcatactacaactagtgcaagtcagagctgattttttaatctaggcattctggctctagctgatgcccttaaactctttgccatacttgccctcaaaaatcttcagaatataacaagaggaagagaattatttatttcatatatttaatgtatcagaacctattttatatatactttatacatattatttatttctcataaaatgtaaagtatttccatttgaagaatcagaaatggggaaactaaatgaggctccctaagttcacaaaactaataaaaatcagaatcaaaattaaggtagcagtctaaaaccaaagccagtattcttcaatattatgccgcctatctatagtagatagtcataagacatttattaaccagtatttatgtatgtcttatggtaagtgaaacatcttctgctctccagtcacaacctagttgaaaaaagtatacacatatattcaatgtagaatattttttcttaatttatttgactcaattgttttttatttttcatttaaagaaatttaatagcatagggggctttccagtgaaatttaatagcatagtggtcttccagtgaagaccagaaaacctgctagataaattctaagagagctgtaacactgactcagtagttgaaaagcatatatcttatgtatgcaagttatgaggcataatagtaaaatgaacatctgtgatgtaccactacccaatattagaactagaatatcactaatgtagctgcatctgtctgtgtgttttttctcatcttgtgtcaccctcatattggtaaccacctctctggattttttgttttattatccccctaactttttttaattataatagatttcattttttagatcagtattaggtttacagaaaaattgaatggaaggcatagagagtttccatatactctcttttccccaaaacacagttttccctgttattcacaaatgacattagtgtgatatatgttacagtgtatgaactaatattgatatattgtcatgcagagtctatagtttacattaaggttcattctttgagttgtatattctgtgggttttgacaagtgtataatgacatgtatctagttgtagaatcacatgctataatttttctgccctaaaaattccctgtgccacagctatttatcactcattcccttccagtgaacacctggcacccaccggtctttccactgttttgcgttttgcagagtgtcatatagttggaatcatatagtacgtagccttttcagattggcttctttcacttagcaatttttatttaagactccttcatgtctttttggcttgacagctcatttctttttattgctgaataatattctattttatggttttatccacttctttacccattcacctggtaaaggacattttgctttcttccaccttttggcacttatgaaaagaaactgttacaaacttttagatgtagattttgtgtggacataagttttcaactcataaataccaagtaacatgattactgtatcctatgttaagggtgtgtttgctaggccagtgtggtgactcacgcctgtaatatcaacactttaggaggctgaagtgggaggagtttgcgatcagccagggcaacatagttagaccttgtctttaaaaaaaaaaagaaagaaagaaaaaataagaaacaaagaaagaaagtaaaaagaaactgccaaactgtctttcatctggctgtacccattttgcatggcatccacaacaaatgagaattcctgttctccacatccctgctgacatttgctgttgtcagctctttggattttagcttttatttaaatagatgtgtagtgatatctcaatcattttaatttgcatttccctggtgacatatcatagtgagcatcctttcatagtcttattttccatttgtatatcttctttaatgagatgtttattcatatcttttgtccatattttaatcaggttgtttgatatcttactgttatgttttacataaacatagagatagaacagaccattgtctccttccttcctatctgtattccttcatatattttggataacagtcctttatcatttatatatgttgcagagattttctagtctgtagcttgtctttttcattctcttgacagtgtctttcacacagtagaagtttttaattttaatgaaattcaacttaataattttctttttcatggattgtacttgtggtattttatctaaaagtgcaccttcagacttagggtcaccaagatttttttcctgtgctattttctaggagatccatagttttgtgttttcctctgtagtccatttggtataaagactttgtctcaattgactgttctgcaggtggatatccagttgttccaatactattggggtaaagaccattatttctcctctgaattgtctttactcctttgttaaaagtcagttgactgtatttatgtgggatatttctgagtgttttattgtgtatcattgatgtatttgtcagttcttttgccaaaaccatgatgtattgattactgtagctttatagtatagtaagtcttgaagttgagtagtgtcagtcttccaactttgttctttttcttcattgctatcttggctattctgtgtctttgcatataaactatttctataaattttagaatcaatttgcctgtatctacaaaatagcctggtagaattttgattgaaattgtattgaatccatacatcaagttgagaagaactgacagcttgacaatattgagtcttcctatctatgaatgtgggatatgtatttaaatcttttgttaatcacagttttctactttttttcacgtagatctctatgtattttgttagaattatatgtatttcatttacattatgctaatataaatggtattctttttaactttcaaattccaagttttcattgctgatataaagaccattgacttttgcatattaatcttgcactctgaaagcctgccatgatcacttattccagtagagttttggttgattctttgggattttttataccaacaatcatgtcatctgctaacaaagacagttttatctctttcttccctatttatataactttaattttctttgaatttaatttatataactttgtcttattgcattagctaggacttcctgcataatgtcaggtaagagtactggcaagggatatcctttccttgctcccagtcttagtgtgaaaggatcttgtttctcactattatgtgttgtattaactgaatttttttaatacatgttctttatccagttgagggagttcttctttattcctaacttcctgagcatttttattagtgttggattttgactagtgcattttttgtatctgttgataagatcacatgatttttcttctttaccatgttgatgtaatagattacatcaattgattttcaaggctgtaccagtcttgcgtaggtgggataagttctacttcgtcgttgtatataattctgtacatttgtacattgctcaattcagtttgctagtgttttgttgagaatttttgcatatatgttaatgagagataattgcctgtagtttttctttcttgtaaagtttttatttctattagagtaatgctgtcctcacagaattagttaagaagtattccctccgcttctgttttctggaagagattgtggagagtttgtataatttcttcgtaaatgtttggtagtattcatcagtgagtctatctgggccttgtgctttctgttttaggaggttattaattattgattaattatttaaatacatatctttctttctttttttgagttggagttttgctatgttccctgggctggtcttgaactcataggctcaagtgatcctctcacctcagcctcctgagtagctgagataataggcatgcattatctgtttcttcttgtgtgacttttggtggtttgtgtctttcaaggaattggtttgctttatctagattatcaaattagtgagtgtacagtttatagtatttcttcattattcttttaatatccatgggatcagtaatgatggcccctcttcatttctgatatttattctctcactctcatctatcctggctagaggtagaggtttatcaattttattgaccttctgaaagattacaaaattggcttctggttccattgctgtttttctattgattttgtttttaatctattgatttctgctctaattttattttcctgtgcttcagatttaatttgattccatattctttcatctcttagcatctcagttatacttttttaaaaaacttttttaaatggttcctctagaatttgtaatacacattttttttagtatagtttacatggtgaaaccccgtctctacaaaaaatacaaaaattagccgtgcgtggtggcacacacctgtagtcccagcacacatctgtagtcccagctacttgggagactgaggcagaagaatcacttgaacccaggaggcagagattgcagtgagccgagattgtgccactgcactccagcctgagtgacagagggagactccgtctcaaaaaaaaaaaaaaaagaaaagaaaaaaaaaaggatatggggatatggctccctcccctcttccttcccttttttttccttttcccagtattgatgaaagacaggaagtgattttaaatgcagattttttcaaatcaaacttcactaatagaattaattctggatttttttttttttttttttaagacaggattttgctctgttgcccaggatggagtgcagtggcttgatcttggctcactgcagcctcaacctgctgggctcaggtgatccttccacgccaccaggcccggctaattttttgtatttttttgtagagacgagatttctccatgttgccccggctgttctcaaactggaatgttattttgaaagcagtagttttaatttgggcaaaatggggcaaagtttaacataattcaggtcttattttgtaataaagactgttaatatatgatgagatatagtagaacaacggcttatgtgacttcaaggatgctgttgtatgctctttttgtttgatacagaagctcagaattatatttccttctttaacatattttttgagaccaaagtaagtgtaagtggcattgattagatagtatttctttttctcttgcatttccatttactgagaaagtagtaaaaatggcacattgacatataactagcagatttttgttagtgtgcaagacattgaagaaagggagatttggggtttgttttggagtaatcttggggaaacactggaacgtccataaggtattgttctttatatctaagagatgaacgtgttcttaatcatgggattggcagcaactgtgaattttctctagtctctgtttttgttagtccatttgtaatagtgatgggtggatttacccctgcctttccattggtaattctgtagaagtaaaggcttaggaaaatactttctctttgtgagggtcctttgtcaaagactgaaaagactagagagtggcatttaattctgcagagtataggtcatggtacttagttcctatagataggagttagcagtatatccaaatactttattccttaagaaacgattttttagccagtgaatgcacttttaattggaaggtcttggttttctcaactgtttactcctaataattcagagcgtgataagggatattttggagaaatgtattcattttttatttaggtttaatcttttgggtaaagtaataaattgtatacatggagtatggtttaccaagggtttaaaattaatgtaagagtaattccagtttcctcatatatactgggaatatatagctcttttatccctttattttgagagaaggaagtatatttctgtactcaaattcaaatctcttttttctattaactcacagacttttttttttttcttacagttttctgtatcctcacccatcagggcatgagtaaatgtttaaggttaaggaagcagaaagtttttaagtcctagaaaaaaatataattgaaaaaaataaatttgaaagagtagatttgtgacatgaaagaaactatgactttatcaagtgttattaagataagcttagccttatggcgatttattgttctcttattagtaactcctactctcagcaatgctgatacaattaggttatgactgatctcttttgtaagcataatttaatttcacttccacccaggaagtgtttttcttatagtaaatgaaggagttttagaatatagatataagataattgttaactggagggatagaaggaaagcagagaattagataagttatttttgacaatccttgtctaggagactattggattgaaggccatgaaaaaagaaagaaaaatataattggccattaaatatttctagagacctgttttgctgggcatagaaaagcaagcccatgatgttttttatttttagtacctaatttttcttttatctttattgaaatcctattgttcttaattgaaagtccttcattatttttatctaatactgaaatataaaaattaaattcagaataatcaaaatgttaaaaatagttgagatgtcaaacctgaaatattctcattcaaaaataaaaaccaaaaattaataaggaggctctttggccattatcatttagtctccagggtaattggtgaaaagtaatcaagtaaaagtcatatgaataatagtagttctcattaatatgttctgggcactatactcagtccttaatatgcatttcctcagtaattcacataaaaccagatttgatatgcacttttactattttcattgttttataacaaaattgataggcaatggggaacccaggtttatctgacacccccccccatccgcccccagagctagagagaataacagcttctggtttctaagtacagagtcagctaacatattgtatgctttgttgcttcacaaaattcaatataataataatggccagaatggaaatctgtccagcctcttttccttttttctattctcatgtctttcagaactttcaacaagtttacatagcttttcatagttaccttaatgtttactggtagccagttccttttagttggctaaataaaaagcctttaaaacctaggttcaaaatctaaactctttatgagccagttggattaactcattttgtggtcagagcctctgtgcatttttgattgattacaagaggaactagtcatagctcaagagaatcgtcacatatttatcacaccattagcgttcactgtagtatggtaactgtttttagaattatgtcatgatctgaaaaagctgtaactattatgtcaacctgaggaaacttacctgtttttgtgggctttctgtaatagtgtttatctgtcatttatggctttcaaatttaatactgtgcaagagcctggtctaggcaattatagaagatagaaagttttcctttgaaagttaaaatgtaggaaagttgttaaattttagtcacaaataaatgatacagtaaaaaccataaagaaataaaacaggagagaggcaaaaagtggaaaaaaaaagtcatttaaagggctgaagcagacatacttagaaggtacttttgattagacatacttttgaaaatctaattttctactttctagagcttatttttcttattgccataggttttaaaatgtacttctatattgttttcttgctcttctctcctctgttgtttctgttatagatgggtatgtttgtcacctgtgcctagaagaaattcttccagcatggccattaggatataatgtttgagctcacctgatttggagggggtagttgaaactaccacttcctttgtaactgcaagaccgtttagttttcagacgttatctttaatgttagcaaagtatgtgttttatatagtgttttctgtataaaaaactataatttctatttactaagttgaatctatatggaatagtccataaaataaaccttacataccaactagttggatgtagtagtgaaaatcattcatggatatttcactctagtttgatatataaatctcttggattttcaacatagagtggggaagaaatcctaattacagttctcttcccattttaatttctcctcttttttttttttttttttttttttttgctgtttttctcaactgtcagtggaattattgtcttcctgtctccatatttaggtagtgtcagtggctgagtatcaccgcaggatcgatgctctaaatactgaagaactgcgcacactctgcagacgcctccaggtgcccccttcagtagtttaaacccctccagagactaaatactccctgtttttagtgttctttgtcatggcaaatctcatttgaagaatttgctttgactgcagcactaaaattaaattcctttttgtattaaaggttatagtattgccgtgaagagctgtggattatcttttctgtcatcttttcatttgaaaaatattctgaagaatgttctgtcacttcagaattattctcagtattgtgtgtttctttcagcgatgaggagttttcattcatttaacgttggaagaatggtgttggttttgagattgaatcttttctaaacaaaatctgaaagatatggtactataggaaaactaataaaaaatttaatagcaaggcttaaatattttatttaaggctatttcatttatatcagcgtcacatcaaatatctcaataggataaactgttcttgaggcattcttggttggtattaggagtacattggaatagtacagtttagacacagaactggataaattacttaaaattctgtgaaataatctttgtgattttttttttagaaacaagaaagcaatgtaattgaaaactcatttttaagttgtgtctattatactgtgtttctttcttcttaataagatatgctttcatggctctgctagacctgaattttttcttttaatgcttctaatgctgccttgggtttctttttctttttctttttacctttcacatcatcaaaataagggtgaaacatgatgatatgaaagaatgagtatttagcttcttgtcaaaaaacaatacacttatagaacatgtattggttgcaaatatatgctgctcaggtttgttaagaaacctgttaaaggaacaaaataatttagcaagaatttcattcccatatagaatcacagttgctgagcgttgctgcattttagttatctgctccaatagaattctgcatattttccaatttaaaagtttcataatgtttcatttcttttattttctaatattattatgttttatatattaaaataaaattaatattaaaaagtaagcaccaatagaatatattgtgcagtagtaagctttatttttacttagttaacattcttatcgttttaagaataccagtgaaatcatttccaccaagcaaaaaagcatgtattctttgtaatgcaacacattaatctaatttaaaaaataaatttatgaacaaattaacagtaaaatttattgtttggtccaagtagatgaaaaaaattaaatgtttagaaagttataaaaagaaagcatttaaaaaaatggtaacgtttgtcagtgaaacaaatacatgcacaactcacagaaaatagttatttttttttattctactattctttacattaaaattttggcacccaggaagttttgttcattatttttgacaaattttgtgttagcatgaaagaattctattttaaatagcatacacacacacacacacacacacacacacacacacacacacacacagcgcaagccagctagctgacttttgcccttcaagggcttaattaaagatgcatgcaactatcttctttacacagaaatatggggatttatcattcctaccagtcgttcctcatgtagtggatgagaaaacgtctgcttatattgttataaaatcttttcctacattggctacatcatagatattagatatgggccatcttttgccctataaaatcttaaggttaaagatttagccacattttctacgatataaagctttatttatctgaaaagtctgacaattttgaaagcatgtcacaagtttacattaatgcactacctctatttactgttttagattactacaagggaagacataaattcaaagcaggttgctacagtgaaagcagacctggagtctgaatcttttcgaccaaacctaagtgatcccagtgaacttttactgccagatcaaattgaaaaggtatgacatgctcacatatgtgcatttctgagtgtgagtgtgtacccatgagagtaaaacagcctctttttagttgtttctgaagcaacagcgttaatgctattactattccactccagtgaaaagaaagagtaagcaaaacatagcaactagtgttaattaagatgttaggagatttaggtaagcagacactaaaagccaatatttgttttattgttgtgtgcttgttacttgctttatgtggattatttcatgtagttgttacaacagctgtagaaattggatgctcttattatgcacattttttattaagttaaaaaatcgggagcacagagcgattaacttgttcaaggtcacacagggagaagtattaaagcttgattcctaacttggatagtctgtctccctagcctattatttaagagatattttaataatcaagctaatagtctatcaagtatttttgttaattcaatatggaaggcaaaagcattaagtaatctatgtttcttatctctgttctaatctgtgtctggttcagggtgattctttattttcctaatagacaattaatattttattctgagaaatgtgtaatacttttcaatcatcttagtatctttgagaataataatttctactgttaatttatttttatagcctatattatataggcaccattacattccagctggcattagtattctacataatgaacaacaagctatcaagtaaatactaacactttgttttctaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtatgaaacaccaactgcatagattgcttatcctttaagagcagtaacagtaacttttagcatatttatttgataaacattactttattagtgcattttattgtttaactgataattactgggtacttttaatatgcaaggcaatgttgagtattacagaggatagatatgagcatgatgattaagaattactgccttcaaagggattatagagtggtagaaaagaacatttgcacataccaacatctctaatggtggggaaaatggtaggtttcttagaacctagaaaaagtgaggaaataagaatgaggttcatgggaaaggtagaaattgacagaatcttgaataatgggtgaagttttgattaaagataattgtttgaaggtgatagccagaacaaaagcacaaataagagtaatattggtttgttcttcaaacagcaagttcaagtcagttgtaattggaaactaatgagaaggtaaaatagcaatattagaacaaaacactggtattactaacacttttagtgttttatgtgtcaggaacttgactaatcacttatgcattatgttatttaatcatgaaagccctatgagattgatactgttatctttatattaaagaatgagtcaactatgacataagctcatcaacttgcccaaggttacatacccaagaaaaagtatttgcaccaatgaaaatgaatgaactgctgctacatgccatggcataaatgaatgtcacaaacataatattgaattagaaatcaaacaccagagagtaactttcttatgatttcatttatagaaagttttatcagtgggccaaatgaatctatagtggtattaggctagtaactccttcaggtagttgagactattgatgagaggaagcacaaagagagcttctagaactagtagtgttctgtttcttggtctgaatgaatgttgcatgggactttgccatgtgatagttctaaactgagctatgtgtttatgttttgtgtacttttctataatgtatatgtaaaataacctttcaataaggaaatattttcaaaattaagactataaagatagaatgtcaggatagacagtgactgtacagattatctgtcagactctctgcactcccatttctgatgtggaaacttcagcccataacactgaaattacttggtcaatctcttattcatcaattttctcattagggtactgtgtgtcttgtataagatcatgcacagggttaaaggacaaaacaattcacacataacacctgccctcatggaatttactgtataatgataaagaaaaaatatcatattttaaaagtgatagaatgtttccctatactgaaggacttattttattaagcaccgcaatcccatagcatcatgttatccatatcatacatacattgtacatataagtcgtcctgaaatgtgttaaccactttttaagattgtctgcttaattactttaaataaaatcccaaaatttaaaaactaggaaaaaatctgtatttccattgaaaaaccaatatacttcatatttgacaataatgtaaattatatagcagctaaccatttttccctttttaagtatgattagattaaactataccagatttctattttttgcattttatttaaacatatatgatgaaataatgcttactggaataaatttgttagtcgtgtcattgaatatgccttttttatccttaggtttttggtgcgttagcatctgagccactgaaagtgagtgatggcttttatggtactggagagacctttgtttttacattctgtccggagtttgaggtaagaaccactatttcaatattttatttataaagagttgacataacatactgcccaaagcaatttatagattcagtgctattcccattaaactaccactgatattcttcacagaattaggaaaaactattttaaagttcatgtggaacccaaaaagagcccaaatagccaagagaatgctaagcataaagaacaaagctggaggcatcacgttacgtgacttcaaagtatactacaaggctacagtaaccaaaatagcatggtactggtataagaacagacacatagaccaatggaacagaatagagaactcagaaataagacctcacacctgtaaccatctgatctttgacaaacctgacaaaaataagcaatagggaaaggattccctatttaataaattgtgctgggagaactggctagctatgtgcagaaaattgaaactgaaccccttccgtaaaccatatacaaacattaactcaagatgggatagagacttaaatgtacaacccaaaattataaaaaccctagaagaaaatctaggcaataccatttaggacatagatacgggcaaagatttcatgacaacaatgccaaaagcagttgcaacagaagcaaaaattggcaaatgggatctaattaaagagcttctgtacagcaaaataaactatcatcagagtgaacagacagcctacagaataggagaaaatttttgcaatctatccatctgacaaaggtctaatatccagaatctacaaggaacttaagcaaatttgcaagaaaaaaaacaccattgaaaagtgggcaaagacacttttcaaaagaagacatacatgtggccaaaaaaacctgtgaaataaagctcaacatcactgatcattagagaaatgcatatcaaaaccacaatgaggtaccatctcactccagtcagaatggctattattaaaaagtcaaataacagatgctggcaaggttgcagagaaaaaggaatgttttattttgttgttgttgttgttgtttttgaggcagagtcttgctgtgtcgcccaggctggagtgcagtggcatgatctcagctcagtgcagcctttgccttccaggttcaagcaattctcctgcctcagcctcccaagtagctgggattacaggtgtacacaccatgcctggctaatttttgtatttttagtagagacggggttttgccatgttggccaggctggtctcgaactcctgacctcaggtgatccaccctcctcggcctcccagagtgctgggattacaggcgtgagccaccacgcccaactgaaaaaggaatgtttttaccctgttggtgggagtgtaaattagttcaactgttgtagaagacagtgtggcaattcctcaaagacctagaggcagaaataccacttgacccagcaaatcccattactgggtatttacccaaaggaatgtaagtcctcctaatataaagatacatgcacacaaatgttcattgtagcactattcacaatagcaaagacatggaatcaacctaaatgcccatcgatgatagactggataaagaaaatgtggtacatatacaccatggaatacaccatatacaccatgcaaactaatgcaggaacaggaaactaaacaccacatgttctcacttataagaaagagctgaatgatgagaacacatggacacatttcaggggaacaacacagaccttgtgtctgtcgcagggtgagggtgtggggagggagaggagagcatcagaaataatagctaatggatgctgggcttaatacctagttgatcggatgatctgtgcagcaaaccactgtggcacacgtttacctgtgtaacaaacctgtgcatcctgcacatgtactcctgaacttaaaagttaaaggaaaaaaaagagaaagagatggcataaatgaaaaaaccatgcactttggagtcatgcaagttgcatctgtcccctatctttgccttttactccctggtaacttttctttgaccattttgaacttcaactttcctgtagatagaatgaggaatcataaaatatggcatgatcatttaataattaaatgaggatcatttatatataatacttgggatggcaccaaacacaaattatggacttagtaaagaatatacattatcattactattctgtttacaaattgtcattgtgaaatttccagaaacatttaatgactaagcttaatgatgtaagtcatgaaagcataaaaaataaattatttggatttaaataacaagttattgactggtttctttttctttacctgtgtggctttactgtggcttgactaacacaaattgaatacattctcatgccaataaaatctaaaatgtaaaggtataaatgaattttagtgaatgtgtgactattcttaaaacattgagtgcaatattagtatctcgggcacattggagtgtggcatgtaaaaccttcattttaatctcaagaaaaggaatcaacaccattggttataaaaataaatgaagaaaataggaacgatttggtaacacaataaaaattcttttagcaaatttgtacttaactagctcaccagaataaccaatgcttttcattccttccataaaatatgtcaactgatagcaacagctacttgaaagcttgtagttattacagattttctaagcatcagtggtgcctattctcaaactttttatgttactgctacctgataagtgtaataatgtagtcaattaaatgttacataactatgaaaaacgagtgctaaaagaaagttttattgaaaactgtaatgaacacattttaaaaacttgataaaagtaagttgctagaaattgctactatgttaggtttaggtaaaacacccataaaaggttagaaaaagatatttaagaatattcatgtctagtttgctcttggatttctcaaatgattttaagttctcactgtttaaagaaattgaaactgaaaatcataaatacccattatggtcatggtttatttaagaactgtgatcagtaaatatatatgcaaagaaaaggccttggccctatgttaaaatattatccaattaacatacatttctgtttaatggtaaaagttaatggcatttgtgtccgattttttttcaactcatttacttctttctcaattttttctattaaccgtccaactcttggtgtctgtagagtcaggagaaagaagtatgtgtgaaaagttaacaaaattttgagaaattggaattgaaagttaagtgatagagtgtgtgctttcaaatttagtcatataaacactgaaacccaaaccaccagagccttctgtgcggagctttttgtggtgttcttattcttatactgccagtcttggctttgttaactcgtttgagttttggagaactaactctctataataaccatttcatctatatatttaaagctttttttaaatttatataggtctttaagtggacaggagataatatgttttttatcaaaggagacatggattcactagctttcggtggtggagggtaagtctcttgaacatttcactatgagatttttgaagaactttaaaaatgcatttggattatttataaattcagttgtctttagaaagtgttgacgttagaattcaaatttgtatattatgaaaaagagagtataatgtatttgcaagaagtagctcaagtgtagttattgaaactattgatggagtatttgtttcttcattttaaaatactgttcagtttattcactgtttattaagacccatctttttctttagagcacagtggctctttgataatataaagggaaatatctcagtacctttgaacttctctaatttttaaataactgtgatggaatattttatttctcccaatgcatagaacaagtccaattgttttcatgttattctactctggagaccatttggaatgatattttagacaataatggaaatggggtttttgcttgcttgttttttaacaattatgaatcagacaataatgtgattatcttggcattgcaagtactgtgaggagctttgttttttatttggtatcccagcctcctttaatctttgcattgttgggaggtaggctgctctggtcccacctagcctgggcttagcaagcaacaactccttcctttggtatttctgtctttcagtattagacatgggtatgctaaataattttcagacttgtaaaagtgttacattatttgtatcccacagttgaggatatataatgataatttattcagaccaccaaagaatattcatcatcccaggttattctattattaacaaattttcttacaacttctctgtaagtaggtgtttggaggatataagtagggtgattaaaaagtgatcatggttattgtagccttctctgttagttttagttgttgaactcagcatgtatttacatggtccaattataccttttggggggggtatcattcagccctcccctaaacagtagtcttacatgtgattctgttagctctccaacaggtccactcaatctagtggcttataatttcaagattttatgggtgctttaagtcttcaaaaatgtcatacacaatgccattagatgtctgctggaactagattttattgtacaacatgatttcaccaagctagagtaaccactgggttatttgataataaattaatataagttttcagtgtttaaaggagagtacagcttcagaaagcagaaactacagggagttgatattccagaattccaagggaaaagcaccccaaaagaaaaatgatgtagtggacttaatgtaggctttggagtccaatagacatgattcagattctcacttcaacatatgctgtatgtggtaccttgagcaaactccttaacaaatctaaactttccttagctataaattggagattaaaccagttttgtagagagattataaggaattcacaaggatataatttttgtgcaaatcctagtatagtatctggcatatagtaagtactcaacaactgatagccacctaaactgatagccacctttactcattttctttcatccaacatgatctgttcccttctgataccaggaagaattctgcctgcagtatcattggctgcatgagctataagacattaattaaagatttagaagactacttttattccttccacttccttagccattctcttttcagaaagtcgtatgaatcatctttgaaagcattgctcatataaaaatacactttctggctttctgggtgtttcacctgggacagatctgtaacctcttaaatacatttacttaaatatttggatatcacatacctttttgaaatgctgatgaaatgcagaggtacccattgtcctaaaatgaatatacaaataatccaattttatatgtgatattaagaaattgacaaaaatgttgaaagcttctactcagggcttcagaaaattcaggttaccttggaaaaaactattcatacttggtaataaaacttactgcagcatcagtgacattcatgaatcttgaaggtcaattttgaggtactacttagatgcagtcatctgagattacaactagatgtcttaatcttttattaaccctttcatatttagcagaaggtttttatgagcaagtctgaccctttcatattctcctttctaatagattggctatgatagtctattcgcgcttttaaggctcatggattcagatatctctttaaaggcatgttgttgccagtagagttagagtctctagaagtctattgtcataagaccataaactttttaattcaaatgcgtttctaatttatctctgtattttccagtgccagtgtctgaaacatgataaatgcacatttaaagttgaacaaattagacaaatatgaatttcaatttgaaccttaacaaatgatggcttcctcatgggacagggggcattttggggacgatatagttttgcagtgcttctgtatcacagactctggattgttatgattttcagggtgttcttgtatcttagcaaagtcccattttcatttatagaagaggttcatcagaacgtcatcactggttatcccattacagtttttttgtactgtcaactctcttcttgagtgacactggatgatctctttacctggtcattgtgaattactatactgatctgtcttttctgttttgttgtgaagtaccaactctttttttttttttttttttttttttttttttgagatggagtttcactcttgtcgcccaggctggagtgcaatggcacaatcttggctcactgtaacctctgcctcccaagttcaaatgattcccctgcctcagcctcccaagcagctggaattacaggcgcccaccaccacgcctagctaacttttgtattttttattagagacagggtttcgccatgttggccaggcaggtcgcaaactactgacctcaggggatccaccagcctcagcctcccaaagtgctgggattataggcgtgaggcactgcacccggccccaactcttaaaggaaccattctacatggtcactgtagccaccttctctacttagaaacacatctctatacttaaaatttgtatatgtaattaatatacattatatatttgatgctgttttttattacagagtataaataaatagttcctttcttttgttctaagatagtgttaaaaatagatcagttccaggccaggcacggtggctcacgcctgtaatcccagcactttgggaggctgaggcgggtggatcacaaggtcaggagatcgataccatcctggctaacacagtgaaatcccatctctactaaaaaacagaaaaaattagccgggcgtggtggcaggcacctgtagtcccagctatttgggaggctaaggcaggagaatggcgtgaacccaggaggcggagcttgcagtgcgccaagatcacgccactgcactccagctagggtgacagagcgagactctgtctcaaaaaaaaaaaaaaaaataggtcagttcctctcccacacaagtcagttaactctgtaatgccatgtgactcctgatggcaagcctgaaggtcagaggttatagccacccaaattatagagttgtgtaagtctttacaattacctaatatgcttttcttttttgtgtgttttaatataattgacaaactctaccccagagaggttaagtgacttaactaagtttgacataagttgtggccactgagttgacagacaagtcttgatcccagaccagtttttttctttcaatgaaatataactgcccatattttttaaaaaagcctccgcctcctaaactctggctcaattctgctgacttgatatattactttagatttagagaatcccaagggatagctctctggatattatgttaattaatagtctttgccccctctcctcttctattaggtaggaaaacattttctagagaatagaaagaagtcctctcataacctggtgttttcccctctcggttatgtattagataattagataaattggaccttataatctatctgttaagttcctgttatacctagattatatcttggttcttctgcttgaatctcaacatcacatatttgtccatttaaagtcctttcaaactgagctcttttgcaaacagcttcctatgcaggaaaccagagttatttactaggtccttaacatgaatccccaaattttattttagatgatactgaatttttgtgcctttgcgaaagtcatgttaaatatgttaaaaccataccgaaaagataaacacacacatacacaaaaaaaaaaccatactaaaaaaaatacccaaagaaaaactcataataccaggcaaaaaattacagcgtagtacctgtctcaaaagctaatcctatataaagttcattatagaggacactgttcctggtctgtatcataaataatttttttcttttcttttcttttcttttttttttttttttttgagacagagtttcactcttgtcgcgcaggctggagtgcaatggtgcaatcttggctcattgcaacctccgcctcctgggttcaagtgcttctcctgcctctgcctcccgagtagctgggattacaggcatgtgccaccgcgcctggctaattttttttgtattttttagtagagacagggtttctccatgttggtcaggctggtcttgaactcccgacctcaggtgatccgctggcctcggcctcccaaagtgctgggattacaggcatgagccaccacacccggcccataaataattttttaatggaataggagtaaaacaaaattgtgtcagtgtggaaaggagtagggaaggatttgagaaaattaataactttagggttgttaggtattcaaagtctcatttaaattgttttataacttaaggcataaatattaacagattattatttatgtattgcagaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtgtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttccccttcggtcttccacagcagtattattgtctttgtggagttgactaatgataatttaaaaatcctgtaatggatttctactaaaataaggtcatagtggcatataccaaataaaatcaaatacagaaatacaa

SEQ ID NO: 1466 - DNA, 26587 bp, Homo sapiens; identical to SEQ ID NO: 1465

SEQ ID NO: 1467 - DNA, 482516 bp, Homo sapiens; identical to SEQ ID NO: 1464

SEQ ID NO: 1468 - DNA, 94886 bp, Homo sapiens
atggtccgtccccgggcagagagagggacgccccctcctcctccccgcctcttgtgaggcgcgcggagccgcctcccctgggtcaggtctgatgggccggtgggcgcgctagtggtggccgccaccgccgaaaccgtcgacctcctgggccccagttccgcgtccagccccgcggcagcatggactacctgacgacgttcaccgagaagagtgggcgccttctgcggggcacggccaaccgcctgttggggttcgggggcggcggcgaagcccggcaggtgcgcttcgaagattacctgagggagccagcccagggggacctcgggtgcgggtccccgccccaccggcccccggcgccgtccagcccggagggacctggtgagcccacctttctttcgcctcccgcgcggccgacctgggctgagggctgtggggaggcggcggtcgtggcgccgggcgggggtcgctgcccggctctggcaggtgtgcctgggccggggcgggcaacgtggccggggtggcggccgccgggggcgaggaaggaaggactcgttcggctctggggagggaagactttcagctgcgtgccagctcttcctgctctgctcttcctgctttcctcacctagacttgattttctttccccgccaagtatttcaaggggacgatccattctctctttccctcccactgggaggtgaagactgaaccagttatgacgtccgtgttttcagtcttggattcttgaagagcgctgtgcctgctttggttttggtttgggtcagtctttccttaatatttctcagttgttaggattcacttcctaaccgaaaaataaaaagccagatacttctttgtaaaataaaacacttcattaacattggaagctagttgacattttgcgtcgtgtactttttgaacggctgcacgttgtcttgtggtggcagaacctagaaactttctcagttcctgtttattttgtgttgtgttggccgatttttttcaccacagtggctttgtaccattctttaaaacagtcatttgtagcgacatgatattgataacttaaagaatttttgaaagtgctgctgaacagttttagcataatgcatagggtaacttccagtgtccttggcttcgtttaacaggtagcagacatcctagccatgtctgatttttatttttgttaattgctttaatatttgagggttatgaaaataaatgagcattagagagtttagaaaatagagataggcacaaagtgtgtaaaatctgtttataactccacatcgtgccagtcattttattttaaattttatcttactttatttttgtagagatggagtctcgctgtgttgcccaggctggtcttaactcttggcctcaagtgatcctcctgcctaggccttcccaagtgctgggattacaggcctgaaccaccatgctgggccctgccagttgttttaaagcagtaaaacagtgaggacatttttgatctatgtgtgtaggtatgtaatttaagctttgaagaaatattaaagtctcattttagcatagccctttaaaataaattttccttactttacataaaatattttttatctttagaaatgctgtttatggaattaggaaatgaaaaggggaggggaatacttttgtttctgctctgaaggacgttaaccaaatgcagaatcctcttaaaggtgggaccaggcataggaaagggactttaaagtgttcaaatcaaggactttttaaaatgagttttcagtagcctaattgaaaacagttgatgtgtgaccagccttgaaatgggtggagaattcagaaatatgtggggtaacttaactaaaaaggaatatggttagtattttaataaatatggccaaacacgtgtatctgattcattcggtggcccgtgtctgtagttccagctactctgctcaggaggctggggcgggaagatcctttgagcccaggaggagaatccagactgggcagcagagagacacttatgtgtttatatatgtggagcacacagctatatctgacaccctccttcaaagtggcgcttctgaagtgatatgtattcctcttctgttgaagctgccttatgtattcattgcatattctttaatagtcatggtgcccccaaatctctgacacattagagaggcgttgtgaggtcaaagtatgaccacagtcatgtgggcaggtacgtcctagcattaacttcctgaaagaatttggacaagttacttagtgtctttgggcctatattttcttctttgtaaatgaggttggatttggtgatttcaaaattctctattctagagcattttcatttggagcagaattagtgaaaactagctgacttttgagaggcaacgtgtatatacacaagtgaaaaataaatgattcttcatatgtttccagctagcctttgtttaaaatgagaattctgtgctttgcagctgcttctcagatggattttggctctagggttgttctttgtgtttgtgtcctttagaatgagtgtctgtcagtctgtttgaaggatttcttctgctctttctactcttatttcagtttcttaatagctgcttaagtttcctgctatcattctttcttcagttctttaagaagccctgtgtattataggagtatttcttgttacagatactttcacacatgtaaattgactgcattccaggaaaccctttgttgttagtgatcttattcctcctttcatccactaagatgaaaaagtagaaccttgtttctgttccttctcacaacccaacatcggaggagttacgcatcaagaaggggtggagggagtcatgttcagcaatgatgttgataagatagtttcaccattgacagattaaggatagaccagataaaattttggtcaaatgtcagccagttgcggtggctcacgtcggtaatcccagcactttgggaggccgagacgggcggatcacctgaggtcaggagttcgagaccagcctagccaacacggtgaaaccctgtctctactaaaaatacaaaaattagctgggcgtggtggtgcgtgcctgtaatcccagctacccgggaggctgaggcaggagaatcgcttaaacccaggaggcaaggttgcagtgagatcgccctactgcactccagcctgggccacagaacgagactccatctcaaaaataaaacaaaaacaaaaattagccaggcatggtggcacactcctggaatcccagctactcaggagactgaggcaggagaattgcttgaacctgggaggtggaagttgccatgagccaagatcacaccactgcactccagcctgggtgacagagtaagattccatctcaaacaaacaaaccaaaaccaaaaaaaactttggtcaatgtttctgagtttaccctttctataaagaaaccacttactgaactgttaatgtctctccttcctttactcctctccaaggtggctgcttttgctcttaccagcttttagtgcttgctggctccatcattatagccctctcaggaaaaccataattgagacttagacatattaaggacattatcacaccattgatctagttaataacaattacaaaggaaacatcttaaaatacaatgcttgttcctgattaacgggtacattatgctttgattttaaaaaattgttttgaactttaaatatagctcttgtttgggggcataactataactcataatgtataatctttaaaagtactcacttcactagattatattgtaataaatatagataaattttactagtgtagactctcaacttactgtcgtataaacatgaaatcgtttttatcataagcgtcctattatatcaacctcattttcccacttggtgacaggattctttgagcacaactcagcccttttacattttcttttcatttatttttagcaattaaaactatctttcagttatttaagacttggtccatttatttaaaaatttcagtctcatattcaatttatatctccatttacctttctacctcagttcccattccaagttaggttggtagcggagaagaggtgtggtctagctctcacaaactcccctccaccccttcttgatgcattaactcctctgatgttgggatgtgggaaggaatagaagcaggggtccactttttcattttagtcctttttggccccttagtgggaggatgacaatggtggatagcagtagtagcagcagtgatggaacagttctgctaaaatggctactcctatgcagaagtgctgacttcagtagccaacagttctttcaactttgaatctgggacattaacatctggtaataccaaccatagaccttagttgcaaattgttgtactaggcacctaaaactgctctgcctcatagcatatatgttactggtatgtgtgtgtatatcaatagagttgatgaaaaatgaagttaagtgggaatgtattacatttttatgacttgaattatttgacatgtcaaggaaaaactatttaataataatatttttttaaatgattatccctgttgctgaagtttcattttaggtttacattaagcaaatcctatgtactgaatgtatgtaactgaaggagaagcgtttagaagcctgagattgatattcttgttactggttcacttttgataatcatggaaaatgtaaaccaagacatggaataataattataatagacaaaacatatagtgcttgctgtgtcttacgcacaagttaaccctcagcaacaaccctatgaggtaattaatagtagcattttcattttactggtgagggtactgaggttcattaatgatcctgtctagttgggaaaatagacattggacaaagaatttataactgtgttggttattgggcatggaatgtaaaatatattatgggagtatataagaagggtttctaacctaatattggggggtgtaaaatatcatgttttgcttggattgggggtaatgtctatttcagtaaatgggatgatgatgatgatgatgatgatgatgatgatgatgatacttgtagtaataacagaagtagtaatacaggttgagcatcccaaatcagaaagtccaaaatctgaaactttttgagggcctacatgatgctcaaaggaaatgctctttggagcattttggatgtttggatttgggatgctcaatcagtaatgcacatattccaaatccatcctatcctttaggaagattcaaaaaaatccaaaacactcctgttcccaagcatttcagataagtggtactcagcctatagcaagaatgatagctgtaatggggcaggctctgagcaaaagttttttatttaatcctaataaaaacctgatgacatagtactattattatcctattttccttttgaaaaatctgagccaaagaaagaagtgagaaattcagaatttatttgggtgttttcttagtatttgcaagagttacagtccttgagataggggaaaaatgtgagaagaattaaaattctatcatgtaaggtattaaagttaaattagttaagattgtaaaggatagaatggattgtcattgaaggttctttagagttagaaagatagtaaaatgacagagctggaaatgcaaaatccaatgagggtgtgagaaaaattaggtatatattaggttggaaattgccacctcagatgatgtgttaagagttagatgatggtttatcttgaacccaggaggaccaagtgcctctaaggcaggggtccccagccctggtccatggcctgttaggaaccaggatgcacagcgggaggtaagcagcaagcgagccagcattactgcctgagctctgcctcctgttagatcagtggggacattagattctcataggagtgtgaactttattgtgaactgcacatgcaaggtctaatccctgatgatctgaggtggaacagtttcattgagaagccatctctctccccatcccccaccccttgcccacatgtccataatccatagtcttccatgaagcctgtctctggtgccgtaaaggttggggaccactgctttaagagacctggagtgtaccagttgttacagtaactttttaaaacaaccaccaccaccacaaaacaaaaaactcacagtgttggtagaagataaccctagctggccccagttttagtctcttttcctaaagccggatgggaggaagagaatactctctacttgatcggcaacctcagtgggctctagtggtaactcccaactagttagcctttcttaatagtgtatcatttagttcagtggttctcaggcatgaggttgatttgcctgttttagaattgctgcttgtctcacaggatagctgataggaagttctgtattatctatgttgtagaacaaaactgcctctaaaataagctgatgattctcaaacttcagcatgcaacagaatcatctcctgaagggcttgttagaaaaatattgttgaatacctctcctagaatttgtgattctgtgtggctgagaatttgcatttctaacaagttcttaagtaatgctgatgctgctggtctggcaaccacacttttcttagtgggtaagtcttttatccatgggaaggttagaagtaaatatagaaatgatgaaatttattaaatgcttatattaatagttttgttttaagtctaggaataatcagtgtatttggtctttaaggtatttgttctgtttcatagaattaggcctataaaagtggccaacaaattagtcttaagagtataatttaaaatgcatacttgcgtaattgttttttgacttgggattttaagttgaaaggtgcaacaatttggctaaacttagaaaccactggaatgtttaagaacttaacatttattatatttaaaacttagtatagggtttttaatatttttctcaggaggtttacttgttagaagcaatgtgtttaaaatagaatatagtaaatttataaatgcagtttagtatagtaagtcctcctttgacatcatcaataggtttgtggaagttgcaccttttaagcaaaatgatgtgtaaagaaaccaattttaccataagctaattgatgtaaacaagagttaggttcctaccatatatttctggtcacaaaaacattagcaaacttgtaagtaaagacctaaaatacttccattattaaacattgaaataaatgtgaactatgcaaacattaaagaaagattaataaagacaagagaattatttactcagttattccagtcagagtcactgttggctggatcctgtcctgctcatggcacaaggtgggaaccagccctagacgggacaccattccacctcagggcacagtcacacacacacacacgcacacaaacacacacattcatactaggacagtttaaacacactaattaagctaatgtgcacatctttggatgtgggagggaactggagtacctggagaaaacctatacagatgtgggtagaatgtgtaaactccacacagacagtggccttgtctgggaattgattttttgttcttatcaaagttataacaaaacaatgataacaaaacgatgttattcaaggacctgtaatatatgtaagagaacttagttacccatgtttataacaggattatttagggatatttaattttccagtttgagttggtcagctatttaaagcaccttagaaagtgttaaaatttgctagattataaatagaatgcactttttatggtagaagacaagggaaagtaggtttttatatttttaacttcaagaaatctaacattaaaagtaaagtgactgcagatagtgtttttctgtgtgtgaaggcttatttcatggccactaggaaacttacattaggagactctttataaatgttgttcaataggtgatactagtacaaaaaggaatgtgttttagggtcaaatacatacattagagaaaggacaaaaattggcttttattttctagcagtaaatggaaagaaggaaatgtaatcagccataaatcacagtgtccctaggataaagataaacctgttgcttaggcagccaggagaaacacagttattccttatagtgagaatataacaaaaaaaaaactcatggaactctgtaataaagcaaaacaaaccaaaaagcttatttttatggtaagtacagacttcagtttcaaaaatctatttttaatttttttaaacccattaaatctttaatgtagttcaatggtgtagctctaaactgcaagttagtaaaagcacttctgtacaaggggaaaacaattaatccaaatatgcagttatctaacagtccatcttaactgagaggtaggttttacattttaaactatagattttagatagttacgactctctgttttggatttttttgagagtactactcaatagaattttttgaggtgatgaaaatggtctgtatctgtgatggccagtatggtagccactaggcaaatatggctattgagtatctgaattgcagctaatgcaaatgaggaactggattgagaaaattggattcaggattctgtatttgctctatctaatatggtagcaactagtgttaaaggaaaaattatttgataatacttcctaaagcacaataagacagactttattcaggaccattgcaatagggatagggactgtggcaatgagattttgtagttgaggagagagattgggctcaactccaaatacaaaatgggcaagtgggaatttctagccaaggagtagagtaaggatagatggatggacaattgctaagaggtaacgtcaggaataaggggtattatggtgaaactgacctaccaggattcttgctgaaggcaggccagagtaatcagacttcacctggacagtggaggatgagaaaactgatcagatacggaaggtaatcagatatccaggatcggggtgggggttcctgctacactgaccttaacatgattcttgctgaaactcggttttataaggaagtgaacagattggcataggagaaggttcagcagcctgactaaaatttggctatgcaaataatctttgtgactaggcacatgtagctattttaatgtaaattaatttaattaagtaaaactttaaattcagttttcagtctcactagagacatttcaagtactcacaagacagatggctagtggctaccatattatacaaggcagatataaaacatttttaccattgcagaaagttttattgggcagcattgatagcaatgagtcccaatgcagggtacacattagaattccctgggtagccatgaaaaaattttgatgccaagatctgattataatcaaagatttgatcttgaaatctctgtttaagatctccacttacagtttcttacggaattctaatatgtaactagggttaaaaaccactgacttaggatgtgaaggactctacatcattctgttttccttaatgatatttctctcaatcaaactcttgctgaatttagcaggttattatttatttatttttctttacaagtacttggggcatgcacctattttatgatgcaagttaataaaagaaatgcatgtttaagttttctgccaacctctggatagtattgagaccttaggaaagttgaggtgacttacaatgaaaagttcctaaaaggaagacatgtttgtatgctgagagaaagatgctgaagataaaatgactgtgtggcaaggtccttgtggaataaataaactactggaattatgatcattcttttttcacatgccacaattaagagccattaatattgtggaatatttgcttccagtcttttatacgaaattaatttttaaaataaacctgatatatactatatataaataagtcatatgttgcaaatactgaactttaaaaatcacctctaatccagtcacccagagatactgttaatatttgggtaggcattactgccaagtaatgtacatcacttctatgtgtatgtacatatagaaggatggatgggtggttagaaggagggagtgacagaatgaaagataatacttattcaccacaagaggttaattcctaaggggtgtgtctaaatttaagcaaattctaaaaaaaaaaaaaagaaaaaaaattacagatactgttattacaatcttgtttcagttttaggtgggatatatttaaccatgctttggtatgacattagcagtttcatttctcatttttctcctcctcacatcctaatatttactcattttactatttttacattgtccatgtttgtaacattcatacttagtttttcaaccacttttttataacttattattgttctatattctctagtaaccttttagaatgtcctccttgattctggagtttttgatacaattggcataatttcagtcttatagcactgagtaatgtttcagtagagaagtctcatgcaagccagccagattcttttccatttcccctagtagatgatttgctttttatgcatgaattgttgaataattttttaagctcccaagcataataatttaactaagagtagaaatgggaatagcctgactcatgtgcccacatgtgtctatgtggaataatcttttaggaattacacctttcttctggaatacatgttgatggagcagccactatatggaagatctctggttttgagatagaaaagagagctaagaagtacaattttggctccaaacacttccacctggaagacatatatggttcattgggcaaagcaagttggccatgtctgacatcaataggatggtgaggtatattttatattcctcaacaggaaggaatacaggcttagtaacaataatatagtctatcaccatgactaatttagaaaccattatattagtttgacagatttgaaaactgctggtgttaactgtcacaaatatgaagttatgtagggaagcccatttcttctgtcacttacgcagtctgcaggtctttgatctcttcagaagctctatttgtatgtctctcaaatgtgttgtgcgtgcaaatcaatagtaaatctgtaggtccggactgagcctcagatcttacattcacagtaagcttctgggtgatgtcaatgcagctggtccctggaacacacttttaaatagcaaggctctatagctctttaatatcatggatcttttcacttagaagagagccaactttaaggtctagatggaggaaaaggggcagtaaaaaggaacattaatgggtatgagaccaagaggagtgtgaaatactttcaaataaagggaaagaggaacatgcagaagaagtctcttggatgtttcacagagatcagataaaaaaaaagtggaaaagcccatcaaatttgccatttaatttattcattttagggtggggattgtgaactggggaagagaagatattacaatacattgtggattctgtaggagataatggagtaaagacagtaaaagtagatttctactttcaaaaattcaactgaaaagaagcagaaagatggagtagtatctagaaaaagatagatactagatttgagggaaaattgaggggttttgttttgtttttgttttgatcgtggataaggagtcaatagtgaaatgttgaaaatacaggtttttttccctagtatctcattattgagagaattattagaaaagctacaatcagcaatctgttttttttttagtttagaagatacttttaaagtgtttgaagttttagtatctatattactgtttttgaaaatactgacttgcagctcaatgttttaaatagtcaaactttttatacatagctattatcaatattgtaatattcagttattataggagtcttttattacattaaacctgatctcatagtacgttcattgatgatttccagactttctacagcatacctttccatttctttaccaaaatgatttttttaaaggttttatactgctctgttaattctctgcttgaaagtccttcaggagttctgagtctagtaatagcaagctaggtaattcagactatcctgctgagaacaatttaaaaagctggacacaaagcaaacattttattaagggtatcagaaagctaagtggtatgggtaggataggatctgaatgaggacaaaggtctaaggagggagaactccaatttgattgctttttaccccaggggtagtgttgattcctgaaacaggaactgagagaccaaaaggtgcatttgacaggctgtgggtataatggaaccgggccagagtgcaaggcctgtcacaggggatgggtggccctagtgatctcttctcactttggaccccaaaatgttgtacattagggagaaagataaactgaagtagctaggcctccctaggaagatacttcaacttcaaattatcaaaatttctgtaacttaattaataagatctggtattactagtgtcctcaggcacttgacagaagcaaacattaattctttctggagaattaccagtttctacatgtaaaaatgttttgtcagacgattttgcaaattttatgttctgcacacaaaataggcacatgacaagatatgtgacacaatagagaatagaaacaggcccacggtaactctagatattctagttatcagatttaaaatagctatgttgagaattttgacctgattaagaattttgtagaaagttacaaactatgagaaagaaaaatggatattctagaagtgaaaaatacaacccctctaattaggacctttgtagatggatttagcagcaaattagacaccgcagaggaaagaattccctaactgaaaggtaagtcaaaagggaatgttcagagtaaacaggaaagaggaaaatataggagaaggtaagttcaatacaagatacagtgagaagttctaatatgtatgtacatatacatatgaatcctgaaagtagatgagagatagaatgggcaaaagcattatttaaagagagaatggctggccaacatggggaaaccctgtctctactaaaaatataaaaatcaggcgtggtggtgcgtgcctgtagtcccagctatttgggaggctgaggcacaagaattgcttgaacctggcaggcagaggttatagtgagccaaaattgcacctctgcactccagcctgggtgacagagtgagactctgtctcaaaaaaaaaaaaaaaaaaagaatggctgaaaacgtccaaactaaagaaaaactttaattcagattcaagcatccctatcaacctctagtggaaaccacaccaaaggcaaaaaaaaaaaaaaggaaaaaatagtgtttctaccttcaatcatacagcattaagatggacattgatttctcaacagacacagtaaaaactaaaaaactgggaacctatagatttaaaatgttaaaagaaagtacctgccacctagaattctgtgacctgtgaaatttcccagagatacaataataatcataaatatgagagcaaaactaaatcaaccttgactatcttaaaaataatgttttttaaatacgcatgtattcagcgtgtaaaactgtttcatatatcttggcagtggcagacagtttttaacatccttgcattgtctgggaagaggataaaagtaccagttaatattaggctgtgagcatatgtttattgcagcactattcacaatagcaaagacttggaaccaacccgaatgtccatcagtgatagactggattaagaaaatgtggcacatatacaccgtggaatattatgcagccataaaaaatgatgagttcatgtcctttgcagggacatggatgaagctggaaaccatcattctcagcaaactatcacaaggacagaaaaccaaacactgcatgttctcactcataggtgggaattgaagaacgagaacacttggacacaggaaggggaacatcacacaccagggcctgtcgtggggtggggggaggggggagggatagcattaggagatatacctaattgtaaatgacgagttaatgagtgcagcacaccaacatggcacatggatacatatgtaacaaacctgcatgttgtgcacatgtaccctagaacttaaagtataataataataataataataataataataataataataataaaaggctgtgaggagtcagtaattcagactttttatctctgggatgaccactaaaagaattgtttaaaaaaatgtgtaactttcagatatgtggggaaaaaccggagttaataaatactgaatccaaggaaggcaacaaaggagagaagtctaaaagaacaggtagacagatagaaaatagaacaaatagtgctgggcacagtggctcatgcctgtaattccaacactttgggaggccaaagtgagtggatcgcttgaggtcaggagtttgagaccagcctgaccaatatagtgaaactctgtctctactaaaaatgaaaaaaaaaaaaaaattagctggggttggtggcgtgtgcctgtagtcccagctactcaggaggcgaaggcaggagaattgcttcaacctgggaggttggggttgcagtgagccaagatcgtgccactgtactccagcctgggcaacaaagtgagactccatcaaagaaagaaagaaagagagagaaagaaagaaagagagagagagagagaaaagaaaaagaaaagaaagagagaaaggaaggaagggaaagaaagaagaaataaacaaaaaggacctgcttagatacacaccagaaacataacgtcatatggttaggctttgtgtccccactcaaatctcatcttggattataatcccgataatccccacatatcaagggagaaaccaggtggagggaattggatcatgggggcagtttcccccatgctgttcttcttgtgatagtgaggtctcatgagttctgatggttttataagtgtttgataattcctcctgcctttattctccctcctgccaccttgtaaagaaggtgccttgcttccccctttgctttctgctatgattgtaaatttcctgaggcctctccacccatgcagaactgtgagttagttaaacctctttcctttctaaattacccagtcttgggcaattctttatagcagtgtgagaacagactaatacagtaaattggaactacaaagtggggtactgctataaagatacccaaaaatgtggaagcgactttggaactgggtaacaggcagaggttggaacagtttggagggctcagaagaagacaggaagatgtgggaaagtttggaacttcctagaaacttgtcgaatggctttgaccaaaatgctgatagtgataatggtaaatgaagtccaggctgaggtggtctcagatggagatgaggaatttgttgggaactggaataaagttggctcttgctatgctttacaaagagactggtagcattttgcccctgccctagagatatatagaacgtgagagagatgaaatagggtatctagcagaagaaatttctaagcagcaaagtgttcaagaggtgacctgggtgaccgtaaaatcagtcagttttatggattcacaaagagatggtttggatttgaagcttatgtttaaatgggaagcagagctaaaaagtttggacaacttgcagcctgacaatgcaatagaaaagaaaaacctgtttctgaggagaaattcaagccagctgcagatacttacttaagtaacgaggagacaaatgttaatcaccaagacaatgggtaaaatgtttccagggcatgtcagagaccttcgtggttgcccttcccatcacaggcctggagacttaggaagaaaaaaatggtttcatgggccagacccagggccttgctgttctgtgcagtttcaggacacagtgccctgaatcccagctgtggctaaaaagggccaacatacagcccaggccatttatttagaggatacaagtcctaagccttggcggtttacgtgcggtggtgtgcctgtgggtgcccagaactcatgaattgaggtttgggaacctctgtctagatttcagaggatgtatgcaaacacctggatgtccagacagaagtttgctgtaggggtggagccctcttggagaacctttgctagggcagtgcagaagtgaaatgtggggtcagagcccccacctagagtctctactggggccctgcccagtggagctgtgagaagaggcctaccttcctccagacctcagaatggtaaatccactgacagcttgcactgtgcacctggaaaagttgtaggcactcaatgccagctagcgaaagcagctgggagaggggctgtaccctgccaagccacaggggtggaactgctcaaggccatgggagctcacctcttgcatcagtgtgacctggatgtgagacatggagtcaaaggagattattttgaaactttaagatttaatgactgccctgccagattttggacttgcgtgggacctgtagtccctttggtttgcctaatttctaccatttggaacagagacatttacccaatgtctgtacccacattgtgtcttggaagtaactaacttgcttttgattttacaggcttataggcagaaggaacttgccttgtctcgggtaagactttggacttggattttagggttaatgctggagtgaattaagactttgggagactgttgggaaggcatgattggctttgaaatgtgaaagggacatgaaatttgggaggggccaggggcagaatgatatggtttggctttgtgtccccacccaaatctcatcttgaaatattatccccatactctccctgagttaagggagaaaccaggtggaggtaattggatcatgggggtggtttccctaatgctgttcttgtgatagtgagttctcatgagatgtgatggttttataagtgtttggtagttcctcctgagttcattcttcctcatgctgccttgtgaaaaaggtgcctggttcccctttgccttccgctatgacttaagctgaggcctccccagccatgtggaactgtcagtcaattaaacctctttcctttctaaattatccagtcttgagcagttctttatagcagtgtgagaacagactaatacataaggatacagaaatgttgagagtagaaagaaaaagcagaaactaatgaaaagagaattggtacattaatattagacaaagaatactttatggaaacagtattctgagaaaaagtttaattttccaggaagatataattttcgatttgtatgagcctaataacatggtcccaatgtataaaaagcaaagtagggagacctactgggaaccaaataacccataatttagagtgagagatattaacaacctccattggtaacagaataatcagacaaaaacaaatcaatacaaatatacagaatttgactaacacagtccacaaacttgacctcatggatatgtaaatacatgtgtgtgcatgtatgcatacacatatataaaacactaaaccctgcagtgcagagtatacattattttcaagcatatatggggcatttacaaaatttatacatcttataagtttccctcttaacactatcttagctgtgtcccagagattctggtatgttatatctttgttcttattagttgcaaagaacttcttgatttctgccttaatttcattatttacccaaaagtcattcaggagcagattattcagtttccatgtaattgtatagttttgagtgaatttcttagtctaatttttctaatttgattttgctgtggtccaagagactgtttgctatgattttagtccttttgcatttgttgaggagtgttttacttctgaatacgtgatcagttttagagtatgtgccatgtgacaatgtatattctgttgtttttgggtggagagttctgtagagattaggtccatttgctccagtgctgagttctggtcttaaatatctttgttaattttctgtctcagtgatctgtctaatattgtcagtggggtgttaaagtctctgagtattatcgtttgggagtataagtctctttgtaggtctctaagaacttgctttatgaatctgagtgctcctgtgttgtgtgcatatatatatctaggatagttagatcttacgaattgaaccctttagcattatgtaatgcccttctttgtcttttttgatctttgttggtttaaagtcttagtttaaaactagatttaaatcctagttttgtcagaaactagaattgcaacctctgcttttttctgttttccatttgattggcggatttttctgcgtacctttattttgagcctatgtctgtcattgcatgtgagatggatctcttgaaggcagcatatcaatgttcttggtgtcttatccagcttgccactccgtcttttcattgggacatttagcccacttacatttaaggttagtattgttatgtgtggattttatcctgtcatgatgttagctggttattttgcaggcttgtgtatgtgatggttttataatgtccctggtctgtgtacttcattgtgtttttgtagtgtctggtaatggtctttcctttccatattttagggttcttttaaggcagttctgatgctaaccagtactcttggcatttgctcttatggaaaggatcttatttctccttcccttatatagcttagtttggccagatgtgaaattctgggttggaattttttttaagaatgatgaatattggccctcaatctcttctggcttgtagggtttcagctgagaggtctgctgttagtctgatggacttccctttgtaggtgacctggcctttttctctagctgctctcaaatgttgtgattatttgattgtactttcatattgatggaagaaaacaaatagtttattttatgtgctttggtatttagatctgtgaataaacattttaatattaattattaaaatttagaactgtttttataatatgtaattattgcataatattttataatttttaattagtaaagagaatattttccatttgtttttcaaactttaaagtgtagaaagttagtacattagttttcttgccctgaactgcattctgtggtgagcttttgaaaattacagagcaattgcaaacttgcaaacatgtttaatgaattattgggatattatgaaacacagatcgaaaagctattaggcaaagtaaatacaaactaacggttactcctaaaatcaattaaggaagggtatattattagttaaaggtaatctgtaattgtatattgcattgcttgagaagtttaaattgcaagtttaatttgctattcaaagaaatcatttaaaaattatttaaaacataaattattcaaaaataaatcgaattttattttaatacattttcagttgtttaaaataaaaataaattctttaaaacttattttatcttaaaatagttttaatgtttgcattttctcattagagaagcaaatttaaatataaactattcagtgtagaagaattagaatactttgataagcaaaaataatattctttataaaaattctaccatattgcattgccaccaggaatgcagaagaatatctcatttcctactgtcaaacagtatgtgaccaaacttcttttgagtttttaccaacccgataggtgtgaaatgatatttcagtatagtttaaatttgcatttatctaattatgagtgagattgaacaacattattacatgtttaaggacatttttacatcctcttgtgaattgtctgattatatcttttgtgcatattttcacctgcattattttttccctagtttttaagagttctttaaatatttaggatacaaaagtagaatatgtgtatgtatgcgcacgcgtgtgtgtgtgtgtgtatctctgcatactatttttcctagagttgtaatggatgaaccataattctttctctacttttctttatggaaaattaatggcagttcataatagttttggtagttcaaagtatagttcaagttgttgcttcagaacattactttattagatgcttgccatgtgtcaggcccctagttaggcactgaggaggctttgtggaagaaaggcaatgttttggaggttacaatttagtggaagggatttaaacccaaatattaacttaacactgtgtcagatgctgtgaaggagacataaagatgctatgtgactaataacagggacttgggttagctgggtgatcaggaaggttttaggatagttttttaaagcattgcagaggtaattgtcctttttggggattttgatattattattattttttagtgcttgtttagaaccattcacccgacagctgagatgattaggtcaacataaactcttgtatggtcaaaatgccatttaagtttagatagagggagaacaatgaaatagatattttctagattatatggtcttaggttgaaccataaattttctttgaaaactatagtttttaattttggtaaattttgagggtaaagtaaatgtagcattttgccatgtttactatcttatttaattttgtgatttatttagttttttagatttcattttaataatttttatgtttaggtaggagtggtgttttattaattcagtgttgttattacatgaagtatagatgaaaaggttaacactaatacaaaatttaaagggaagcagtttcgctaatcttgatgataatgaaacattcaaggaagtcttgataagcaaatgaaaaatattaataattggcattcaatctgaaagtaaatgttcaaatgtatgtttctatatgaaagcacaccttgatttacttcatggcatgttaatatgaaagttcataatttaatcccatagagaagactatttttcattatgacttgtagaaaaattttttcctgtgagaactaatgttacaatttcttatttggaaaataatgatatatatcttgaaagatgtattttaaaaatatataatgtatcttaaaatgtgttggtattataatcaggttaaatctgttgaaataaattgtaatttagtttttaatgacttcctttctgttgacaattatgttttgcgttgacttgcaattattctattggttcatactagttaagttcctaaagcaagcaagtaggaagttcagttccttttttttgacagttgcttgatttttacagcagagcatcccagggagtaagctgtattactagtaaattagacatctgcccaaagagctctattcagtagtccttgacattactctgaaagaaagatgaatttaataggaattttgcctttttttcccagacactggccaaaagaagaccctagacaagaaagatggaagacgaatgtcttttcagaaacctaaagggactattgagtatactgtaagttatttgctttcgaaaaagctatttttctttgtaagagtcttctttaagacattctctgtttatactataaataagacaagcattgttaattgccttatttttaaaaatctgtatttcactttggataattgttttattttttagttgttgtttttttctttaaagagaaattttactgagatataaaggtagttatcctagaaaatttaatttaatatagatgatagtttactgagagagttcccatgggccaataatttttattaggttaggcttttaggaaaatttttagttctttagaaatgtgatcttcattatattcgcagcagtgctagtgatagttataatggcagatgggatacataaaagaaaagttgatattaatcttccagtataaccttccacattaaatcatttgtatttatttatagctaactccctttagctctaaacattgagcttttttttttttttctgtattcttgaaatgaacttcaaatcttcctgcagtcagctggcttttcacatttctggttactctgggaaactgaagtgagaaatcagctttggtatatggtatgctgcatatttgattgaatgtaaagattgtttatttggataatgttaacgtgttgtaaagcacttttaactgagcttaattttgttattctgtgtttttctaacataactgtattaaggagaacagcaattttaaacattaatttagcatttgtatcattatgaaaccgtccagtcttggtttgactcttattttccatgcatctttaaaattgaacaaattatcaaaattctaatttatactctattttgatataccattcatatatagcggacagtgtgagattttaaatatttttaaaaggaatcagataatttaggatgaaataaaatttactaatatcaagataatctcacagcatattttaaactcaaattgcgtgtgtttgtaccttctctgcataattgagaaaataagttcaaataagttttttataggtaacctttaaaatttcttcgtctttacaattctgcagtgccaatatgaaaaatttagatatatacatgtttttatcatgtttattgtgtttcttcagcctaagaaatcatgtcactcataaattctagaaaaattcttggtaattatctttgattgccattttctcctccttcctctattttgtttctccagaactctaattttttattgaaactaattgtactacattttgctatcattatgctttgttgaccttgctattattttgattgtatcttctgtctgctttgctgggtgtttgcctcttcttaattcccaatgtgagtggtcccttgtttctttttgcttttctattgacattctattacttggagtgcttaagaactttataaactacgtggagtgagacccaaactttttttctatccctccctttctagttgcttgcatttcctactatcacttcatactaaacaaattatggaagcctcttaccaattcttcttcctccatccttccacaattcctgattttctcatttccgttccctttcagtttgttattcattcaggttgcagtctttagagtcagcatcagtttgctcattcacatttgcttccctgacctactgctactgctgtcaccacaactccattcaatccatgaatgtcttctcttgagtcttagttgaaatcttgtaccttaatttctttctttacatttttattactttaaaccttatctttgtttttctgcatcctttctctttcttgttccagtaatcctagccctgatgccagtaatatgagatgccacttgggctgttttgttaccttcatcatctcatttaatagaatcactgtgagaataaaatgtgttattattaattatgaaagtacttggtaaacttacagattttactgcaaaatatcatttgtttacagagaccttttatatatattatctcggtaacataggttttatatcagtacattgtgtagatggggaagtttgcatagaaggatgtaggcagaactagattattattgtattaacccaaatatttggcataaatttggttttataaaaccattaaggaaaatatgtatattattgttttacatacacaaacaaatgcacacgcacctgcttttcctgacttttgaaatcttctataacctaattctaaatgcctctttttttattttattttattttgttttctggagacagggtcttgctttgtcgcccaggctggggtgcagtggtgctatcacagctcactgcagcctcaacttcccaggctcaagtgatcctcccacctcagcttcctgagtagctgggactacaggcatgcatcaccacgcccagctaatttttgtattttttgtcaagatgggattttgccatgttgtccaagctggtcttggactcctgggctcaagtgatccacctgcctcagccttccaaaatgctggaattacaggcatgacccaccatgtctgacctctgaatgcctctttatcgtttttagagacttaactccatgtaatcaccttcccaaaaatttgtgcttcatgagtctactctggatggtttaggaggaagaggacagtatcccacaaatatgttatgcttttctgtctcttaactatgtcagttctgttatcttcactttgaaagttcattcctttctctctacttttcaaattcccaacccttcttcaaggcccagctttaaatcatttcttttctgtagtcttttctggaaaatttggattacatggtgcttttattcatactcaaaacttctattgcattcattattccattttaaattgttcatcttttgcataaccttttctatcttagtttccaactagattgtaaattccttgtgcaaaatgacttttagttgcacttatttgtgttttcttcagagctctctctttttttttttttttttttttgagacagagtctcgccctgtcgcccagactggagtgcagtggcgcaatctcggctcactgcaagctcggcctcctgggttcacgccattctcctgcctcagcctcccgagtagctgggactacaggcgccgccaccacactctgctcatttttttttttttttaatagagacggggtttcaccgtgttagccaggatgttctcgatctcctgacctcgtgatccacctgcctcggcctctcaaagtgctgggattacaggtgtgagccaccgtgcccggccttctttagagcgctcttaatgccttgtgtaatggggactttaagtggttatattatattggccaagtgacattttcttttagggtaattgatgaaatctcattatttatgatttctacacatatgatcatggaaacgtacgaatgattcagaactaaataactcaactttagttcaaatatttttctaatttatatgtgcaatgacagaatatatgcataaagatcattttgagtttaatacaggtgtactttgcaaaaatgaaattagtatgttgctagaagtcacatatattttagaaactattcaaaggaatagtgtattattttaaaacctttgtaaaatgaaaataatcagtttttgacttttaaattatgttttgtattttgaaattacttgaagtagagacctacatgtaaatgtattgtgatgaagcctttactctgtattgtaatagattaagagcatttgctaacaaaacacagtgtttcttgacagttattttcaaagatgacaataccagttgttaatcaaatgtaagctggtccctagatatattaatgctcattaaatattatagtttagtttttctgttttaaacattgaaataatttattttttcttttaaacaggttgaatcaagggattctttgaatagcatagccctgaagtttgatacaacacctaacgaacttgttcaattaaataagttattctcccgagcagttgttactggacaggtagtatcttttttttaatgtgctgatgtttagaaacattaaacagaaaggcagaaagtatttattgtactgtagttaataatatagaaaatttgagaataattttatatgtgcttttaacaaatcatattggccatgtaagagaaaattaactgttttatgtctgtattagtttcttttttaatacatattgaaaataattgtagatttttctttttaaatatagttacaaagagctttttaaaatattcagaacaatatatgcatatgataaaaaattactttatcaaagtaaggcatccctccatctcaaactttcagtttcttttccagaagcaaccagttggcagtttgcatttctttcaggaataatctagcctacttttgttgttgttgttgtgttttaatttaactttgattcttggaaagtgttgtatttaatcacagttctagttcagactttttcacgcgtgcatggtattacattgtattgatatatcatacttatttaaagcattagactatttctactcttttgctaaggtcaatagtgctgtagtaaacatgcctgtacacatctgtttttctttaaatgtaagtatttctgtagggtgaattcttagaagtaaagttactatatcagaggatatgtgcactttaaattttgctagctattgccaaattgtcctttaggagtgacacctctatagtgtatgacaattaatgtttcctcaccctattccagccgtatatattatcaaatgtgtctaaactgattttaaaggttcttttttaaaaatgtttttatattcttataatttgaaaatttttatgtttttctgtttaattggtaattgttaatagtgcttgcttatagaacaccatctaattattaacacttcattttaactaaatctttgtgtgaatgttttcttacaggttctgtatgttcctgatcctgaatatgtctccagtgttgagagctctccatctctaagccccgtaagtcctctgtcaccaacatcatctgaggctgaatttgataagaccactgtaagtatctctgctttgcaaagatggcgatgaagaaatctcactttgtctacattgactgtcttgttttttacattccattttgactatggttagaatgaaatatttcctttttattttgttgcttaagtttgtaaatcccagctttaaaaataagacattcttatgaaaccatatagcttaaattgacttacctttgtaggtggtggttgtgggccaaaaatattcatcaactcttattttttaaagaacatatataatttaacttacaaaggaatcttacccaaaaaacatgacattatcacagtagaggaagttcatgtccaatttgatgtttatttcatctataaataaatgagtatatagtacttagaactcttgagtttaattttgacacattgccttttaaaaaataatttatcatcttagtcatccaagaattgacatagtagattaatttatctagcatttctaaggaatgagtgttctaataacttacattttacaaatgaacttcagggaactaaacttcatttaataattttgattaaaatcttctgaaaggaattatatattatatatttctttgcctttcatagaataaattacatgatattattaataactatttttctccttgcctgggaacttttttctgcatgtgtgtgtgtttgtgtgtgtgagaaagagagagagaaatgaggcctttttcatttatttgatggatatcttctttatataattatggcaatactatgctttagaatgcagtcacatgaaaggaatatattacatttgttgtcatcattgataagaataaaagtcaggttttaatggtaggtattacttaccaaatgacacaatacctttttgaacatagccatgccattttcccatgggacttacaaagagatgtactcataaggggcaatgacaaagtaactacgtagccttaggttaatttagcctgtgtttcaaaccctaaagcagaatgatgaaaatctaagctgtagcatcatgcctgactagaaacctgtggggtctcttcctgttcctcggctttaacctaaatctgcctgtctactggctttcttggaaggtataagatcaaagaaaacaaaatgttgaaagttaagggagcaacaaggccaggcctcaacctgtgtgaaaatgtaccccttcttacttttgccatttgactgaaagagatggagaggataaagttatgtgaatgatcttttaatcctcagtgacttagctactgtcaaagatggaccaaaaaacttcctgtaatttggccagtgatatgagtaaattctttgtccctgggatagattaaaaaaaaaaaaaagaggtgagagattccttaaagaactaaaagtacacctaccatttgatccagcaatctcactactaggtatctaccccgaggaaaagaagtcattatataaaaaagatacttgcacatgcgtatatagcagcataatttgcaattgcaaaaatagggaaccaccccaaatgcccatcaatcaacaagtggataaggaaaatgtggtatatatataccgtggaatactactcagtcataaaaaggaatgaaagaatggcatttgcagcaacctggatggaattggagactcttattctaagtgaagtaactcaggaatggaaaactaaacatcgcacgtactcacccataagtgggagctaagctatgaggatgcaaaggcataagaatgatatagtggactttggggactcaggcaaaagggtgggagcagggtgagaagtaaaggattacacattgggtacagtgtacactgcttaggtgatgggtgcaccaaaatctcagaaatcaccactaaagaacttactcctgtaaccagacacacctgctccctgaaaacatattgaaatggaaaataattaaaaaaaaaaaaaaaagaggtaagagaagagtttgtaaacttctctttacatggaatgatactctttacctgccatcaaagagattatgggcaatagttagaaataattcttacaacagttgattgtgtaaattttagttgtattttttttacctaggattatattcattaccaggctccaggataatatttctatgactttctgcatatctcaagtgcctatatttctatatttctaattattgggttttatgtctcccatgctgtataaatcccttagaaataaggatattatgttttattagatatagtttacattttcattacactaattaaaataatgtctattagtattgttattatatgtttttcccagaaattgtcagtttatattaccagcaaccactgataaattttttgaatgtccagcttagtagtggtttactatgaagctaaaaatatgttcctggctttgtcggcataaagactttcattggtaataattcgttttcacttaaaaatattgcattttgagaatttccatggaaaactattttttctttatttttcacttttttttgttcacatatggaggaagaaatatagaaggagatagaaccaaagtaatggtaaaaatcataaaaatagctaaaatgtagtattgcaacaggtataattctaagcactttaaaagtattatttatttcttatctcaaatttatgaggtaggcacttggcctgggtttctgtgtttgtccctccagacttactctgtattctctagtgtcctttgggtggtagactgcatcagtgcactctctcttgcccttttgcttctgttggtggttttctttctggagcagttgcagaagataagggggaaggaaagagagaataagatggggacatatttattctcctagctccttccctgtaaggttactccagagtgaccacattcttcagcatctcatcttatcttttgtcagccctttccacagagccatctctaaatttaggtatctgtttctcccccttacctctttagggatagaggagtcttctgttattgttcaccctgggtttttgtacaccatatgtacctttgtaaatagttccataattaaatcctcttaaaattattcagtttctaccgggcatagtggctcacgctggtaatcccagcactttgggaggccgaggcaggcagatcacttgaggtcaggagttcaagattagagcggccaacatggtgaaacccatctttactaaaaatacaaaaattagccgggtgtggtggcgggcacttgtaattccagccactcaggaggctgaggtgggagaatcacgtgaacccaggagtcgggggttgcagtgagccacgccactgcccttcagcctgggttacagagtgagactctgtctcaaaaaaaaaaaaaagctcagtttgatgtgccatctgttttttctagtacctgaccaataagtattgtatccattttatagaggaggaaacagaggaagagaagttaattattttgtgtttaaggtcactcagctagtagctaagctaagattctaacccagatgggcttggttcggagcccatattttttattactactttatagctggaaaatgataactcagaaacactactcttgcccaataaataattggacccaaagagttaagtaatatttaatcattataaaagtcgatatagtaatagctaccatttcgcactatcatcttcctaagattctttaaatctctcattttttgaataaatatagaaacctgcttttgttttgtacacctttggtttttctcctttgtactgtaagttcacccattatgctaatgccattttagggtaaaactgttaatgtgttatattcaggatgaagttcagtggaaaaatgtttaaaataagtaatatgaaaaaacgaaataattttaaagtacttatgtttatattaatatactctattgaagggtgggatatgcagatagtcatattctctttaagataaaacatggtataatactctaatcaatctaaaatatgataaaaatagaatattaataacacttgaattggatacacatgatgataagacaatataattttgaaaaaaaaatacttttaagagattctgaggaaggcctaggaagtcctaaaggaggaaagaggaaaaagtataaaatagcaatagaatgtaggcatattaaatcttcctttttaaggataggctgtgattatactgctacagtagctattgtttttttacttaaagagtgcttactatgtatttactgtgttcatttcagaattttaatctttaacactttaataacattttaattactttagacttttaattaatctttaaccccatgaggtaggtacaataatcatgatctgtatttttaaaaatgaggaaagtaaggcatagagagaagaatgatggttagtaagtggtagaactgagactgaaaacctggcagtcaaggtctagattctgtgttgtgttcttaactactttttgtactgcctaagtaatgaaatgatgactactagcaagtgcaggtactctataactgagacatatgatctaaattaaatatatgtgtcacaatttataggaactaggaagtttgtagtaaagaactgtgtggaagtaatgcatgaaatttttgcttggccaaagcaaaaataaaaatgtagaagatttagaaatgttctttaattacctatattagtttcctagtattatcataacaaagggtgacaaattgggtgggttacaacaaaagaaatttattaccatacagttttggaggctggaagtctgaattcagactattggtacgaccatgctccttttgaaacttgtagaggagaatcatttcttgcctcttctaactggtgtttgccaagtatcattggcattccttatcttgtaaatatatcaccactttctgccttccttgtgacaagtggccatctacttcctgtatgtatgtcttcacatggtggtctcttctttatataaggaaaacagtcagattaagggcccaccctactcatgtatgaccttaccttaaattaataattacatctgaaaaatcctattttcaaataaggtcacattctgagatactggaggttagggctttaacattatcattttgggggagacagtcaaaccataacattgcctcataaaattataattatagagaatttatattatggagctttatttatattctagaattttatattttttgtctttgaaggaaaggggaaatttagaaaactttctaattctagtcaagtaagattttctaagagatgtttagttaattttcttcatttaagatatgttgaagggttaagttaatttctcatagggttttgggaagcttgtgaatatttgtaaaatattgtgaaaacttttttaaaaacgtctcttttttaatcatgatagtcacataattaattggcatcttgaagtggtatgcctgtatacctgaaaatagacattaattacaagtaatagcagacatgcaagaaattaaaacaattttagttaggaatatcaaagtagtttgaaaaggttaaatatcgcctgtgcttcaggaattgctttcacatatgacatcctttaacaattcacaaacataacctctcttttctctctgtgcatatatagaatatatattttttaacttaaaattaaagacactaatatctatcatatacaatattatatgttatatataaaacatgttttatctcttttatagaatatataaatcgtaattttttctaaattatgattttaacttcaatgcttttagacttcaatgttaatataaatatatacaacttatgtgatatataacttatatattaaatgtaagcttatgtattataataaaactataaatatcaataccactcaaatgtgtaaataacacataaatcatatatactacattcatattattacatataatttagctttgatgcttttaaacctattttaaataacaacttagtaaggaattgttttttaatatgtactttttaatagattatactgtaattatacctcggtcttatattcttagaacaaaattttatggttagtatctgaaaaattaaactttataataggacttagtgtttgcgaagattttaggaaacaaatattttatatagaagaaatccctgtatttttaacatcacaagaaatgggtaaattactagatgagagtttttttttttttcctagattccagatggaaacattatttccataattagaattaaaaattgatcccgatattttaattttattattttattctgtatttgattttaaacattcttaagttcttggtcccaggaagtagagattattgaacataatttatagacagtaaatggcaatcatcgtatatattggattgaaagaaaaatacagcatacactgcttcaaaagtaaatgttttctttaaaggatatatagtatatacgttgcatgaagtaaatacaaatgttggtatttctgtgcctgtatggattttcctcctcaatcttcctttgccctacctatgtgttactagagaacatttctacaaattttcaatcgcaaaagaggaaaaatacaataaagccaaggcaagaagggaagtggacagtttggagttgctaattcatttatggtaatggtttataataacatacaaatcatattgtataatatattctacaaaaaaagataactctaggtgattattaaactttttgtaaatcatttgccctagcaatgctttgcttttttacatttgaatatttggggcaataatgaggctagatagatagatatagatgtttatatttctatatttttaaggaccttctctggtggctaaaacaaaattatgcagggaagcatcagcaagccatcaaatgagctgcaaaaccacctcattaataatcacagtttaaaaatagcattcaaaaccatctacatagagatactaatactttgaatagtgtacatttatgtaagttacggtgaggtctggtaattcctctgaacaactttgatcttttttgaaagtaatctccttttttgtgctttgctttgagcatttgctaatctcatattctttttaaaagaattacattgacaaattggtattgctatagatactgagttcagactttcaggtaacctcagagatcatatattgttcaaaaaggcatatcttcatttaaggaaagcatatgacaatgtgcacatatatatacatatatatatatatatatatatacacacacatatatttatatttgtgtgtgactaatgcggttaactcagttttgggggaattgaggaatcacaaaatttgttgatagctttttgccagtttgcaggggaccctcttatagctctgcatcagctatttttttcttagcatatttttgagttgtttggtagaagatttgaaagggaagcgatacaatattacagttaagctcactggtttgtgtgttgataacataggtttgcatcttagctccttactcatttgtcaagttattgaacttggctaagcttaagttcaacaaaaaaaaaccaagaagcgtatatatgtgtgtgtgtgtctatatatatacacacacacacacacacatatatatatacacatatatatataactatacctctagtttgtttttaaaaaatgttttaataccatgttgtttccatttgtttttccttataattctctattttattttgaccattccaaaacattctgagaagctggttcataggcttcactgtaagaatggtcagtagcaccaaaaaagttaagaaacttgtgatctagtggaatgggatttatcaactgtagctcgagatttaaaaggctattccagtgaatgggttctgctgtatgcttaggtactaaggtaagctttccacctttttactgctcccagcacctgatggatattatattatatggtcttatcagagtcagtggtttaattcaggagcatctgagtgtgtgtgcacgtgtgtgtatgtgttgggtgtgggtacaagagatgtagtgttcactgttctccagattattttattttttaaatttatagatatgtgtatctccctattaaaaatcactataaatgtaagtttaacctgtgtttgtgatctttattgaatatgaaaatagtgccacttttgtcctataatttgtacgtaaaaatatttcgggctgacttccagaatgcggtgaaatgaaacaacacttattggggaaagctattcatttgactttttaatagtgtgctcatttttattttgttttctgcttttttttttctttcctttaaaaaaaaaaaaaagaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaaggtaaagaatgacactttagagaagacctttaatcatgctttagttattactaatgtatgatagtttggcatttacattttaagtcatcaatgtcagaaaatgcttgaatattatagaaaggtactagtgatactattattttgggttagtatggatgttgcttataacttagagtctggtgatctgttgtaattgttaaaagtaatggaatataaataaattcactaaggcacagctaagttgctgttggtaggatatttcaaaagtgtgaataaaatgactgctgccaggtactgtgtggagtgtgaacttctgtataactagtatagcacacaaataggaagatatctagtatttattgagtaccttctatatgccagagagtatttgaggtatcttaattattttatcaattcaaaacaatcttgtgaaataggcagtcatatttcttttccacagggaaaaacaaaacaggaagggttcataggaaaggttaataggtccaagatctctctataatggccagaattcaaacctagtcagaatcttttttttttttttttttttttgagatgaagtttcgctcttatcagccaggctggagtgcaatggcgtgatctcggctcactgcaacctctgcctcctgggttcaagcaattctcctgcctgagcctcctgagtagctgggattataggcactcgccaccacatctggctaactttttgtatttttagtagagacagggtttcaccatgttggtcaggctggtcttaaactcctaacctcaggtgatccacttgcctcggcctcccaaagtgctgggattacaggtgtgagccaccgcacccagcccagaatctattttgtctgcttcactttgttgcttttctaagcaaaaacttctaatctgaaaagagaatatagtaaagtaatagagttggaaaataaactccagattttgctcaaaaaatgtctataacatgatactgcctttagaattcacacatgagaactatttctttgaagtataattcataaatttatgagtatttgaaacacataataagcatttagtggtatgcattttgccctaaatattgttttaaatgttgtgttttcattttcatttactttaaaatattttctcttgatttcttctttgacccatttgagagtgttttatttttctagataactgtcttttactaatttctaattcgattctgtgtgatcagagaacacactactatttgaaggctttatttagacctgttttatggtctagaatatcgtatgttttaataaatgtaatgtgtgcactgtaagagacacattatatttgtgttgggtggaatattccacaagtgtcaatcaaatcaaattgagtgatagtgtcctgtatttctgattttctgtctgtcagttgttgatagaagaattttgaactatctcactgttattgtggatttatctgtttttgcctttcagttttatttatctgtttttgccatacattatatatttatatatatatttatatatatatttaatatatataaatatatttttatatatatttgatatataaatatatttatatatatatttgatatataaatatgtttttatatatatttgatatataaatatgtttatatatatttgatatataaatatgtttatatatatttgatatataaatgtttatatatatttgatatataaatatatgtttatatatatttgatatataaatatatgtttatatatatttgatatataaatatatgtttatatatttaatatataaatatatgtttatatatttaatatataaatatatttttatatatttatatatatatttatatattaatatatatatttaatagataaatacatatatatttaatagataaatacatatatatttaatagataaatacatttatatatataatatatatatttaatatataaatacatttatatataatatatatatttaatagataaatatatttatctatttacatatttatatatatttatatatatataaatataaaatatttatatatatttacatgtatattataatatatatctttaatatgtcacattctcactttaagtagcattatatatgccactttacatatagtacacacaccttacaacagtatacttttatttcccccttccagcctttgtgttcttatcgtaacacctcttatttctacatgttataaacacaattcattgttattatttttgctttaaaaagttaatttaaaataatttttaaaataagggtaaagtctattatatttatccacttacttattccctacacttgtcattccttttttatagttgcagatttccatttgtatcatttttccttttatataaggacttctaaatttcttacagtgtaggtcagctagtgataaattctttcagtgtttatttgccttgaaaaagtctgtttttccttattttattaaatgttactatcatgtttatgtatattttcttttttttttttttctccgagacagagtctcactctgttgcccaggctggagtgcggtggcctgatctcagctcactgcaacttccgcctcccaggttcaagcaattctcctgcctcagcctcctgagtagctgggactacaggcacatgccaccacgtctggctaatttttgtatttttttagtagagagggggttttaccatgttggccaggctggtctcgaactgctgacctcgtgatccgcctgcttcagcctcccaaagtgctggggttacaggcgtgagctaccgcacccggcacgtttatgtacattttcaaaattatatgtgtgtttataaaaaaggatccctaacttttaaattttatgccactttatctttttttggtccattgaattttttttaattaatatactttcatttttagagcagttttaaatggacggaagaattgagcagaaattagaattcatatttatactctccccctttccccagtttcccttattaacatcttgcttttgtgtgctatatttgtttcaatcaatgaagcagtattcaggcaccaaggaaagcccataagattctctcttgtacattctgtgggctataacaaatgtatagtgacatttatctatcattacagtattaccagattagtttcattgggctgaaaatcctctatgcaccacctgttcatccctccttccctttctttccctgaactcctgataattaatggtcgtcttactctctctgtagttttgcctttttttagagtgtcatatagttggaatcatagagtatgattgaatgaattcatattggcttctttcacttagcaatgtgtgtttaagattcctccatgtcttttgcggattgacaccttaattctttttactaatattactgaatattccactgagtggatgtactgtagtttatccattccactattaaatgacatcttgatcactcttaagttttggcacttgtaaatgaagctactttaaacattcatgtgcaggttttgtgtggtaagttttcatctcaggtaaaatatcaagaatcatgattactggatggtatggtaagaccattgttagcttagtaagaaactgaagaactctcctccaaaggacctgtgctattttgtatccaataagcaatgggaatccctattccacagcctcaccagcatttgatgttttcagtgttttagacttcagccgttctaatagatccgtagtggtaatatctcactgtgttaattagaaattctctaatggcatattatattaagcgtcttttttttttcctattcagaaatgacaaattctttaaatcgacaaactcatcttcctcaagccccagaccatggtaggcagccctccctctccgtcccctcaccccaccccttagccacagtgaagggaatggaaaatgagaagccatgagggcctctgccagggaaggctgccccagatgtgtggtgagcacagtcagtgcagctgtggctggggcagcagctgccacaggctcctccctataaattaagttcctgcagccacagctgtgggagaagcatacttgtagaagcaaggccagtccagcatcagaaggcagaggcagcatcactgactcccagccatggaatgaacggagggcacagagctcagagacagaacaggccagggggaaaaaggagagacagaacaggccagggcatggcggtgagggactgaggcccctaaattttgatcccaggggaaaagaagaggccagttggtccagttttgatgggtatggggaagggaatgtattagtaagcacgggggagaggctgccaacaggcacctcagaggtgataggacaggctgaacccctcaccctgacagaagggagcttaagagctctggggctctctgggaatgtcactgctaaaatatatatctacatgtatattaaccactcgtgggagggcaggggcaaggcctggggtgggatcaaaggatctggtgtggcatccagtagccagtcatgcctgcctgagatgccccccatctgtagcccgatcacgttcttgccctcttgcagctggttatccgagaagttccgaggattctccttggatttcttagggaaccagttgggatccccagagaagagcccatcatcccaggctactgccaacccacccagattcctcagcgtccgctgcacacaggccatgttctttccttcccagaggtccacagtttggaagatgtcagtggtgttaatgccatagcgctcagctgcttgcaggaactgagagatcttctccatctgcttgaaggccatggtggaggcctggatcttctttactgggacctgccccttggggtacagtgcattattgagctcacataacaccgtgccatccttgagccagttctggaagttctcgcgtccaggctgggaccggcccacatcctttcggcactgggtggtgatccactggatcaggatctgctccagatctgcatcatactgtttctcaatcttctgctgcacctcctggctcaggccataatgcaggtcccctgttggccattccaatgggtggcggtggctgcggggagcgttcaaacgggctggagagcggcacactcactcaaggcaatggctgcagctgccgagcttcttcttacatgcttattttctacccagatatcctcttcattttcaaaggatattttcactagacagaattttcagttgatgaggttttatttcttttcagaactttaaaaatttactccattgttttctggcttgtgtttttctaaagtgaagtcttgcattatttttatgtttggtgttctgttaaaaaatgtgtctatctttggttgcacttaagatgttctatttatcactgattttgagcaattttattaggatgtgccctggtatatttttttctatttgttttgctgggggttcctttagcttggttctgtaggtttatagttcatgccaaatttggaaaatatttgaccagatttcttccaatattttttgcctcccatcctctctttcctcttctttgggaactccaattctgcatattttaggctacttaacattgggtctcacagctccctcatactccattcacttttttccttctcttttcattttggataattttaattgcttgtttttaaattcaccaattttttttctgccatggctaatctactcttaatcctatccagcatatttcatctcacacattgcaatttttctccctgtaagttcatactgggtcccttatattttccatatccatactgtgtataatcttctatattgttgaatatggttataataattgttttaacgtctttttttttgtactctgttacttctgggtctgtttgcgtttattgatttttctctttaatgtggttcatttttttctgtttatttacatgcctggtaatttttgattggctaccagacatcatgaattttatgtaattggatactgaatatttttgtattcctacatatattcttgcactttttatctgggacacagttatttcttgatcctattgtggcttttatttctttgatgatcacttggtaatggcttgttcataagttttgttaggaccagaatagcctttagtgtgtagctaatttttctccttactaagacaataatacacttgtaagtattctgaggctttgtaaatacaagatttttttttgctttaatgtttagtgagaacacgaactattcttactgtgtgggcgctgactattgattcttctgctcctttcaagtactctcttcttatcgttggatagctgcgatacatgtaggtggtaatcagtactcagttcaaagctggaagggaaccctttgtagacctctaaagctttctcactggacagtgctcatttctgggttgtttgtttgttttgcttgttttttctctgcctgtggactggaaactttctccactcagtatgcttcggtaatcaaagagctgatcttatgtgtttctccttattcaggtatcattgcctagcattccggtgtctgaaaatattatgtcacatattttgttcgtgtaagtttggtgtgtgtatgcatgtgtgtgtttattgtagttttaggcagcattagttcttgactagaagcagaagttcatttgatatctgaataaaaattttatttaaagatcaaagcaaagataaggtcattggcaggattaggaatgatctgcagcctagtgtttttggaacgtaatcccttgttataggctggctctgtgcattctgctgcacaaaaggagataagcaggaagtggtgctttctcatggaagtcgttttttcttttttcatcttcctacaagttgattatacaaaagattatttatgtaacaattatggaaacttattaacaataactataatggctaagttattgtggatgtaagactgaaaaaatatcagtacaagcttttctctttgctaggatggattcccaattataatgattttatctcttagtatttgcagaaatattgtaatgtaagtggtaatttttcttttgcagatagactttattttttttactttattttctaatagaaataatttctctttagaagattagtcaggtaattgcacgtaaggaaatggaagttgttaatacaaaagaataatctgtgcttaaagtttctgaagttcatgtggattaagtagatactttaattgaaaacgtcttgctcataatagtcttaatataatcctgataatatgtaggagttatgaaatattttaaaaataatgagatgggagtgctttggtataagcttatgattttcaacttgatcaaatgaatttgagaatttactttttcaagacattttcatgaattttatgttgaagaaatgtttctcttggcaaactcttgatttatggagaatgatgtctaacagattaccgcagaaagccccagctgtatgggaactttgagtgtgtagcagagggaaagaaacttaaagaatatatcagtgtgtctttttagtaatagcacataagggagattcctggaaagtaacattagcagattgatcagtctagtgggtaggacttcaaactctttctaatccaaaaagtagactcatggttttgagatgcttttcaaatgatttgtatagttacagtactaggattaaggtattaaggtatatagagaattaaaagcattatcagtatactgaggcttttctgtcatacatagctagttatcactgtctttgtgaaaatcttcctaaaagataaaatgtagtattatgctagtgaaccaaataattggttaaaactaatgcaaaagtgaaatttatgaaatggagagtaacctgaagtgtttcagagaatttagagcttgattttttttttatttctagttgattgcttggtttcctttctcaaataagtttacagaagatgggagagagaaagttatgaaagatcagaaacctttaaagttgtttttttttaatatcaaatatactctatccttgattatctacatcttggattatcctagacaatgtaaatgttctctacaatgtactttaccatctctcattgacttgagttggtatgtgacccaggaatacaaactgatgtgtatggatctcattaaaatattaattgaaagagaaataggctgtagtttatataaagttactccttatttaggtggtccacgtcctcaactaaaagaggtgctattcagagtttcatatggattccctctccctcaccaaactgcacacacacatatactcttctctccaatattgtgtgcattaactgtatgtgatcttgaacatccgcagtaactttttttcacttgtgattggatgaccattttctgtagatttactttttattttatcatttttaaaagcaatatctgccataacttaatttttatattcttaaagttgaaccaggtgaattcacagagctgaatatggacttgggaggaggatgtgatgccaaatcaatcaggatttgagtttttctttttctttggataagaagctatttagtttatttttaaaattctttctggctcttcatttttacagttacaggatatatagtggactgaaaatttgaaaatgaaattaaggaatgttgcacccttggagtgattatggattgtgacttggatacagaggaattatatatagcataaagcatgaactagctggacttcaaatcctagctgtttaggacaagtttccaggtgtttctcaccattagtttctctatcagtaaaatggaaatggttttacccatctcagagctatgattgtgaagatcaaataagcaatatgcatataaagcatggtacatataaagtattcaataaatattcatgttagtatgatcagctgcctgtggaccctagtttgctcatttataaagtaagaaggttaaacttttaagatttgtatcactatttatttatttatttgttttatttttttgagatggagtctcactctgttgcccaggctggagtgcagtggtgtgatttcagctcactgcaacctctgcctcatgggttcaagcgatttgcatgcctaagcctcccaagtagctgggattacaggcacatgccaccaggcccagctagtttgtgtttttcagtagagatggggtttcaccatgttggccaggaactcctggcctcaagtgatccacccactttggcctcccaaagtgctgggattacaggcgtaagccaccgtgcctgccctgtatcactatttatataaatatatttaaaattttatagcttttcatggtgagttaaaagtatatatacactatatactttagatgtcatataatctacttaattttacagatgaagaaataagcccagagactccttgcccaaggtcacaaatctaggtagtagtagagtcaagtggaaacagattttttaaagagatgttttaaagatattatactcttttccttttataatattatcaacattatttattgagtctgcactgtatacatgacactgtatttggtacttgtagtgagggaataacacaggaagcagtatgcaaattaacataaaaggtggcgcttcttaccttactgaagttacctttctgatatgaggtaactcagtattttactcagtttgcacattttatttccttacttgattgtctttggggaaatatgatattctacctctcctaaagaggagaatttactgggaaaacttgggttttaataaaaatggtttcatgagaatgccacagttcctgagtgtactatttttatatatggcctaacatcagaagaaaattagtaaaaatagctagataatttttgaagtatcaaccttgaggattaaatgttactttcttttttcaccttagggcacagtcagtggtgtgctgctagttacaccaaataatataatgtttgatccacataaaaatgaccctttggttcaagagaatggctgtgaggaatatggcatcatgtgtccaatggaagaggtgatgtcagctgcaatgtacaaagaaattttggatagcaaaataaaggaatctttacccatgtaagagtgatatttatattcctttgcaactttattgtatctagatagttgacccttgtctaataccttaactatttttactagttttcttatagctgccttttattttgtcaataatgaaacgaaaatatatgcattattgagaagattattcttaatttgcacctgggatagttatgaattatcttagatttgtatttgtgtatgtggtcagagaaccagatatttgaaaagtaacctatagtgcccatttaattcagtgtttaccagcctttttattcagacacagcttccagtcttctaaattacccctgtgagcaatcactgttgggataattttcaaatttcccttggaagtgactgaagagctgtgatttgagagaggccacatgagcaaagagctgacattgctgtgggcaagacagcttttttttttttaattgattgatttatatgtttgcaatcttctctcccagtataaaatacagtgtaaagtacagggaagaaaacccacaacttgctcaaatataaagagttaactttggaatatactggtcagaggatttgtgtgatatgttaagatagctgtgagactacagtttggacacagcttttgaaagtaatatgcttgtccaaagtaatggccagaaagaaaaggaggaatgggaaataaaaggagaaaaagataaaagataggtataaaaagaaaggaaggagaagtagcaaggaaggaaattgatatgtactaggaaataacctcctcattccttcatacatgactaccaacattttaaaattgtcttcactttaactgatactgatatttatatccctgtattagcccacaggaatgatagctgttttaaaattaacccttgtggggcagagcaacttacaaaggaaaaaagggacaaattatttttgtttctgaggaagactaaatgaattggtagaatatctgtgacagaataaaatcctttgctcaaaagtctccactgtaccttccacccaacagatattattttgacttggtagactaatctttagagctgcagataattcctagaaggtgttagtatcctctgtattagttatatttgtagatcatcatccaaggccagtttcagcaaataaggattattgggaggtggataatgggatgagacaaaggtaaaagagtgaaggattacattcaaagaagaggaaggatatatacatatatggagagagagagagagagagtcattggtgagattctgttgtcctccttttctttctttttctttttctttctttcttcttctttttttttttttttttttttttttttttttgagatggagtctcgctctatcacccaggctggaatgcaatagcacgatctgcaacatccacctcctgggttcaagcggttctcctgccttagccttccgagtagctgagaatacagacacctgccaccacatctggctaatttttgtatttttagtagagacggggtttcatcatgttggccaggttggtctcgaacccctgacctcaagtgatacactggcgtaggcctgccaaagtgctgagattataggtgtgagccacgatgcctggctttgtccttttccatttgcaatatggtactttggggttctcttattctgaacaatccatcactgttctacaaggatgctgtatagctcttccctttcaaatcactgttttgtcattcattgtcagctggaaagtgtcacctggatttaaatatttaaagatatttcttcagaaagaaatatctttaaattctgccttatggattgattaaaaacaatatttggcacaaaattagataaataaaacaaatgtatgccaaaaatgaggtataagatttgattgcttttcttctgtcttatgctccttgggaggttgatttcaaaggtattattatggtattacattcaacagtagtaacatcattgacataaatgtttagcctttcagcatattaaatctgaagagtatagcacttttctaaatatatatcctgtcacgtttgttatgtttatctcttacctaagggtcttctaattctttaaatgtacagataaaatttctcaaaacttttgcccggttccaacaccctatagatgcagtatgagtgcatcaccagtagatgacactattgtatatttaataacaaactagattcttgtttttttaagatgaatcagatacaaaggcagcagagatattgacttcaactaattaatacttcaaaaatttatccatcctagttatagaaattatgcatacttgttgcagaaaaattggaaaatactgaaaagcggaacaagacaaagagttacccagcttcaccattcagagatagccaattatttttgtgttgacttactttacaatctttccttttcagcatattttacatggttctcaaactatgtatgtataaatgttaatgcttttttcattaagaactcatataattttcatttatcacagacttcttgtaaccatcattttaaattagcaacttacatttcatggtatagaggtttacactccctctttccagaacttaacttttgaacattagtgtttacatatacaaatgtcattaaatctgaaagtctagacccagttatgaaccattcatttgtctagtatctaaacttttcacctgaacaagttctcttagaggtattaaagagtatagttgttagcctgaagattttctctatatacttttgcttgagttttattcagattggttttaagccttacatttgagccatatattttaatttaagctctatttgaatgtaaataagcactgtgtgtgtgtgtatatctatggaaatcagtttatttttactttattgggagatttaaaattttaattaaacatttctctgtgtttattttccatattccatcagtgagtaaattttagtttagaattacagctttacccagggtttatgtcatcaagttcccttcaagtggattacttgcaaggaaatcttactttgatatttcctaaatattaagcaattgatataaaagtttgacttaattacttgatttatagaattacttggtctataaggttaattatttggtcatattgaataaatcagattttttatattctttggagatacgtgctacatccttttgttaaaaagtctttttagtgatactaattctgtgttcagtgtgtgaaaagtaaaataccacaattttaaaagtctaattatttttaattttgtttaatgacagagatatagatcagctatcaggaagggacttctgccattcaaagaaaatgacaggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagtaagtgttatagagtaaatgaagttagttcatccaattgtatggtgtctccgtctttcctcactgactcaaaagccgctgtaccttagggcaacctgaaggataagtgagtgacccttgaccggtgattctctggggacaagtatatacagtctccagtgtctactgtcttttcttatcccacaggtggattgtacacataatgagcatcattgctacccaccatgtttaaacattcttggctcactacatcgtatcattaaacaatttatttcttgagaaattgcacaaaagctgtataatacctttgatcactccattttctcttaaaaagtttttggtgtgttaccattaaaaatgtcttttttcatatataacattttaattgccaaagttgtaatcccatcttttataaaatgtacagttaaacctaaaagtgtacttacagaattcttccacgtatcgagaagtttcatcatcatcatctaattattttcttttaaaaacctgccctcaggacaaataaaaacactattttatctgtcagttttctggtactgtttacttctgaaaattacactattttcagtcttttatttctaatatactgtgcttctgttaataaattatgggttaaatggggtataacaactaacttagctaacatttctgatattctattagaatgtttatcccagactagtccattcacatgtgaacttttctttcattttttaaattcaaagatttttgttttgctgtaatacataaaataaaatttaccatttaactttttaaaattatggtaaaatgtaacgtaaatatattatttgaagcatttttatatctacaatgcagtggcattagtacattcacattgttatgcagatcatcactactgtccatttccagagcttttttcatcttctaaaactgaaactctgtaccccttaaacaataagttggccaggcatggtggctcactcctgtaatcctatcactttgggaggctgaggcaggcagattgcttgaacctaggagttggagaacagcttgggcaccatggcaaaaccctgtttctacaaaaaaaaattacaaaaattcgtcagacatggtgatggtgcacacctgtaggcccaactactcgggagactaagatgggagaattgattgaacccaggaggtcgaggctgctatgagccatgatcatgccactgcactccagcctgagcaacagagcaagatgctgtctcaaacaaaaaaataaaaaacaaaaaccagtaacttgcttttctcccttcctcatagcttttggcaaccaacattctactttgtttctgaatttaactactctagatacttcatgtgagtggagtcatacaatatttatccattgatgtttggcttatttcacttgacataatgccttcaaagttcatttattctgtaatatgtgtcagaatttcctatctttttaaggctgaataatattccattgtatgtgtgtacattttgtctgttcatttgttgctggacattttggttgtttcaaccttttggctattgtgaataatgctgctttgaacattagtgtacaaatatctgtttgaatccctcctttgagttttttttgggtatattcccagagtggaattctggatcatgtggtaactctatgtttaatttcttgaggaacctccgtactgttttccatagtggctgcaccattttaccttccctgcggcagtacacaagatttgggtcagtttttaaaataccgaattttcttttcatcatgcagttgagatatcctgaagacctaagggctgtgttcagtagatattaaaataattcatatattaatacttgaaccaagttctataaaagatttaatatttttcttctgtaatatttttttaattcaaaactaatgcatgttcagtaaagaacatttggcaaacataggaagattctagaaaatttataaaaatcttctggaattcatcacccagagatgatcattgttaacattcaatatatctgtctttcttatagaacaaaatcatatgtgttaatttgttatttacatcaaatcaagattatactatactgttgtatcctgcttttttatgtcatgaaccttttcctatgtgattacagttctttgaaaacatggctttaaaggccctaaaatttatttaaccatttgcttattaagacatccagttgttattaacgatctgtattgttaagacattttaaagaatgctgcccagcattcttcaaaacatcaaagacagaaaatgcatctgatagttatcttatattttgaagatctttgactgcatctttgactacatctgatagttaccttatattataaaacctttgaaaaagataaaataatctgtttaagctgatgatgtggtggaccaattttgttgtgggggttgggggtttaatggggttaggggaggttattataaccaaatattaaaaggacaaaaattgatagatgtttttaaacagtcatctctaaactgttaccatttggtttcttctttttttggaataattagttttaagtaattttaagttacttaatattctgtaatagagaaatattcaaactttctgatctttatgactttataataaaattatgtaataaatataaaagtgtctagtccaattatgagaagaatggtgaaagctcatcgttttaaccacatgaaaatagtggggttcccatagattatctaccttgtgtaatactgcacagaaaaagccatgatgagtacccaggtctcctgactataagtgctatttcctccagtgtgctgccttggtaagctaatcaatgtctgggttcctaaattcacctatatattcagaccctcagtatactctatcagcacctctggttgaaagagttagaactaattcgttcttaattaactgtccaaacaggtggcagaatctaacatattattgactgttttattacaattttgtatacatgtaaaagcattagaaacttcattaaatttttgtctgaaacaaccatgttaagtatacctttaaaacttctacagttatttagatgtcattcaaaaagactgatagagaatatgtagaaaattatatatatattatgtgtgtgtatatatatatgattgctttagtatgggtgttgaaaatgtaacaatgtttctgaaacttttactttttttcttaatgtccttagacataatttttattcattaacttggctcttttgttaagtttagtcatgttgtatctgtgactttacctttgaaggaaaaaaaatataaattaagaaaatgtactttagcaccactaaagtgaggttttattctgtaactatttgtcagaattttgaaggtaaagttaactaaactacctaaacttggtgtgtgagaattgaataaacactgtttgcatctcaattctaggttctgcacttttaaaagaaaagcaaaggcatcgattacataagttcttgtgtctcagagttggaaaaccaatgaggaaaacgtttgtatctcaagcaagtgctacaatgcaacagtatgcacagagagataagaaacatgaatattggtttgctgtgccacaagaaaggtaaaaaacccatacgacaccttgagagcattattgagattctttgaactaaaattattttgtgtgtcaaaataccaatgataaactattgaaacatagtttatgattaaaagcagacaataagtctatttgaaaccattttgcccctactttataatttgccccatttttaattgcattcccttttgtagtttattatttaaaaatgtgaacaaatatccaatttgggtagtaaagagacttaagataccttggagcaagaagattcatcaaaatattatttgatatagctccttcctgaaggcagctaatggtgtataattcctttatattaaaaattcttcaaatattcattaaatatcttctatatacgtgacactaaattagctactaaaaggatgtagtggtcttcacaatatttgtgtgtaccctttgcacaattagatttttcatcataagttttaagcggttgtaaaagatgtctattgtactatcttgtcaatttttacattttaagtaaatagtgttacttatacccagtagaactgaaacattataacaactttccctgtactattattcacttaaaattactttaacagttagacattgcatcattactttttctctttaaacttctatttccataataccacctcacacaaactcattacaacgtactatatttttatccccattatagttctttgcaacaaactacatatacttaacacatttacatatctgtgtgtgtatattgaaattgcatttattttaacattttctgtgacttttgtaaaaacagtaaagggtttaaggttttaggctacctgcaagccaacaacttagtctgcctccatttggtgcatgctgggagaaagcacaaacatctgtacaacagcagtaatcagaacatcagcaattgtgtgatttctctgtacctcctttcctacaaaggatgtgaaaaaggccaagtgacagctgcacatacctggggttattttacagaagaggaaccataagtttagggaacctgaatttttataacagacagtaagcatggttaccctttgctagacagtaagatactatctctacttctaagataatgctacactaacatacttgaaaagatactgctgagcaaaggtattacacataaaaagtaaaatatcataggaaatgcctgtcttaaggagatagatagacctttcctatatccattgatagattaatatgtttcattgaaaggatgagataggactcagcatcagttctgcctctcccttttatttttctttataagtactgagaagctttgttcatagaaaagtcagtgagactgaagagagtttcattttaataatgtcattcaattatttaaacttgtttctatataattccaaaaattaatcatttttgtcacaatatttttagtgatcatcagtggacaactccattgaaaactccttcagttttgcggaaatcaattaatgagaaacaacctgacatacagaaggacttattacccagtctttataatcatttcctgtctcaacaccaatcttgggcagcctaaaagtttttatactgtagggcatatcccattgtaaattctgagtaggtgaagatatgcccttcttttataaattagaaaaagtgctttagtgaaagcagataacaggaaatctgtaaaatatcttgaccatactgtttttaggcagattattatgagcaaagagtaacatatggaaattggagatacgcgaattgattcccttagcaccatcttacacgtttgtgtacctcttggaaaatctttatatgttgctttggaagactacagcttttaggcataaaatgataatgctcttttcccttttcccactccaccatatatagagtaagtacaatgtgtgtcttccacaacattggcttaatcttaaaatatgatttgcataattgatgaatacctgaaagggacagagcctgatattcaaacgttccagtgatgttgaaatcactacaatgagaaatgtaactatatttagttaaaatggacataaaaatttagtttttctcattattcttggttttaatgtttacatggaattccctattttaatattcattcttttatcttggttaatattcattacaaattagtattattaggattctgatctttattgtagacataaaacttaggaaaactgctgcatagatagtgagaaattgataaaaaggtaagatgttacattgaaagataaaatgtagcaccttttaaatatgttagctgccacgtaaagaatggcaattttaaaaatcattatattgaaaatataatttctagaaccatggttattaactggtatatgttagctgaaagttatataatcaattttcaaaaacatgttaattaaaaccaataaaacgtagatatttgaaatgtgtgtgtgactctcaaatacatttatcagggaatgtaacaactggctttagtgtagtaaacaaaacattgaaaaggggaacctgagatttctaagattagatcatctgtctctcaacactgtatgttcctagtatcatttaaaatttaaggacattacatttctattaacttggaaaattgtatataatgtctcaaaataggccattaataaattgtttacttgtattttagatcattagattattgtaggaatgaggtcaaagttgtgtatctaatttccttttccatcactagtgtctttaaagaagaaaagctttataatatacaacatctgaactagtcaaacacatgccaaggaaaatcttaatttggttttctaaagaacaacctgacagaatatagccaaataaaatgtttaagttaatgccttcctgatagtagaccttttatattaatataaaacaatatattttgtgtatattttaagtcttcaagatttatcaagatattttacaaatataattttttaattctggcagcacagaatactaggtatattaatagtcacttctcctaacaggacagatcacttgtatgccttcttcattcagtggagtccagaaatatatgcagaagatactggcgaatataccagagaacctggatttatagtagtaaaaaagattgaggagtctgaaacaattgaggattctagtaatcaagcagcagccagagaatgggaggtaaggagaaaaatatgaagattttagtcatctttttagtttgtatgaatttatagctttatggtagtacaaagtataagtgatgtttccacaaaagaggaatttttttaaaggtcaggttcactatccgtgtttatttgtggttattgaatgaatctgaatagtgactttaatactatatttgtcattctgcttttgctttaaaatactagaaaacccactagcaataaaatgacttttattgagtgtcttatagaatatttagtttaggaaagattaacattatggcaaagaaggaaataattttaattttgctgttatattaattttcataaaacatcgatttcacatctgatttgttttaatttcatctcctccatggaggaggtacggcagtcatttaacacatctgtgcatagtatttgcatagcatctatacaaattactactcctttctatgtttcagacctaagcattatcttgacttaaatttttcaataataattttaaggaaataagcaggtgctaattttataaagtagtagaaattttatatgctcagatttactgaacttgtttaaatggtcaaagttatactaacaaactttttgtaactcctcttagatatatcttaagattacatattaccttttacatgctttgtcttataaggttggtagggtggcaatatctgttggtgttgcctagattagtctcttcttgatgcattagaaaatgtagagcagatgctaaaatgttataataaatgtaatcaaatttttttattcattgggtgttaatgtttgtggctgttaatgtgatatgaatgtatcttgcatgcacttaacatgtatagtaattgaaggtatacatggcttgtcttttgtttaaaatgcaaactgatttggaatgtgtctaatgtcattctgtgtagtatatacagcatcagtttctactgtgactccaatataagggagggaaagaagaacatatcgaccatgtattttgggttattttaatacttaaaccaacattatcaatcttcataccagctttattcataatggccccaaattggaaagtctcattagcaggagaatggatgaatacatttttgaatacttacagaattccaaataacaataaaaaagatctactggtacaggcaatgacatggatgaattttacaaataatatgttgagtaaaagaagcctgacacaaatgaacatatactatgtaatttcatttacacgaagttcaaaagggcaaaactagtcagaaatccatcacactacttgatactgggctgtgacagggtggctcagggacaggagggaactttattgcgttctggggatgttctatatgttactctcagtggtggttacttgggtgattacatatgtaaaatatatataatatatataatacgtatataatatatatatgtatcttatatatatatatattatatacatctatgtccctgagctgtgtttttaagattagctttagaaggtacttaaaatagcccaggtgatcaaagatacgtacctaactaaggcagcaacagttgaaggtagagtggaaggtgatgaaataaagctagaagaaaaggtattagctagctaattacacaggattcagtgacaacctggtaaccataaagttatctccagcttgggtggcacggtggatggcagaattgtcagtcatgaacgggaattgagagctttctctccattggggttggagtacttaactttggaaataagagactattgactattttgattcaaaggaactgtctcagtttctgtgcaagactctgcagggtataatttctaaaggaaaaataaatctcctcaccagtcctttgaccggaattggtgcagttcaaaagaaaatggaagagaaaaaaataattttggaaactccttgctacattgtctgaaaatattaccgcagtatccagtatagcagcactagccatatgtggctattgagtacttgaaattcatgtaatgccactaagggactgcatttttagttttaattattaattaaaaaccgatacttggttccattattggacaatttttaaatatattaggaataacttagatatatgatctactttttcaactgtaaatttcatgaaatctaaatatgatctaaatcagtctaaatctaattaaggtcaagtatttcctatgaaaatttagtgcctgaattgagatgtgctgtagtgtaaaatattctacttcctatagccactagccacatgtaaccattgagcatttaaaatgtggccaatctcaattgaaatgagctgtagtataaaatacacactggaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggtgggtgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaatacacactggattttaatgacttagaatggaaagaaaaaagaatgtaaacatcttgtttgtttatactgattaatattgaagtgataatattttgaatacattaggttaaataaactatattaatacaattaatttcacttttttaatgtggtgtctagaaaatttacaattgtaatgtatcttacattatattgctcttgtgcagtgcaggtctatgcctcatggatactaagtgcctaaaaaaatgtttgttaaactagggaggccgagggtaacaaataaaaaatgttaaactagggtggatcacgaggtcaggagtttgagaccagcctggccaatatggtaaaaccctgtctctactaaaaatacaaaaattagctggacgtggtagcacacgcctgtagtcccagttgctcgggaggctgaggcaggagaatcacttgaacctgggaggcggagattgcagtgagccaagatcacaccactgcactccagcctgggcaacagagtgagactccatctcaaaaaaaataaataaataaaataaaaatgtttgttaaactaatgagtactcatttaagtgaaagagtaattttaaatgttaacatgatttattttaaaacaggaagaatttggctaaagcccttatataaaacagtagtacttcagaatgtgccgtgatgttttttatttttttgttctacaaaggaatggagaataggtgtcctagaatttaggatgaacttgttatggctaccaacttgggcatcagttagatttaaactaacacctctactcactgttattctgctttagtgatacttaaaaaagatctttattatccctgactgttactcaagcagaaatatattgctagccagaaatgtatacattgactggggaagtttgtatatgataaatttggtaaacttattgtttgcttttttctccctttccctatgtaagtgtcataaggcagggatttgtcaatttcatacactattatatcttcagaactaagaattgtataggcatatagttcattctcaatatttattaatggataaacttgggcgtagattaaaattaaggtataaagcttctaatctttcaagattgctctatttcctgaaataagttcttacatcagttgtagtaaatattttcataaagccatagattctggacattttaactaatagtccacagtctgtcatttacatttttttttgttctgtttaaacatattcagtgaaagggaatttgttacctcaaagggcaatactttacattttaggacagctctgttagaaagttatttgttacaataagcttaaggaaacatatctttgtaaattggattcatttatctttattctgtcttccaatgcaagtcaataacaacaagaaacattttctatttactgcgatagtgtgaaaatgtttgtcttcccttttaatcttgtttcagaattattttttccagtacttcaactgtttaactttatgaactctattcagatcttattcatatcagtaccctaaaatatgttaaaagagttcataaactatggcaccccaaattactaaaatgtacacttgggatagcaggaaaaattccgtaatatttttaaaaattttaatttccaaatatgaacattgaagaccagtcctattgaagacagacagaaacatatatttactaagaaaaagaaaatttagccaaattttaaggtggtcaggagtaaaagttcctaatgataaatcagttcctaagtatttggataaaggatctgagaaatactattcttactgctcacgatgtgtaaaggactgaatttcctctttttgtagtgttactttgtatgccacatgataaagagtactttggtgtgggtcgggcgtggtggctcacgcctgtaatcccagcactttgggaggccgagacaggtggatcacgaggtcaggagatcgagaccatcctggctaacatggtgaaaccccgtctctactaaaaatacaaaaaattagccgggcgtggtggcgggcgcttcttgttgtagctactcgggaggctgaggcaggagaatggcgtgaacctgggaggtggagcgtgcagtgagccaagatcatgccactgcactgcagcctgggcgacagagcgagactccacctcaaaaaaaaaaaaaaggagctatgcctgaattaattgcgtcaacatggctgctattgataagaaagcatgtttttaaacaatcaaggcacaaaatgattaaggaaacctttcttcatagtgaaccaaacttatgtttttggtgtgatacccaaataaaagaaatatgcattatgagtcttgcttttggggatctgataaccttatttgataactgagaaggaactacttattacagtctttcccctgatttctgccggtattcaacacaggaagtcaataagtatatccagtgttgtgaggatactgtttgatgtggggctttgcagttctgtgataaatattactttctgttttttgatacagattttttatgccttttcactgaaaagggaagtgctctaatggcattttaacaaattgtcaggcaagtcctgaggtgaagatgaggcagaatgcctattgacatctgctatttcgtgatgatcgcacttttgttcaataaatatacaaaaataaaagattaatagtaaaacaaattcacatgtgccattcagcttcatcagcttatttcttctgtgtccctccttttctccaattgttcatagttattcaaatgtcataaaaatatttagaatacatgtaatatgtacagtatgtatttttacaatttgttttttgagtcatgatccaactaagttctcaaatgctgcagttagttaaaatatctcttaagtctctctaaatgtaggttcctcctccattgctttgctttgcttttttatttcagtttttaagaaatcagattttttttctgtagaatgtcacacagtctggaatatgctgtttgcatccccatagtgtctgttaacatgttattctaccacttgaatgattgatagatctagagcaatacacttaagtatagattatcatctttattttacagataatttctttgtatttttttatttattttattttttttgagatggagtctccgtctgtcgctcaggctggagtgcagtggcgtcatcttggctcactgcaagctccgcctcctggattcacgccattctcctgcctcagcttcccgagcagctgggactacaggcgcccgccaccacgcccggctaatttttttgtatttttagtagagacggagtttcatcgtgttagctaggatggtctcaatctcctgccctcatgatccgcctgccttggcctcccaaagtgctgggattacaggcgtgagccaccgtgtctggcccagataatttctttaagctggttttttatttggctaaaattctcttagtggttaatctctaattcagagcctataccttttccaccataccaagtactcaactttggcggaacctttgcatcatgatggggagctttcaaacatatcattgccaaggtcacaaatcagaccaattaaatcagaataattggggctaggacctagttatcagtgttgtttaaagctacctaggtagttacattgtgcagtcaaggtgcgaaaactagtataccaccatgccacaacttcaggtgttgtgttaaacatatacaatattaagactgtggaagactctttagactatattgattataatatagatcagcttttgagttcctgtcatgcaagttatatgaaatacttttcatattcctttcatctgggctgctgcatcaaaaacataaatttggttcactatggaaaaaggtttgtttaatcattttgtgccttgatttttaagaaaacatattttctcctcagtaacagccatgcagatacaattgatgttgtcatagctcccttacataccacaggacttccatcatgttgtgtactcagagatactacaaggagaggaagatcaaaaaacataccaggctgtaagtcaatgatctttgaactttgtcttcttcaactttgtccatcaaataccctttaaaatttaatatatttggcaagtgcctgaggatccagtagtatagcttaaaggagtgaccaccacaataagctcagattcatgtaaaacttttcattcagctttataatttatttgttgtaatataaagatgaatttggaatttcttatcatgaagtcaaaatggtaatactgtaagttgaatcgcttttatcctgccatcatttatcatgagacattacatgctggacaatatcagcatccaccccaagtaccaacttcaagaggctgtatactagaattttctgaaagtcaaggattcattgtgtcacatgttcagtatgccagtcttgctgcttgaccacacaggcctcaaaggtggagctttttatgctaacattgctttttggttcctttcctttggattgacttttccagtccttttgggataaaagctggcagagaaagctttccaaaatttttcatctctaattttataccacatgtacttcagtatctttcatactacaaacctaattaaagtatccagttctcctaggatgataaataaaaacagctaagaaactggttttattaaatcaactttacttgatttatttagtctcccacacatttacttgattaaattttaagaacgaatttactaagattatgtgttgatagggtgtgtaacagtatttttcattcttaaaatgattcgtatttgaataaaattgctctggcttccctcttgcttctcacctttgccaaaatactgataaaaagacattctgtacagttttggggttttgaaacaacctgtatctttttaggtacatgacattagtcacattttctcaataattgaagtttagattatttaagtataaatgtaaatatgttaactacttactatataaacctctatactattattcaaaatatgttagaatctgcctttcagcttagtttttaaaataatttatagtctttccattttgactttagtatttagtgctgtcccttttagttatataagtgtaaaatatgtaacccgttcttagcattgtaggccataacatttatcacattatgtcattgttggatttggtttttcactactatgtggtgattgccttgtggagccagttctgttttcacagctatcattaagtagagttatggtcaggatcattcattaggtttcccagaaaacttctacaaccgtggttattgctgcaacttttaagaaacaccttatcaggagacttcccttgtttggttaatatcttatttcctaagctgacaggcagtgagtattctggtgatcattttattaaacatatgttttctattattattaaggtacaagtaacaccaaaattaaaactgagttaatatgttaaacgcacaaaaccctcatgatctcttctcagtctagccagcaaaatccacatagaattaattttgtccaaaagtgaaggaattctttgtgtataaagtcactacattgagaaatcacatttctcagataaagggaatttttttaagtattctttttttttaatactgatcgaataatcaaataatattacaaattataactccagaagaaatttaataaatctaaaaaagaaatcagaaggattaaacacttaattagaatttattagttgataggtactgactttcataatacggtcatgcagcacataatgacattttggttggtcccctgagattataatggagctgtctcttagtgatgtcataacatcatagtacaatgcattaccctctctatgtttagatatattttgatacacaaatccttatcactgtgttacagtcacctatagtattcagtacagtaacgtgctatatggtatgacctagaagtaataggccataccgtataacctggttatatggtaggctattccatttaggtttgtgtaagtacacactgtgatgttcacaaaacgaaattgcttaaagatgcatttctcagaacatatccctgtcattatgtgatatatgactatatttctatgttgagaacctgtatagttacaaatgaaacttttagactgtttatgttttcttttattagcatttggcacccaggttttatgcctaatatggtctgttttgactactgattatgttatcttaaagttgttatcgaccttaggagagttttgaactagtgttttgctttccctgttaaaaatattcttcaattgctagcccaaagttatgagctataacatttccattaaaaatctttatctaggccaggcgtggtggctcacacctgtaatcccagcattttgggaggtcaaggcaagcagattacctgaggtcaggagttcgagaccagcctggccaatatggtgaaatcccatctctattaaaaatacaaaaattaggccaggtgcggtggctcatgcgtgtaatcccagcactttgggaggccgaggcaggtggatcatgaggtcaggagatcgagaccatcctcgctaacacggtgaaaccccgtctctactaaaaatataaaataaaatacaatagccaggtgtggtggtggatgcctgtagtcccagctactcaggaggctgaggcaggagaatggcatgaacccaggaggcgaaccttgcagtgagccgagatcgtgccactgcactccagcctgggcgacagagcaagcctctgtctcaaaaaaaaaaaaaaaaatacaaaaattagccgggcgtggtggcgcacacctgtgatcccagctactcaggactctgaggcaggataatcacttgaacccaggaggcggaggttacagtgagcagagatcatgtcattgtactccagcctgggcaacagagcaatactccatctcaaaacaaaaaacaaacaaacaaaaaacctctaatatagactgtcagaagaggatttatgggtgacagactagtttatgattttaaatattaaaattctaaaatattactttatttttaaatttattattattttttgagaaagggtcttgctgtgttgcccaggctggaatgcaatggcacactcacagctcactgcatcctcgaactcctgggctcaagaggtcctcctgcctcatcctcctcagtagatgggactacaggtatgtgccacctcatccagctaattttttttttttagagatagagtcttgctgtgttgcccacgctggtctcaatcttctaggctcaagtaatcctcctgcctcagcctcccaaagcactgggattacagccacctcacctggcataaaataataaatagtgagtagggtaaattatatattatagcttctatcataccattcccaactcaaataggaagagatataaggtaatttaataacttcagttcgaataaagtaaaggaaaaggattattaaattgaatatctgaattatgagaacagattatgttcaacttgtaaactggtagtgttttcaaaagtgctttgttttatatcccatcatgttataataataacaattgacatctgcttcaaattcttggatatctaggcaaatttaaatgacttagcaatatgtattataaatactacaaaaacagaaagggcaagaaggagacttactgagctcattttatgtttgcctgacactgtatttataaatttggatgacttcgagaaacagaaaaccacactcagaatagcttaaacctgttgtttctcgaagtgtagttcccagaccatcagcagcagcagcacctgggaatttgttagaaatgcaaattctcagaccccatttgagtctgattaattagaaaccatttttggagcccagcattctggtataacaaatactccaggtgatattgatgccggctaaaacttgaaagccactgatttaggtctctaatgactagttctgtccagagatgagagccagcctcctcagaaacacatggctggaaggatacctgagcaaaatcaaggccacttcaggaaggagttgtaagggtggatattgaataggcaaccaacagaatagactatgccatgcttggtggtttttggttttgtttttaatatctcatttaaacctcattttggaacacacgtcatatttgttattttagaaaatgtagctggaagttatgacaagctttcaaaatgctgcttccaccaccaccaccaccaaattatataatattgctgatggttgttaggagagtctgtgatggaggggtggagtgtgaccacaatgcactgtatgtagaagagaactttcctggtgtgaagataatgatggtgttcctatgagggactgtgggagagattttagggtaaatgtagtggggctgaatgagaggaataggggaaatggttggtatgtgggggaggtagggtgttactgtggggtgtgctgtgccctgtgtgagtgcatgctggaatgtggaggaaggagatgggagtgggggtttggttgggatgcagtattgcgtgttagaaaggtagtgtgtgtgtgaaaaggtggcatcatgtgtgcatacaacaaagtgaagtggaaggagctgctttaccttaaaatggaagaaattttcaaatgtatcatcatgatattgatattctgattaaaactgaattctagatagttttagtttatatgtatttgtagtttatatttaatctttaaaaaattcacttctttgcttatattcaaaatatcactggttagtgaagtatatgtaggcatagtgaatataactaccttttcaagaaattagatgttagaaaatgcaatttaaaaacagactgtgtaacaggcagagggattttcaggtcactttgaatatttgtgtaggatttatttgtagcatattggcttggtttttacacagtcattctgtaaaattttagggtggaagagtccacaaaaggcatcttattgcttaaaaaatgttcacataaaagatacaatcttatagtactgttagctgtaagtaaggaacataattttatgactatatgaacaaataacaaaatgttcattcaaatcattcatgtgctttaagagactctggaaattatatttactacttttttgttactgggttacttttagtatattcatgtactgatgtttggaaatataggctctgtgtctttaaacttttgagccctttctttgcacatttgggtacagtgcaaccaaacttaagcatgggaaattctctcttccctccccagctttacagcctccactcaggactatcattgctatggatactacttagtgattagctctctctcttgtcaatcaaatctttgtctctagcaaactgttttgtcactgtagtaaggctctagtgctggaaatttatctttgacagaggaagaatgcttttgaaaacagttcttacgtgattttatgtaacttaatttgccctggaaaggaaatgtctcgtctctggtatgggaaaaaagggagaagacatcaaccaattaatcataaatacactctggtaaatcttagtcaattattttaatttgtatatatactagtcttttcatggtgacattatgaaaaattatacaatttctgaaagtttaagcatagaggatatttatagaatacaaaattttatgattgtacaaagtaccttgaagttgtttctgttaattctgagtatcttcaaaaagggaaattaataagggactgtaattttgtttcatattaagtgttttgtatgttctacaccaacaggaagatatcaaatcttaattgttgccttaatgttttttattttagcttaactttttagaaaaatattcagaattttctcttgcttgaaaataaattgaatagaacagagtaaattaattattattgactggatctcaaaccagattcttttatgatattgtttacttaagggtataattttaagaatctgactaaaaggttttttaagctgttcaaaaagttttcaggcaatgctacctaatacaaatcttcaaacgatatcctagtaaggaaattcagtcaaccatactattgtaagaattttatttatttttctgtacgtgtacattgttataaaatgtattgtccattgctctttctgtggtaatttgggattatattttgcttatgaatgtttattttattttcacttaattgtagatgatttaaaatccaataaggactttggaagatgcccccaaagcagcttgccgcccttaaatgttaagtgtgtcaaaatattaaaattttaataggtgttatttttaattgtaatttcaaaattcatttatatgttacatcagcacagagggatttaggcacctgaaatgattgaatttttaaaatttgtgattagatttaccagataaatcagttaacaccgttgttttttttttaaaccaagaacaatgaagctattcatacattttttttatttgaagtttgaataatcatttattcttagtttgcaaagacttcaatacagtttattacaaatacaagcaaaataaattgtggttattctgaaatttataggtcaatctaattaatgtgcatcaaacacttacatttattacagtcaccacgtccaaggcctgttcattctttatttttatttttatttttgagacagggtctcactttgtcacccaggttggaatgcagtggcgggattttggctcacttcaacctgggctcctgggctcaagtgatcttcctgcctcagcccggcaagtagctgggactgcaagcatgcaccaccacagcccgctaatttttttgtattttttatagagactaggtttcgccttgttgcccaggctggacttgaactcctgagctcagctcaggagatctacctgccttggcctcccatagtgttaggattccaggccactgcgcccagccaagttctgttcattcttatgggaggctatataattttgtcagatactttatttcatgcctgagcaagaatgcttcctactcattggtcattagctctgcccatacatatatgttatttaattgaaccctcacagtaaccctgaaagtttagtagaattatttcccattttgaagactagttgaagcatggagtggtcactgaactaagttgtcatgtagtacagagacagcttgaccctagcacatattgtagttcaccaggatgactttgaagtttttctgaaatagaacaatatgatgtgttttgttgtgtagacaagctgaagtcccagttttctagttgttttctttgttttaaagcagagattctaggagctgtagggcaggcagctcttaagaaaattgggatgaaaaggattagcagttcttttacctgctttgtagattgagagccctgtaagattttgcctgacaaggggctcttatgcttctaaactggaaaaaaaaaaaaaaaaaaaaaaaattctaagagaataaccagtatttcagaacaaatgaaatttgactttttggagtttataatgtgtagctttttagaattcttcgtctttacccaacaaataatatggccatattattactacctctgtaagagagattatcactgaggtatctatagataccttgacagttttccaaatgcctatgtatgtagtatcacatgaccttacagtaaccctgtgtgttaaccagattgttttgttttataagtgagttaatttacatctcaaatacattaataactaataagcagcatacactcctaacaaaatgcatggcatgaaattaaccttttgccagttagcttcgatgagaaccatattgatcaagcatgcttaagttttgttatcttttattttttaaaggccgttttatagtttattctgataacttaaactttaatcattcatttatttgaagctattcatgtatttgatatattcatgtgccatactctaccttgttagtgtctgtcaataagtcgtaatttacttgaaattataagcccattttataataaggatttagtcttaatcaaagtcacaagtcattaaatagcatcagtgtttcattgcctttatcagtagtcactaatttcatcaccattttcttagtttaggccgtcatatatgaacagactttttttaaatttaggctttcatatatgaaaacacaggagaaaagtttgtatgtcgaattgtttacatctgttcaagaattagctgacaggtggatttttaggaagagctaatttaaatgtaaaaatctttccagtgacttcagcctgagataataactataatgataaaaataattacttgtactgacagtgtataccaaatattgttctaaacacttaatatgagttaccttatttaattctcacaaccctgtggaatattactttatcatctccattttacaagtgaaaaaacagggacatagcaatcatactacaactagtgcaagtcagagctgattttttaatctaggcattctggctctagctgatgcccttaaactctttgccatacttgccctcaaaaatcttcagaatataacaagaggaagagaattatttatttcatatatttaatgtatcagaacctattttatatatactttatacatattatttatttctcataaaatgtaaagtatttccatttgaagaatcagaaatggggaaactaaatgaggctccctaagttcacaaaactaataaaaatcagaatcaaaattaaggtagcagtctaaaaccaaagccagtattcttcaatattatgccgcctatctatagtagatagtcataagacatttattaaccagtatttatgtatgtcttatggtaagtgaaacatcttctgctctccagtcacaacctagttgaaaaaagtatacacatatattcaatgtagaatattttttcttaatttatttgactcaattgttttttatttttcatttaaagaaatttaatagcatagggggctttccagtgaaatttaatagcatagtggtcttccagtgaagaccagaaaacctgctagataaattctaagagagctgtaacactgactcagtagttgaaaagcatatatcttatgtatgcaagttatgaggcataatagtaaaatgaacatctgtgatgtaccactacccaatattagaactagaatatcactaatgtagctgcatctgtctgtgtgttttttctcatcttgtgtcaccctcatattggtaaccacctctctggattttttgttttattatccccctaactttttttaattataatagatttcattttttagatcagtattaggtttacagaaaaattgaatggaaggcatagagagtttccatatactctcttttccccaaaacacagttttccctgttattcacaaatgacattagtgtgatatatgttacagtgtatgaactaatattgatatattgtcatgcagagtctatagtttacattaaggttcattctttgagttgtatattctgtgggttttgacaagtgtataatgacatgtatctagttgtagaatcacatgctataatttttctgccctaaaaattccctgtgccacagctatttatcactcattcccttccagtgaacacctggcacccaccggtctttccactgttttgcgttttgcagagtgtcatatagttggaatcatatagtacgtagccttttcagattggcttctttcacttagcaatttttatttaagactccttcatgtctttttggcttgacagctcatttctttttattgctgaataatattctattttatggttttatccacttctttacccattcacctggtaaaggacattttgctttcttccaccttttggcacttatgaaaagaaactgttacaaacttttagatgtagattttgtgtggacataagttttcaactcataaataccaagtaacatgattactgtatcctatgttaagggtgtgtttgctaggccagtgtggtgactcacgcctgtaatatcaacactttaggaggctgaagtgggaggagtttgcgatcagccagggcaacatagttagaccttgtctttaaaaaaaaaaagaaagaaagaaaaaataagaaacaaagaaagaaagtaaaaagaaactgccaaactgtctttcatctggctgtacccattttgcatggcatccacaacaaatgagaattcctgttctccacatccctgctgacatttgctgttgtcagctctttggattttagcttttatttaaatagatgtgtagtgatatctcaatcattttaatttgcatttccctggtgacatatcatagtgagcatcctttcatagtcttattttccatttgtatatcttctttaatgagatgtttattcatatcttttgtccatattttaatcaggttgtttgatatcttactgttatgttttacataaacatagagatagaacagaccattgtctccttccttcctatctgtattccttcatatattttggataacagtcctttatcatttatatatgttgcagagattttctagtctgtagcttgtctttttcattctcttgacagtgtctttcacacagtagaagtttttaattttaatgaaattcaacttaataattttctttttcatggattgtacttgtggtattttatctaaaagtgcaccttcagacttagggtcaccaagatttttttcctgtgctattttctaggagatccatagttttgtgttttcctctgtagtccatttggtataaagactttgtctcaattgactgttctgcaggtggatatccagttgttccaatactattggggtaaagaccattatttctcctctgaattgtctttactcctttgttaaaagtcagttgactgtatttatgtgggatatttctgagtgttttattgtgtatcattgatgtatttgtcagttcttttgccaaaaccatgatgtattgattactgtagctttatagtatagtaagtcttgaagttgagtagtgtcagtcttccaactttgttctttttcttcattgctatcttggctattctgtgtctttgcatataaactatttctataaattttagaatcaatttgcctgtatctacaaaatagcctggtagaattttgattgaaattgtattgaatccatacatcaagttgagaagaactgacagcttgacaatattgagtcttcctatctatgaatgtgggatatgtatttaaatcttttgttaatcacagttttctactttttttcacgtagatctctatgtattttgttagaattatatgtatttcatttacattatgctaatataaatggtattctttttaactttcaaattccaagttttcattgctgatataaagaccattgacttttgcatattaatcttgcactctgaaagcctgccatgatcacttattccagtagagttttggttgattctttgggattttttataccaacaatcatgtcatctgctaacaaagacagttttatctctttcttccctatttatataactttaattttctttgaatttaatttatataactttgtcttattgcattagctaggacttcctgcataatgtcaggtaagagtactggcaagggatatcctttccttgctcccagtcttagtgtgaaaggatcttgtttctcactattatgtgttgtattaactgaatttttttaatacatgttctttatccagttgagggagttcttctttattcctaacttcctgagcatttttattagtgttggattttgactagtgcattttttgtatctgttgataagatcacatgatttttcttctttaccatgttgatgtaatagattacatcaattgattttcaaggctgtaccagtcttgcgtaggtgggataagttctacttcgtcgttgtatataattctgtacatttgtacattgctcaattcagtttgctagtgttttgttgagaatttttgcatatatgttaatgagagataattgcctgtagtttttctttcttgtaaagtttttatttctattagagtaatgctgtcctcacagaattagttaagaagtattccctccgcttctgttttctggaagagattgtggagagtttgtataatttcttcgtaaatgtttggtagtattcatcagtgagtctatctgggccttgtgctttctgttttaggaggttattaattattgattaattatttaaatacatatctttctttctttttttgagttggagttttgctatgttccctgggctggtcttgaactcataggctcaagtgatcctctcacctcagcctcctgagtagctgagataataggcatgcattatctgtttcttcttgtgtgacttttggtggtttgtgtctttcaaggaattggtttgctttatctagattatcaaattagtgagtgtacagtttatagtatttcttcattattcttttaatatccatgggatcagtaatgatggcccctcttcatttctgatatttattctctcactctcatctatcctggctagaggtagaggtttatcaattttattgaccttctgaaagattacaaaattggcttctggttccattgctgtttttctattgattttgtttttaatctattgatttctgctctaattttattttcctgtgcttcagatttaatttgattccatattctttcatctcttagcatctcagttatacttttttaaaaaacttttttaaatggttcctctagaatttgtaatacacattttttttagtatagtttacatggtgaaaccccgtctctacaaaaaatacaaaaattagccgtgcgtggtggcacacacctgtagtcccagcacacatctgtagtcccagctacttgggagactgaggcagaagaatcacttgaacccaggaggcagagattgcagtgagccgagattgtgccactgcactccagcctgagtgacagagggagactccgtctcaaaaaaaaaaaaaaaagaaaagaaaaaaaaaaggatatggggatatggctccctcccctcttccttcccttttttttccttttcccagtattgatgaaagacaggaagtgattttaaatgcagattttttcaaatcaaacttcactaatagaattaattctggatttttttttttttttttttaagacaggattttgctctgttgcccaggatggagtgcagtggcttgatcttggctcactgcagcctcaacctgctgggctcaggtgatccttccacgccaccaggcccggctaattttttgtatttttttgtagagacgagatttctccatgttgccccggctgttctcaaactggaatgttattttgaaagcagtagttttaatttgggcaaaatggggcaaagtttaacataattcaggtcttattttgtaataaagactgttaatatatgatgagatatagtagaacaacggcttatgtgacttcaaggatgctgttgtatgctctttttgtttgatacagaagctcagaattatatttccttctttaacatattttttgagaccaaagtaagtgtaagtggcattgattagatagtatttctttttctcttgcatttccatttactgagaaagtagtaaaaatggcacattgacatataactagcagatttttgttagtgtgcaagacattgaagaaagggagatttggggtttgttttggagtaatcttggggaaacactggaacgtccataaggtattgttctttatatctaagagatgaacgtgttcttaatcatgggattggcagcaactgtgaattttctctagtctctgtttttgttagtccatttgtaatagtgatgggtggatttacccctgcctttccattggtaattctgtagaagtaaaggcttaggaaaatactttctctttgtgagggtcctttgtcaaagactgaaaagactagagagtggcatttaattctgcagagtataggtcatggtacttagttcctatagataggagttagcagtatatccaaatactttattccttaagaaacgattttttagccagtgaatgcacttttaattggaaggtcttggttttctcaactgtttactcctaataattcagagcgtgataagggatattttggagaaatgtattcattttttatttaggtttaatcttttgggtaaagtaataaattgtatacatggagtatggtttaccaagggtttaaaattaatgtaagagtaattccagtttcctcatatatactgggaatatatagctcttttatccctttattttgagagaaggaagtatatttctgtactcaaattcaaatctcttttttctattaactcacagacttttttttttttcttacagttttctgtatcctcacccatcagggcatgagtaaatgtttaaggttaaggaagcagaaagtttttaagtcctagaaaaaaatataattgaaaaaaataaatttgaaagagtagatttgtgacatgaaagaaactatgactttatcaagtgttattaagataagcttagccttatggcgatttattgttctcttattagtaactcctactctcagcaatgctgatacaattaggttatgactgatctcttttgtaagcataatttaatttcacttccacccaggaagtgtttttcttatagtaaatgaaggagttttagaatatagatataagataattgttaactggagggatagaaggaaagcagagaattagataagttatttttgacaatccttgtctaggagactattggattgaaggccatgaaaaaagaaagaaaaatataattggccattaaatatttctagagacctgttttgctgggcatagaaaagcaagcccatgatgttttttatttttagtacctaatttttcttttatctttattgaaatcctattgttcttaattgaaagtccttcattatttttatctaatactgaaatataaaaattaaattcagaataatcaaaatgttaaaaatagttgagatgtcaaacctgaaatattctcattcaaaaataaaaaccaaaaattaataaggaggctctttggccattatcatttagtctccagggtaattggtgaaaagtaatcaagtaaaagtcatatgaataatagtagttctcattaatatgttctgggcactatactcagtccttaatatgcatttcctcagtaattcacataaaaccagatttgatatgcacttttactattttcattgttttataacaaaattgataggcaatggggaacccaggtttatctgacacccccccccatccgcccccagagctagagagaataacagcttctggtttctaagtacagagtcagctaacatattgtatgctttgttgcttcacaaaattcaatataataataatggccagaatggaaatctgtccagcctcttttccttttttctattctcatgtctttcagaactttcaacaagtttacatagcttttcatagttaccttaatgtttactggtagccagttccttttagttggctaaataaaaagcctttaaaacctaggttcaaaatctaaactctttatgagccagttggattaactcattttgtggtcagagcctctgtgcatttttgattgattacaagaggaactagtcatagctcaagagaatcgtcacatatttatcacaccattagcgttcactgtagtatggtaactgtttttagaattatgtcatgatctgaaaaagctgtaactattatgtcaacctgaggaaacttacctgtttttgtgggctttctgtaatagtgtttatctgtcatttatggctttcaaatttaatactgtgcaagagcctggtctaggcaattatagaagatagaaagttttcctttgaaagttaaaatgtaggaaagttgttaaattttagtcacaaataaatgatacagtaaaaaccataaagaaataaaacaggagagaggcaaaaagtggaaaaaaaaagtcatttaaagggctgaagcagacatacttagaaggtacttttgattagacatacttttgaaaatctaattttctactttctagagcttatttttcttattgccataggttttaaaatgtacttctatattgttttcttgctcttctctcctctgttgtttctgttatagatgggtatgtttgtcacctgtgcctagaagaaattcttccagcatggccattaggatataatgtttgagctcacctgatttggagggggtagttgaaactaccacttcctttgtaactgcaagaccgtttagttttcagacgttatctttaatgttagcaaagtatgtgttttatatagtgttttctgtataaaaaactataatttctatttactaagttgaatctatatggaatagtccataaaataaaccttacataccaactagttggatgtagtagtgaaaatcattcatggatatttcactctagtttgatatataaatctcttggattttcaacatagagtggggaagaaatcctaattacagttctcttcccattttaatttctcctcttttttttttttttttttttttttttgctgtttttctcaactgtcagtggaattattgtcttcctgtctccatatttaggtagtgtcagtggctgagtatcaccgcaggatcgatgctctaaatactgaagaactgcgcacactctgcagacgcctccaggtgcccccttcagtagtttaaacccctccagagactaaatactccctgtttttagtgttctttgtcatggcaaatctcatttgaagaatttgctttgactgcagcactaaaattaaattcctttttgtattaaaggttatagtattgccgtgaagagctgtggattatcttttctgtcatcttttcatttgaaaaatattctgaagaatgttctgtcacttcagaattattctcagtattgtgtgtttctttcagcgatgaggagttttcattcatttaacgttggaagaatggtgttggttttgagattgaatcttttctaaacaaaatctgaaagatatggtactataggaaaactaataaaaaatttaatagcaaggcttaaatattttatttaaggctatttcatttatatcagcgtcacatcaaatatctcaataggataaactgttcttgaggcattcttggttggtattaggagtacattggaatagtacagtttagacacagaactggataaattacttaaaattctgtgaaataatctttgtgattttttttttagaaacaagaaagcaatgtaattgaaaactcatttttaagttgtgtctattatactgtgtttctttcttcttaataagatatgctttcatggctctgctagacctgaattttttcttttaatgcttctaatgctgccttgggtttctttttctttttctttttacctttcacatcatcaaaataagggtgaaacatgatgatatgaaagaatgagtatttagcttcttgtcaaaaaacaatacacttatagaacatgtattggttgcaaatatatgctgctcaggtttgttaagaaacctgttaaaggaacaaaataatttagcaagaatttcattcccatatagaatcacagttgctgagcgttgctgcattttagttatctgctccaatagaattctgcatattttccaatttaaaagtttcataatgtttcatttcttttattttctaatattattatgttttatatattaaaataaaattaatattaaaaagtaagcaccaatagaatatattgtgcagtagtaagctttatttttacttagttaacattcttatcgttttaagaataccagtgaaatcatttccaccaagcaaaaaagcatgtattctttgtaatgcaacacattaatctaatttaaaaaataaatttatgaacaaattaacagtaaaatttattgtttggtccaagtagatgaaaaaaattaaatgtttagaaagttataaaaagaaagcatttaaaaaaatggtaacgtttgtcagtgaaacaaatacatgcacaactcacagaaaatagttatttttttttattctactattctttacattaaaattttggcacccaggaagttttgttcattatttttgacaaattttgtgttagcatgaaagaattctattttaaatagcatacacacacacacacacacacacacacacacacacacacacacacagcgcaagccagctagctgacttttgcccttcaagggcttaattaaagatgcatgcaactatcttctttacacagaaatatggggatttatcattcctaccagtcgttcctcatgtagtggatgagaaaacgtctgcttatattgttataaaatcttttcctacattggctacatcatagatattagatatgggccatcttttgccctataaaatcttaaggttaaagatttagccacattttctacgatataaagctttatttatctgaaaagtctgacaattttgaaagcatgtcacaagtttacattaatgcactacctctatttactgttttagattactacaagggaagacataaattcaaagcaggttgctacagtgaaagcagacctggagtctgaatcttttcgaccaaacctaagtgatcccagtgaacttttactgccagatcaaattgaaaaggtatgacatgctcacatatgtgcatttctgagtgtgagtgtgtacccatgagagtaaaacagcctctttttagttgtttctgaagcaacagcgttaatgctattactattccactccagtgaaaagaaagagtaagcaaaacatagcaactagtgttaattaagatgttaggagatttaggtaagcagacactaaaagccaatatttgttttattgttgtgtgcttgttacttgctttatgtggattatttcatgtagttgttacaacagctgtagaaattggatgctcttattatgcacattttttattaagttaaaaaatcgggagcacagagcgattaacttgttcaaggtcacacagggagaagtattaaagcttgattcctaacttggatagtctgtctccctagcctattatttaagagatattttaataatcaagctaatagtctatcaagtatttttgttaattcaatatggaaggcaaaagcattaagtaatctatgtttcttatctctgttctaatctgtgtctggttcagggtgattctttattttcctaatagacaattaatattttattctgagaaatgtgtaatacttttcaatcatcttagtatctttgagaataataatttctactgttaatttatttttatagcctatattatataggcaccattacattccagctggcattagtattctacataatgaacaacaagctatcaagtaaatactaacactttgttttctaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtatgaaacaccaactgcatagattgcttatcctttaagagcagtaacagtaacttttagcatatttatttgataaacattactttattagtgcattttattgtttaactgataattactgggtacttttaatatgcaaggcaatgttgagtattacagaggatagatatgagcatgatgattaagaattactgccttcaaagggattatagagtggtagaaaagaacatttgcacataccaacatctctaatggtggggaaaatggtaggtttcttagaacctagaaaaagtgaggaaataagaatgaggttcatgggaaaggtagaaattgacagaatcttgaataatgggtgaagttttgattaaagataattgtttgaaggtgatagccagaacaaaagcacaaataagagtaatattggtttgttcttcaaacagcaagttcaagtcagttgtaattggaaactaatgagaaggtaaaatagcaatattagaacaaaacactggtattactaacacttttagtgttttatgtgtcaggaacttgactaatcacttatgcattatgttatttaatcatgaaagccctatgagattgatactgttatctttatattaaagaatgagtcaactatgacataagctcatcaacttgcccaaggttacatacccaagaaaaagtatttgcaccaatgaaaatgaatgaactgctgctacatgccatggcataaatgaatgtcacaaacataatattgaattagaaatcaaacaccagagagtaactttcttatgatttcatttatagaaagttttatcagtgggccaaatgaatctatagtggtattaggctagtaactccttcaggtagttgagactattgatgagaggaagcacaaagagagcttctagaactagtagtgttctgtttcttggtctgaatgaatgttgcatgggactttgccatgtgatagttctaaactgagctatgtgtttatgttttgtgtacttttctataatgtatatgtaaaataacctttcaataaggaaatattttcaaaattaagactataaagatagaatgtcaggatagacagtgactgtacagattatctgtcagactctctgcactcccatttctgatgtggaaacttcagcccataacactgaaattacttggtcaatctcttattcatcaattttctcattagggtactgtgtgtcttgtataagatcatgcacagggttaaaggacaaaacaattcacacataacacctgccctcatggaatttactgtataatgataaagaaaaaatatcatattttaaaagtgatagaatgtttccctatactgaaggacttattttattaagcaccgcaatcccatagcatcatgttatccatatcatacatacattgtacatataagtcgtcctgaaatgtgttaaccactttttaagattgtctgcttaattactttaaataaaatcccaaaatttaaaaactaggaaaaaatctgtatttccattgaaaaaccaatatacttcatatttgacaataatgtaaattatatagcagctaaccatttttccctttttaagtatgattagattaaactataccagatttctattttttgcattttatttaaacatatatgatgaaataatgcttactggaataaatttgttagtcgtgtcattgaatatgccttttttatccttaggtttttggtgcgttagcatctgagccactgaaagtgagtgatggcttttatggtactggagagacctttgtttttacattctgtccggagtttgaggtaagaaccactatttcaatattttatttataaagagttgacataacatactgcccaaagcaatttatagattcagtgctattcccattaaactaccactgatattcttcacagaattaggaaaaactattttaaagttcatgtggaacccaaaaagagcccaaatagccaagagaatgctaagcataaagaacaaagctggaggcatcacgttacgtgacttcaaagtatactacaaggctacagtaaccaaaatagcatggtactggtataagaacagacacatagaccaatggaacagaatagagaactcagaaataagacctcacacctgtaaccatctgatctttgacaaacctgacaaaaataagcaatagggaaaggattccctatttaataaattgtgctgggagaactggctagctatgtgcagaaaattgaaactgaaccccttccgtaaaccatatacaaacattaactcaagatgggatagagacttaaatgtacaacccaaaattataaaaaccctagaagaaaatctaggcaataccatttaggacatagatacgggcaaagatttcatgacaacaatgccaaaagcagttgcaacagaagcaaaaattggcaaatgggatctaattaaagagcttctgtacagcaaaataaactatcatcagagtgaacagacagcctacagaataggagaaaatttttgcaatctatccatctgacaaaggtctaatatccagaatctacaaggaacttaagcaaatttgcaagaaaaaaaacaccattgaaaagtgggcaaagacacttttcaaaagaagacatacatgtggccaaaaaaacctgtgaaataaagctcaacatcactgatcattagagaaatgcatatcaaaaccacaatgaggtaccatctcactccagtcagaatggctattattaaaaagtcaaataacagatgctggcaaggttgcagagaaaaaggaatgttttattttgttgttgttgttgttgtttttgaggcagagtcttgctgtgtcgcccaggctggagtgcagtggcatgatctcagctcagtgcagcctttgccttccaggttcaagcaattctcctgcctcagcctcccaagtagctgggattacaggtgtacacaccatgcctggctaatttttgtatttttagtagagacggggttttgccatgttggccaggctggtctcgaactcctgacctcaggtgatccaccctcctcggcctcccagagtgctgggattacaggcgtgagccaccacgcccaactgaaaaaggaatgtttttaccctgttggtgggagtgtaaattagttcaactgttgtagaagacagtgtggcaattcctcaaagacctagaggcagaaataccacttgacccagcaaatcccattactgggtatttacccaaaggaatgtaagtcctcctaatataaagatacatgcacacaaatgttcattgtagcactattcacaatagcaaagacatggaatcaacctaaatgcccatcgatgatagactggataaagaaaatgtggtacatatacaccatggaatacaccatatacaccatgcaaactaatgcaggaacaggaaactaaacaccacatgttctcacttataagaaagagctgaatgatgagaacacatggacacatttcaggggaacaacacagaccttgtgtctgtcgcagggtgagggtgtggggagggagaggagagcatcagaaataatagctaatggatgctgggcttaatacctagttgatcggatgatctgtgcagcaaaccactgtggcacacgtttacctgtgtaacaaacctgtgcatcctgcacatgtactcctgaacttaaaagttaaaggaaaaaaaagagaaagagatggcataaatgaaaaaaccatgcactttggagtcatgcaagttgcatctgtcccctatctttgccttttactccctggtaacttttctttgaccattttgaacttcaactttcctgtagatagaatgaggaatcataaaatatggcatgatcatttaataattaaatgaggatcatttatatataatacttgggatggcaccaaacacaaattatggacttagtaaagaatatacattatcattactattctgtttacaaattgtcattgtgaaatttccagaaacatttaatgactaagcttaatgatgtaagtcatgaaagcataaaaaataaattatttggatttaaataacaagttattgactggtttctttttctttacctgtgtggctttactgtggcttgactaacacaaattgaatacattctcatgccaataaaatctaaaatgtaaaggtataaatgaattttagtgaatgtgtgactattcttaaaacattgagtgcaatattagtatctcgggcacattggagtgtggcatgtaaaaccttcattttaatctcaagaaaaggaatcaacaccattggttataaaaataaatgaagaaaataggaacgatttggtaacacaataaaaattcttttagcaaatttgtacttaactagctcaccagaataaccaatgcttttcattccttccataaaatatgtcaactgatagcaacagctacttgaaagcttgtagttattacagattttctaagcatcagtggtgcctattctcaaactttttatgttactgctacctgataagtgtaataatgtagtcaattaaatgttacataactatgaaaaacgagtgctaaaagaaagttttattgaaaactgtaatgaacacattttaaaaacttgataaaagtaagttgctagaaattgctactatgttaggtttaggtaaaacacccataaaaggttagaaaaagatatttaagaatattcatgtctagtttgctcttggatttctcaaatgattttaagttctcactgtttaaagaaattgaaactgaaaatcataaatacccattatggtcatggtttatttaagaactgtgatcagtaaatatatatgcaaagaaaaggccttggccctatgttaaaatattatccaattaacatacatttctgtttaatggtaaaagttaatggcatttgtgtccgattttttttcaactcatttacttctttctcaattttttctattaaccgtccaactcttggtgtctgtagagtcaggagaaagaagtatgtgtgaaaagttaacaaaattttgagaaattggaattgaaagttaagtgatagagtgtgtgctttcaaatttagtcatataaacactgaaacccaaaccaccagagccttctgtgcggagctttttgtggtgttcttattcttatactgccagtcttggctttgttaactcgtttgagttttggagaactaactctctataataaccatttcatctatatatttaaagctttttttaaatttatataggtctttaagtggacaggagataatatgttttttatcaaaggagacatggattcactagctttcggtggtggagggtaagtctcttgaacatttcactatgagatttttgaagaactttaaaaatgcatttggattatttataaattcagttgtctttagaaagtgttgacgttagaattcaaatttgtatattatgaaaaagagagtataatgtatttgcaagaagtagctcaagtgtagttattgaaactattgatggagtatttgtttcttcattttaaaatactgttcagtttattcactgtttattaagacccatctttttctttagagcacagtggctctttgataatataaagggaaatatctcagtacctttgaacttctctaatttttaaataactgtgatggaatattttatttctcccaatgcatagaacaagtccaattgttttcatgttattctactctggagaccatttggaatgatattttagacaataatggaaatggggtttttgcttgcttgttttttaacaattatgaatcagacaataatgtgattatcttggcattgcaagtactgtgaggagctttgttttttatttggtatcccagcctcctttaatctttgcattgttgggaggtaggctgctctggtcccacctagcctgggcttagcaagcaacaactccttcctttggtatttctgtctttcagtattagacatgggtatgctaaataattttcagacttgtaaaagtgttacattatttgtatcccacagttgaggatatataatgataatttattcagaccaccaaagaatattcatcatcccaggttattctattattaacaaattttcttacaacttctctgtaagtaggtgtttggaggatataagtagggtgattaaaaagtgatcatggttattgtagccttctctgttagttttagttgttgaactcagcatgtatttacatggtccaattataccttttggggggggtatcattcagccctcccctaaacagtagtcttacatgtgattctgttagctctccaacaggtccactcaatctagtggcttataatttcaagattttatgggtgctttaagtcttcaaaaatgtcatacacaatgccattagatgtctgctggaactagattttattgtacaacatgatttcaccaagctagagtaaccactgggttatttgataataaattaatataagttttcagtgtttaaaggagagtacagcttcagaaagcagaaactacagggagttgatattccagaattccaagggaaaagcaccccaaaagaaaaatgatgtagtggacttaatgtaggctttggagtccaatagacatgattcagattctcacttcaacatatgctgtatgtggtaccttgagcaaactccttaacaaatctaaactttccttagctataaattggagattaaaccagttttgtagagagattataaggaattcacaaggatataatttttgtgcaaatcctagtatagtatctggcatatagtaagtactcaacaactgatagccacctaaactgatagccacctttactcattttctttcatccaacatgatctgttcccttctgataccaggaagaattctgcctgcagtatcattggctgcatgagctataagacattaattaaagatttagaagactacttttattccttccacttccttagccattctcttttcagaaagtcgtatgaatcatctttgaaagcattgctcatataaaaatacactttctggctttctgggtgtttcacctgggacagatctgtaacctcttaaatacatttacttaaatatttggatatcacatacctttttgaaatgctgatgaaatgcagaggtacccattgtcctaaaatgaatatacaaataatccaattttatatgtgatattaagaaattgacaaaaatgttgaaagcttctactcagggcttcagaaaattcaggttaccttggaaaaaactattcatacttggtaataaaacttactgcagcatcagtgacattcatgaatcttgaaggtcaattttgaggtactacttagatgcagtcatctgagattacaactagatgtcttaatcttttattaaccctttcatatttagcagaaggtttttatgagcaagtctgaccctttcatattctcctttctaatagattggctatgatagtctattcgcgcttttaaggctcatggattcagatatctctttaaaggcatgttgttgccagtagagttagagtctctagaagtctattgtcataagaccataaactttttaattcaaatgcgtttctaatttatctctgtattttccagtgccagtgtctgaaacatgataaatgcacatttaaagttgaacaaattagacaaatatgaatttcaatttgaaccttaacaaatgatggcttcctcatgggacagggggcattttggggacgatatagttttgcagtgcttctgtatcacagactctggattgttatgattttcagggtgttcttgtatcttagcaaagtcccattttcatttatagaagaggttcatcagaacgtcatcactggttatcccattacagtttttttgtactgtcaactctcttcttgagtgacactggatgatctctttacctggtcattgtgaattactatactgatctgtcttttctgttttgttgtgaagtaccaactctttttttttttttttttttttttttttttttgagatggagtttcactcttgtcgcccaggctggagtgcaatggcacaatcttggctcactgtaacctctgcctcccaagttcaaatgattcccctgcctcagcctcccaagcagctggaattacaggcgcccaccaccacgcctagctaacttttgtattttttattagagacagggtttcgccatgttggccaggcaggtcgcaaactactgacctcaggggatccaccagcctcagcctcccaaagtgctgggattataggcgtgaggcactgcacccggccccaactcttaaaggaaccattctacatggtcactgtagccaccttctctacttagaaacacatctctatacttaaaatttgtatatgtaattaatatacattatatatttgatgctgttttttattacagagtataaataaatagttcctttcttttgttctaagatagtgttaaaaatagatcagttccaggccaggcacggtggctcacgcctgtaatcccagcactttgggaggctgaggcgggtggatcacaaggtcaggagatcgataccatcctggctaacacagtgaaatcccatctctactaaaaaacagaaaaaattagccgggcgtggtggcaggcacctgtagtcccagctatttgggaggctaaggcaggagaatggcgtgaacccaggaggcggagcttgcagtgcgccaagatcacgccactgcactccagctagggtgacagagcgagactctgtctcaaaaaaaaaaaaaaaaataggtcagttcctctcccacacaagtcagttaactctgtaatgccatgtgactcctgatggcaagcctgaaggtcagaggttatagccacccaaattatagagttgtgtaagtctttacaattacctaatatgcttttcttttttgtgtgttttaatataattgacaaactctaccccagagaggttaagtgacttaactaagtttgacataagttgtggccactgagttgacagacaagtcttgatcccagaccagtttttttctttcaatgaaatataactgcccatattttttaaaaaagcctccgcctcctaaactctggctcaattctgctgacttgatatattactttagatttagagaatcccaagggatagctctctggatattatgttaattaatagtctttgccccctctcctcttctattaggtaggaaaacattttctagagaatagaaagaagtcctctcataacctggtgttttcccctctcggttatgtattagataattagataaattggaccttataatctatctgttaagttcctgttatacctagattatatcttggttcttctgcttgaatctcaacatcacatatttgtccatttaaagtcctttcaaactgagctcttttgcaaacagcttcctatgcaggaaaccagagttatttactaggtccttaacatgaatccccaaattttattttagatgatactgaatttttgtgcctttgcgaaagtcatgttaaatatgttaaaaccataccgaaaagataaacacacacatacacaaaaaaaaaaccatactaaaaaaaatacccaaagaaaaactcataataccaggcaaaaaattacagcgtagtacctgtctcaaaagctaatcctatataaagttcattatagaggacactgttcctggtctgtatcataaataatttttttcttttcttttcttttcttttttttttttttttttgagacagagtttcactcttgtcgcgcaggctggagtgcaatggtgcaatcttggctcattgcaacctccgcctcctgggttcaagtgcttctcctgcctctgcctcccgagtagctgggattacaggcatgtgccaccgcgcctggctaattttttttgtattttttagtagagacagggtttctccatgttggtcaggctggtcttgaactcccgacctcaggtgatccgctggcctcggcctcccaaagtgctgggattacaggcatgagccaccacacccggcccataaataattttttaatggaataggagtaaaacaaaattgtgtcagtgtggaaaggagtagggaaggatttgagaaaattaataactttagggttgttaggtattcaaagtctcatttaaattgttttataacttaaggcataaatattaacagattattatttatgtattgcagaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtgtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttccccttcggtcttccacagcagtattattgtctttgtggagttgactaatgataatttaaaaatcctgtaatggatttctactaaaataaggtcatagtggcatataccaaataaaatcaaatacagaaatacaa

SEQ ID NO: 1469 - DNA, 95377 bp, Homo sapiens
tgatgttgaattagaatgtgttttaataacctgaacaaataacagattttccattcacaaacccataaccttatgtcactgaagagggcatcaaattctacaaacaccctttacatatttcttctggaccaaatgttaaaatactcttgcatttcttccagagatgcactgcattaccagcatgcatatgaaaaaatttctgttgactaaagcagcagtcttggcaattctgaaccatgtgctattcttactataagtctaaattgggtagttcgagtgaccaaccagtttgttcagctttgctaaaaatatgcccatgtttgcccaaatgacctggcttgctggtaatctcccacctttccgagtcaatcaacacatggaaagtgctcaaaataagcagggattagagtcacaaactcagctggaggagcttgcttttttaaaacacagcactcctgtagttattttcttcatgttattctgtctttactgttgagattctggtgtacacattaatgctgctcacgagtacctccatttcttctctgttcagcacacgataggtttgtacttgcccacaatgtgcagttgccctctgtatctgagagttctgcaaactgcagattaactaaccacagatcaaaatattgagaaaagaaaataataaaaaataacaatatgaaaataaaaataatacaaataaaaaggtgatacagtataatcactatttatacaacatttacattgtattaggcattataaataatccagagattatttaaaatgttcaggaggatgtgcataggttatatgcaaatactactctaatttatataagggatttgagcatcctgggattttggtagggggaaggtggtcatgtaactaatccccagtggataccgaggaacaaccatacttctttaggttggcatcacatacttggtctggcagtatttaagagctgccatacagttcttcccttctgtgtgcagtggagtctagtgatgcttgaagcctccaatagcctgagtctctgatgaggacaatgtgctgccaagtccccacagctgatccccaacagacatgttatatgggggcaaagaccttttgtcatttttaaatgctaagacttggggatttgttgttgttgttgctgctgctactatatatcctaatctttgtgactgggataggttccttcacattcttgataggaaggaaaacacgaactttcaatttaaggaaatatgacaaacagtacagttggcagaaagtgaagaggtttggattcaaatgcaactagttttaatactatctttgcaacttacttgctctctgagtcttctttttctcatctgaaaaagagtaataacagtataagcttgctataatttaatatgcaaagttcctagaaggatgctaaaccacagatgatgttcaatgaaaatagctatttctgtgaggggtaatggtaaatagactaaaagtatagcaaaagataaacaacatgggcatggctgaatctgaagagactacagaaatggggaacactgtcattcatcccctcggttctgcctaccaagcatctcctagtcataggcatgcttttctgtctcttctgtgttcaactcatgctttccctgtcccgtccccactcctctgtcacacgctgctcccaggaaagtatatagaaatcactcactaagatagctgcattttaacaggaattaagttaaagggctaaagctccaacttagtattttaggccttaggtggaaaagggcagtggatatctctcacctgaacccaggctggccaagaggatccatctagcttaattatgtccactttttgggtccactaacctaggaaggtctattggaccagtctttataaaagacttttatgaggcttcattttgtgaagctgtccagatctgctggaaagactaccattatagtttggcaggatcttctgtggggtcaggagtggggactggcagtactagtgctgtatgtcgacattactcttaaaaatgttcagacagtcttaacatagtctcctcatattaatcctcacagcaatcctgcaaatgggcattaagatctttgtcatagatgatggaactgaagcttaaagcttttaaatcatttacccaaattcacgtatatgataggtggaagagtctatattccaaaaccagtacctctgatttcaagtttaatatccttttttcccctttcactattacagttttctctgtgtgagaaagtaaattcaatagggtctcttgatggcattttgctatcatgtaatacaaatatttcttttttgttgttacatagttgggaatttgaaattctgttttctacattcaacactaaaaggaagaaaaaacacatgaccgttaaaaaaaagaaactacaaatatactactgaaaatgaaattaaagtaaggtattctatattgtcatgttttctggctaaaataatacccacagtttcagagaattttaatctctacctatatgaaaaaagagagaagcgaatagggaaggaagctaagattttagtctcatcatttctttaagaaactataattattttcttatggctaacataatttctaacatcaatctatttgcagtcagttgtaaacattgaaaatgttttgaaacttacagtggaaatacagaatttgtagccagacaaacttgagtttgaattctaataacaccacataaatctataggccttgaggaagtaagttaattaagccataaattagagatgagcctcaagcttcttatctctgaaatgaaagtttataataataatctcatagaaaggtggtggctatcacatgacatagtagatataaagcacttatagattataaacttttttaaagtttacttcccttttctctttgcatcagatagattctcatcattctagaaataacctgattcttattcccaagtagtgcacaatcaagtggattttattcacttagtaagtattcaaagagagaaagcgagaaacagagaagaaagatggaggaaaggaagaagggaaggaagataaggaggaagggagagaggggaaaagtcctactaagaaaaacaatactaaaatcagatggagacatgttccttctctgcatgatctaatattgttctgttagtagagattggaagtacttggagttatccatcctgcccttgtcctctttccccagtagaaatacaggaaataaaaaaagttttataacacttctgataatatcactagaaattggtcattagttctcaaagcagaacttcttgcttgatatatatttggccctatttgattttatcattcattcaagggtggaattgttacagaaatatattctagggtcactaatcccatcactatgcacaattatacatttattttttggacaactgtccagattccaaatgtaaacctgaaagacctaaagaaatttttcaacacccagtctaggattgatcttaactggactttggctgtctatggcatctcaagtagctatttccaacttcactgtagaggacagccattacaggtttgggcagctatctccaccatgagaaagagttaattttttgtataattttgaagtctgagtgaagttgaagtgtgaattcattacaggatatcgtgaatgttgttaagtggatcatacgaatgcagttccctctatatttcctataatgatttgtatatactctaagtaattacaggcatttatatttataattagccttttgggggaaccattttaagaaaatgatttgtccagctgtgtaccagattagtatcagccaggtgtttgtcaaataccaccgtaactgggaaaacacagcaagaagtgttgatacaaaaagaactttggaaatatgcttaaagtttcattttttttttttccaaaaatagttgcatcacttcttagaacacaagtacatgtctttcaaacatgacttttttctttaaaaagtggggcatgagtacacaaatacagtgatgaaatgaaaaaatataatcaatggaattttactggcacaacgtaaaggtcaggataagactaacaatacaagcattagaaacaacactgagcaatgttctgaatgatcatgaactgcctttagaggcttctaaagcaccaagatgaattggtgccaacaactggactatggagtcaagataccagcagaggcagttgacccaaactcaagatgaaacttttataaataaatataggctgtgtggtggctcacagctgtaatcctgacactttgggaagcggaagtgggcagatcacttgaggccaggggttcgagaacagcctggccaacatggtgaaaccccatctcgacaaaaattagccaggtgaggtggcccatgcctgtaatcccagctacttgggaggttgaggcaggagaatcgcttgagccagggagtcggaggttcctgtgaggcgagattttgtcactgcactccagcctaggtgacagaacaagactctgtcttaataatagtaacaatagaagtaaagctgtttgttatattcttgtgaagatttgtctgtgtacaggacagaatcgtaaattaaaatccccaaataagaaagtctgagtcaagaaggcaacagtgagacaactattaacctctgttttcggtaataacatcatacatctattcgaatgtccccttgtccaaagaattatgtaaaccttaatcatcttttaaatgggcatcatctgatttcctttcaaacttcaacccctaaatgagtatattgttctgatttggaaactaccagggagaaatctgactattcaaagcagtgaagtcaacctgagttgataacgtaactgcaggcattcctacaacatttcatcctctccaatataaatagagcaatttgaccttcatttaacttgatcatttaaaatccattatgaacaacataaatatctttcccaccatgtgctttaaaaactttgtactatttatttttttgcagggaaaacttccagataatacagggtcagaaatctgaccacttttgaattttcttcctttttaaaatttatttttaaatttataattgacacaataatattacatatttctggggtacaatgtgatgttttgaggcacatgtacatagtgtaatgatcaaattggagtagttatcatatccatcattttagacatttctttgtggtgacaaccttcaaaatcttctcttctagctatcttgaatatgtagtacaatgttatttttctatagtcactgtattgtgtaatacaacaccaaaacttattcttcctgtataatttaacgttgcagcaattgaccaaccttttgttgtccccccttccagcctttggtagccactattttactctctatttctatgaaatcaatgtttttagatttcacatgagtgagattatgcagtttgtctttctgtgtctagcttatttcacataatataatgtcctccaggttcatctacgttgcttcaactgacatgatttcattctgtgttatggttaaatggtattctattgtgtgtctgcatgtgtgtgtgtttgtgtgtataacaatttttaatccattcatctgtagatggtcatctaggttcattccatatcttgactactgtgaatagcactataataaacatgggtgtgcagatgtatcatcaacataccgatttcattttctttgatatatgcccagtaatgagcttgctagatcaaatggtagtctatttctagtttttaaaggaaactttatactgttttccataatggctgtattaccttatatttccaccaatcgtgtgtaagagttccctttcctttgccagcatgtttgtctttttgaaaaaagctgttttaactgcagtgaggtgataccattgtggttttgatgagcattcctcaggtgattagtgaagttttgcatttttaatctatctgttggttatttgtatgtactcttgtgaaaaaatgtctattcaggtcttttgccattttttatctgattttttgggttttggccattgagttgttgagttttttatataatcagggtattaacttattatcagatgcatagtttgcaaatatttctctcattctgtagattttcttttcacttcattgatcatttcctttgctgtacagaagctttttagttttatgtaatctcatttgtctattttagcttttgttgccagggcttttgaagttttattcaaaaaaccttttcccagttcaatttcatgaagcatttcctctatcttttgctgtagtagtttcatagtttggatcttatgtttgagtctttaatccagttagagttgatttttgtatactgtgagagatgggggtctagtttcatgcttctgcatgtggctatccatttttttcagcaccatttattgaagagattgtcctttctccaatgtgtgttcttggcatcttcgtcaaaaatcagttggctgtaaatgcatgaatttatttcttggttctctattccattgatctatgtgtctatttttatgccagtattattctgtgttggttactagagctttgtagtatatttcgaagtcagatagtgtgatgcatctagctttgtcttttttgctcagaattgctgtggctatctgggtcttccgtggttccacataaattttaaaattgttttttctatttctgtgaggaatgtcactagtattttgataagaattgcattgaatctgtagattgcattgaatctgtagattggggtaatatggaaattttaatgattgttttctccaatccatgaacataggatatctttcaatttatttgtgtcctcttcaattttttttttttttttgagatggagtctcactctgttgcccaggctgctggagtgcagtggcaagatctcagctcactgcaacctccacctccctgctcaaatgattctatgattctcctgcctcagctttccgagtagctaggattacaggcaactgccaccatgcttgactaatttttgtacttttagtagatatggggtttcaccatattggcgaggctggttttgaactcctgacctcgaatgatccgtctgccacagcttcccaaactgctgagattacaggcatgagccactgtgcccggcccctcttcaatttttttcatctatgttttatagatttcttaattgtagccagggctgacgtgtcattgagatttttattcaattttttaaacactttaagtcccacagacaacatcatgtcaggtctttatgattttggagtttagatttggtttcctccctctatgaaccctccttgttataaattgattttgtcaccccctttcaaattcatatattgaagtcctaattcctggtacctaatgcgaccttatttgaaaataaggtcattgtagatagaattagttaagatgaggtaggatgggcccctaaatcaatataactggtgttctttaaaaagtgggaacacacacattcagggagaacactatgtgaacctaaaggcatagattggtatgcatctacaaaccaagaaactccaaagcttgctggcagaagctataagaaaggggtggagcaggtttttccctcacagctcatggaagaaaccaacagtgccaacaacttgatcctggacttccagcctccagaactgtgaggtaataaatttctgttgcttaaaccactcagcatgtggtatttcatgatgtcaaccctaagaaactaacactaatacactttcttcacagttgtgccagaaaattgtctcattagctgattagtgactcccttattatttctgcttttgtacattgagtgggaatatttgcatatcattgatgccagaatctatccttcaaaatgatggccattttaaaaatggataatatctttaagcattgccttgcccttccaaaaggtgaaaaaaaagtgaggcttggtaaggaggacaagatctgctaaaacttgccattaaaaaatattatagcagatctctggatacgttccagtattaaaacacatttgacagaaatatgagaaatgagagaccatactaccaatgtcattctatcaatgtctttaagatgagagcaaagaagcaagaggatcaaggaggaaaataataaagaatccttgctatcaagcagaaaggggattggccttgatcagtgggaaagttaaaaagggccacaaaattaaactgctccttaaaaaatagaaaaggagataatgaagtcaagggaaaagcaacattagtatctggatttaattcatgaccttcttagtcctaggagaatttgggccaggagaatttcctaatcagcagctgcactccccacttctagttctctgggccacatttgacaaatgtagatctgaaactttaatatggatgagaatcaccagaggtcttctaaaacagattgctgtctctcttcccactgcaccccatagttgccatttcataggtctggagtggggtcccaataacttgcatttttaatgagttcccaggtaatgctgatgctgctgatctgggggcaatactttaagaaccactggactgtaacaatgtcaaacctgcctgatgagaagaatcacctggaaggtttaaaaaaatgcaaaatcctcggccccatgccagactttctgactcaacctccagggaagagcctaaaattttctatttcaacaatcctgcctgattaatatgattaggtgagtttggaaaatgctacaccaaatctctataaattcccttttttagcatctgttgtttttccacttggtttcagtgaattttgcaatatggcagtagctatgtgatgagctaagagtagcacaagtactaggttctgtaccttgaatttcctgatcccattggctgaccacagtaccctgctttttctttttatgaacatgtgccttgggagagagtcttccttaatcccaactggccctggtatcatgatgtcatccagaggccactctgaaaccaactcagatgatgtagccttcactggtaattctctgcttatctttcactctttcttatcatacaacatgcatattttgctctgaatattaatggtggctctagcctcaggctgtttcctcttaactttgaaagtatttacgtgtgagttatgctctacaagttttatttcaaaagcactttctctttatttggcaggaatattcttgctggcacttgcagaggaaatcccattggttcagcagatggctaatgataattgaagttaactctttagagaacaattagagatttccaaaaggattgtagtaaaattgcttagggccctatcatgcccatctgctgcttttgagaacatataattcctatctcttagatccaaattccagccacaaactcaaagttgaggcaccctgtaaatggctttctttggaccttctttgccttttggggatttgtaatgattctaaatatagtgacctgatatagtttagctctaatttttgcagcagcactgcaagtagatgttactctattttacaaataagaaaactgaggctaaacaagatcagatatagagtcttgaagattatacaactgcctagtatcagtcaggattcaaacccacagctatccaacttacaagcctaagctgctcctctaagacgactctattctacttttgaagaaatgtggggtcaggtttgagagcaacattttaatttgttatttttcctggagtttccaagattgtgtttaaattctaccaagtgagaaaaggttacaacaatcatccttagttttgtttgctatctcaacaggactctgcgtgctttgattctaaatgtaaaattagctctgtctgttacaggaaagccatcaactgggcagtgtattagtctgttccctcactgccaacaaagacatacctgagactgggcaatctataaaaaaaaaagacgttcaattgactcacagttccatatgtctggggaagcctcacacttcatggtggaaggtgaatgaggagcaaagtcatgtcttacatggcggcaggccaagagagtgtgtgcaagggaactcgtctttataaaaccatcagatcccatgagacttattcaccatgatgagaacagaacaggaaagacctgaccccatgattcaattacctcccctcaggtccctcccacaacatgtgggaattctgggagctacacttcaagatgagatttgggtggggacacagccagatcatatcattccactcttgacccctcccaaatctatgtcctcacatttcaaaaccaatcatgccttcccaacactcccccaaagtcttaactcatttcagcattaactcaaaagtctgcagtccaaagtctcatctgagacaaggcaagtcccttgcctgtaaaatcaaaaccaagttagttactgcctagatacaatgggggtacaggcatttggtaaatacagctattccacatggtagcaattggccaaaatgaaggggatgcaggccccacccaattatgaatttcagtgaggcagtcaaagcttaaagctccaaaatgatctcctttgactccatgtctcacatccaggtcacgccaatgcaaaaggtgggttctcataatctgagacagctctgtccctctggctttgcagggtacatcccctctcctgactgatttcatgggctggcattgagtatctaaggcttttccaggcacaccgcacaagcctttgggagatccacattctggggtctgcaggatgggagccctcctctgatggctctactaggcagtgtctcagtggggactctgcatgggggttccaacctcacatctcccctccgtactgccctagcagaggctctccatgagggccctgaccctgtagccaatctctggatatccaggcatctgcacacatcctctgaaatccaggaagaggggcccaaacttcaattcctggcctttgtgtacctgcaggcccaacaccgtgtggaagctgccaaggcccagggcctgcgccctccgaagccactgcctgaacggtaccttggctccctctagccatggctggagcagctgcagggtgccaagcccctggcctgcacacagcagggggacccaggaatccactttttctctcctaagcctccaagcctgcgatggaggggctaccaggaaggtctccaacatgccctggagacattttttccattttcttggtgattcacattgggctcctggttacttatgcaaatttctgatgcaggcttgaatttctccccagaaaatgggtttttcttttctattgcatggtcaggctgcaaattttccaaactttaatgtttcacttcctcttgaacattttgctacctagaaatttcttccaccagatatcccaaagcatctctctcaagttcaaagttccacatatatctagggcagaggctaaaagccgtcagtctctttgctaaagcacagcaaaagtcacctttgttccagttcccaacaagttccttatctccatctgagaccatgtcagcctggatttcattgtccacatcactatcagcattttgctccaagccattcaacaagtctctaggaagttccatactttcccgcatctttctgtcctctgagccctccaattctctaggaagttccaaactttcccacattttcctatcttctgagccctgcacactatttcaacctctacctatcacccagttccaaacttgtttccacattctcaggtgccctttatagcaacactcaatttactgtatcagtctgtttccatgctgccaacaaaaacatagctaaaacgggcaatctataaaggaaagaggttcaattgactcacagctccacatagctgaggaggcctcacaatcatggcaggaggtgaatgaggagcaaagtcatgtcttacatggcagcaggaaagacagcatgtgcaggggaactcccctttataaaaccatcatctcttgtgagatgtattcactatcatgagaacagacaggaaagacccgccccatgattcaattacttcccagtgggtccctcccatgacaggtgggaattatgggagctacaattcaagatgagatttgggcagggacagagccaaaccatatcaagcggttattcagaaaatgtgactaactattggttttaagtaacaaaaggatggtttcagtcttgaattatcttgaattattatgtttgctcaaactttcatagttgattgttgcatatcttctttccgttctttctttctccagcaagaatttgtttgtaccagctctatgccatacaccgtgatagacacaccagacgtggaagtgagaaatatggttcccatcttggatagcaaagaagatggacaaataaaccaacaaattaaacacagaaaaacgttttctaaaggaaggaggtttcttgaaggaagtggtacttctgttgaaatatgaaagatgagtgagggttagtcacatacagaaagggagaagggagtatccaatgtagatagaacagcatatgaaaagcacagagatgtgagagagcaggtaggcattgctgtaaatccaggtggatgtaaaaaaaatcagagccttgcaggaactaggttgtagaaagctctgtggactaagtttagttggtttaactttatcctaaaagtcacaggaaaatattaaagatgtttaaaaaagaaaaaaaagcagattttcattttattaacaaaacataactctggcagcaggtgtggaaaatggatggaggggccaggaccagaagaaagacacctgttactgaagcaatgcagatgggaaatgatggagacctagatgtagaccatgccagcaaagacggaggggcagaattgagtaatacttgtagaactaatgtaacttacaggatgattagatacatagaaaggagactaactcaatcctttatttttcttcctttttcaaaagtttttttaagactatattactatcttttccccattccctccatacttaatatgacagttagctaattttacttgaatacctatgtcttattctttaccaacaccatcaagcagcagcatctccctaccaccaccacaacaagcagcaagtgtttatggagcacctcttaataaattatcctttgtcttgttttgtgacaaatttacattcctctctgctttacttttgctttatcctgtatttttcattgttctgtggtttagcgtgtattttcttctgctcttccaggaccataggatttcagagcttgttacttaagttctcaggtttttgatatgtacttggaattttattttttactactttctcaaagtaatgctccacaaatatttcttatgtaattccaatgcatctaaagagatttagcatttgagttttatgttaaaccaataaactgattaaagccataattagcaatcaccaacttttatctggaaataaactgaaaactattattcacttactaaggctctggtgtacttatttctgtaaagagaacactatactttgctcaaagaagtaatacaatttatattttctcctgttctcatgtgtgcaaattatgttcattttattgtacaggctatatatcttctgcaataccttcatctgcctgtaggtgtaaagttaaaattcagctcttctgtcaaggtaagaaattagatagctggctaaaacaagttatttcagtgtatactgctcaggtgatgggttcaccaaaatctcacaaatcaccactaaagaacttactcatgtaaccaaataacacttgttcccccaaaacctatagaaataaaaaattttaaaaaatgaatataaaaaaagaagttatttaatatgcaggcttatatttatctagtttttcattgtttacattttttctttattctaaaaaaaacaggatgcatgcacaaaacgtgcaggtttgttacataagtgtacatgtgctatggtggtttgctgcacctattgacccatcctctaagttccctcccctcacccccgaccccccaacaggccctggtgtgtgttgtttccttctctgtgtccatgtgttctcaatgttcagctcccacttatgaatgagaacatgtggtgtttggttttctgttcctgtgttagtttgctgaggatggtggcttccagcttcattcatgtccctgcaaaggacatgatctcattcccttttatgactgcatagtattccatggtgtatatgaaccacattttctttatccagtctatcactgatgggcatttgtgttggttccatgtctttgctattttaaatagtgctgcaataaacatacatgttcatgtgtctttatagtagaatgatttctattttgggggtatatacccagtaataggattactgggtcaaatggtatttctggttctagatccttgaggaatctctatactgtcttccacaatgattgaactaatttacattttttcttaacagcagtcatgtcatgccatgttaaaaaaaatacagatgttttcttcaagaagtctaaggaaagacttccttgtactacttaaataagactgccaaaatggcataatatcaaaaaagaaatgtaaatagagaatcaactgccaactaaatgccaccattactcacagtgtgatatcacctacttgtcttaggcatcattcatttatattatagtctggtccaccgagactattcatcacatttttattgagcaatttctatgtgcttagtactgactctgctaggctctataggttctctgtaggtgctttaagtcctgcccacaatagcttacaatgtggttgagatttaaataaaaatacagaagtttttaaaaatatatcttgtacaaattaccttaaagtaaaaaaaattcagataatgaaaataaagctgtcgaaaatctaggatgagcctagaaatattttgtattaataaaatagtcagtaaaagcctggattaatgaaaaatatgaggacagatatttttagtatggcaattaaacacttctgtagtcataactaaaaatataatgataagcgtatattttatacagatccttaagatacctgcataatgacaattatcttaagaacagttttctttgaaatgtgcttccaattacaaaggatgttgaaaaactttttctcttagtttatctgatttccttatagcttttatttcattatttatttaatttttgaaaattgttcttttagatactaaaaacacagacccaagtcaactctgtctgaattttcatatattctgtggatatattttattatgtaaaagataatgactctacttttctcttccctccttgggagaacttagataaatataccttctgacggaagccaaagcttctaaacacaatattctctgttctcttacgtatccctggctaacagatctcggcatggcttggcatgcttgttcacattaccctggtccaacctctcttgggaacagcacagctgagttttttgtttatttgtttgtttattttcttttacattgggttgcactgatgctgaatgaaagcactaatgctgcaatacaatgggggctggagtaggcagcagttcatttcttccaatgcaaaagctgtaagtttaaaagtacgtggaatatattatatgtatagtcaggactcatgtccatacagcccacttaaagcatattaatgttatatgtttgtttcacatatgtatcccacagaactttacagtagttactataattaaaataaaactgtagatcaaacatcagttcttcacaagtaacttttttttggcaaagttcttaaggatcttactttattttgagggttagttctatctttattataaccttgttgcataatgacaagaatttgtgtttattgaaaataacaaaaatgaagatgaagctacttgttaaaaaccagtgttttgctgaattacaacccagagtatttgagtacacatataacataatataacattattttcaatgaatttgtacacaatggatacatttgtctagattgtaaacaaaaatgttctctgtacctgctcaatttttctgtgaaactaaaactactctaaaaactaaagtagttttttaagtatcatatatatatatactgatatgtatatatagatatacagtttctctacatcagattttaaactaattggacaaagatatttctcattgtatgagaagtatctttgccaaatagtcattatttttctaacttttctaattattttgttacttattactttaacaaaaaaacctttaataaacatgctatgtaaaacttcatgtgggctgagcatggtggctcacacctgtaatcccagcactttggggggttgaggcgagtggatcacttaaggttaggagttcaagaccagcctggccaacatggtgaaactccgtctctactaaaagtacaaaaattagctgggagtggtggtgggtgcctgtaatcccagctactcaggacgctgaagcaggagaattgcttgaactggggaggccaaagttgcagtgacccgagatcgcaccattgcactccagcctgggcaacagagtgagactctgtcttaaaaacaaacaaataaacaaacaaaaagcacttcttgtgattattctccctggatgtagacatttttaaacaaggaaagtttaacgtgaaatgacaacaaccactaacatgaacaacaacataaaaacaaaaagctatcatgttcacttatgttaatcttgtacataaatgttaccttcgctgataatttacttaattagtaacatctttctaggtgtcaaacactacactagtgccaagagacctgtggaaaaaaattaagaaacgagtcctctccaccatgaattacagttttgtcacatgggaagagacatatacaatgaaaatattcaaggaatagtacaatacaatagtcaaaatgagtactatgtaacttcaaagttgcagacagaggtaaggaaaaaacaaaaatacttaaagtattcaaggcctaaggacaaggtgagatctgaacatgtgggaggtgggtaggttttgcatggacaaaaattatcgtgaggtcttaaaaacaagaatagcatccaaaggatggttggggttgattccgttcatgacatttaaacccacagagtcaagaagccggtttatagttgaaattgagattcacattaaataggtagaaataagtctgggtaaagaatcaatcatagtaaatactttctgaggatctatcgtgtaacactcattttatgtacgttattacaattaccctacaggtaagtactattatcttcaatttatagattaatttattgagatgcaattaactttctcagagtcacagagcttgtgagtggcacagccagatttaaatccaagtttgattccaaactcatgcttctgttaccacatcactttgtcttgtaaacagaatatcactgcagcaaatctttcatcccattgtgctgtaagaaggaacagtacacctggaattttaaaaacttgaacctgaatttgaattcttacttatgttaggtatgaaaaatcggttaagccctttataaactgtaccatcttttgtaaaaataaaatagtgaatagatgacagctagtcacacaggtgaatgaggaacagatagaagtaacagaagaatggacattcttctgatgttggcaaatactatgtactcaataaaattcactgaatttaaacctaagtaaagggattgtgtacagcatcagctttgtgctagttaagaccattttaaatatagatttggaagaaaatagttatagtttatagctaattcacaactgcttctgctatttaagaaggactctactattgagtcattatagttggcagaaacgatatgtagtcacagcatatgatcctacagcaaaacttctgataccatattttcatcgcttcccaagatgtcctataggtgacagcatggcctttagcatggtacctaaagaggagacactcagtaaatatgtggtgaattaagcaaatgaggggacagaagaaagggaggaagagaaaaaaaaggacaagaagaagaaaagctgattgaatttaaaagcaggtaacggcatatccgttgaaaactattagatgactcaagtatatcttttagaagtccacaaagttttttattttaatacagacaaaatagattcttttattttataaaaacgtaataaagtttgttattcaacaactgttatttattaattttgcctttgtatatgctgccagaaaagaaatattaagaaatcctgacttggtcatggtgaatcagaaggcctacctggatttttttatcactctaactgcgcagctaatcattcaacctcaaatttgttttttatgacactccaaggatgcccttagctgcatcactcctttgtcatcaaaagcttagaaataacaattaagcagattcctgagttactaaatgacacataactagaattgagacttaggaacttttagttccatgctaagcccacagggacacaacatctctaaaacattaatcataattgggcacaaatattttttgtcacgattccctcctgccctcatttgcttttatatgtcgttaagttcatatcctattaattgaattatcactctcaatatgttgacttttcaccatcataagcttatactgatttttcaaactcatattgcaaaagcaagctatcatgaaatgtaaagatgtccactttggttaagattcacgtaaaggtttgaagttggagaaaactcctggaacacaggtctttcttttcatcacttttcctccaatcatcatctgtgaaattcttcccaacttcttaaatgcatattcaaaatcccatccaagaaaccaatctaatattcagaggcatggattataataataaagttgatctccatgggtattactgacaaaacaatcattaaaataaaaagataaaaatgaagaaataatccaaattaaaatatataattatccttctcaggtgggaagaaatatgcaaattcagggaagcaggaattgcaataaaatgtccaactccgttctttcattatctgttagaatagagagagaaagatgcaataagcatggatggggattattttttttaaattttgtgtatggtgtgaggagtaaaatataagtaataaatttgtttgctttaaacgtttaaaacattctcttttgaagtaattacatgtgttttagatttaaaaaagcaattgtaggcacaataaatggtcaaataatcttgttgtaaaaacaagtttcaattagtatataactctagtctaaaaagaaataaggaagaatagaagctgaaatagccaggaaatagaatattttcctatcaaaacatcaaagtaggccagacgcggtggttcatgcctgtaatcccagcattttgggaggccgaggcgagtggatcatgaggtcaagagatcaagaccatcctggtcaacatggtgaaaccccatctctactaatacaaaaattagctgggtgtggtggtgtgcacctgtagtcccagctacttgggaggctgaggcaggagaatcgcttgaatctgggaggtggaggttgcagtgagccgagatcatgccactgcactccagcctgttgacagagcgagactccatctcaaaaaaacataattaattcattaattaaagtattctgtttatttttttaagatagtacacagtgccaattagtataaagcaaattttttcacacacggttgatgaaattttaaatctaattattttcgcaaacagtctgtctacatgtatctttaaagaacattaaatattacacattacttattccataaattctccttatggtaaaatatatatatatataaacagttttttcaaacctctgcctttcagtacttgggtaatgatacagtaatattttcatcaatgtggcaaatttgaccacaaaattgaccatatggttaagtaagctacagtgtattatttagataacctattacataaatattaaaatggcttcacaaagaatttgcaaatggtctgagaaatgcttattttatgctaaataaaatgagaacaagattaaaaaatgtatatcataatattaacataagtatgtaaaacaaaattaaaaaactgcaggaaaaaaagaatagaaaaacatacactaacatgatactgaatttttactgactggtgagactaaagtttagtaagctatttttctttctaattttcatcattttccaaagtttccatagagaacagggcttatttttgtaactgagcaaaagtataataagatttactttaaaaaattaaaaatggagttagagtgaacctaccaaaaaagagatggaaacaagttatctctcttcgtttcccttcattggttttctagggaaatctgtattaacagcaaaacagtacccagtgtgcacgtgtgtgtgtgtgtgtgtgtgtgtgtgtgtgtgttatagacatagatagatagacagatagatacatagatatagatagatgatagatagatagatagatgatagatagatagatagatagatagatagatagatagatagatagatgatagatacgtagacagatagatgtggggaaggatataggattataaatgtgagttgagtaaaaattgtattggcctcatgatttttaagctgttttccagaatcaaccagcttgttcttatcctgtaagtggcacactatatatctctattgaaaaaacacattcatctcttcctctgaaaaacaggaaaaattctctcagttccctcaaccatgaggataaatgtctaaagaaattgagctgcttgaatgttcatatcagttataacaacttgtaccgagcagaggggttactgtacctgacattacccagagaataaaataaaatgagcatgctttttcgctaaaatgaagagttcaactcatttgataagtcaactgtgttatctctgaaaaaataaaccttttcacagtccttcttaaaaagaaaaaaatcacacaatgctataattcccagcagactttccattcaattagccattaatagaaatactaaaaagaggtgcttgagggaagaaactaaagctcaaaatttgatatggccaatcatacatgacatttgggattaagttctgccttttagagtactcattcattgaagtacatgttttattcaaaatagatctaatcaaaaatgcgactgagagtgtgctagccatatgagccatatggcgaacacgctggattctgatacctaattaaaataggagtggcctagccttaacatactactggaaactgtccttactatgaaaaaatcagtgacttacagattctttcatggcaagagacttgatcagtcacaagatcagactcaagccagtttcaaaaaactcttggttggaggaaacttaagtaaagttaaaaacaacaactcctctaaggaatctagcactcttaatcagatgtatatgtttaatttgcattttaattctcagagatggtctgcctttgtagcatcaactccgattagaacagagagacgggggaaggctatgctataaatcccggcagtttctaaatctcacctttccaaatggtcgctccacatcaaggttgaggaacactggcagggtaaggaggtggagctggatgcatagttgtttgtgtggtacctgatctgtgaacagacagaggatttcacaggacacttccttgagtatttttaaagaaaagcaaaaccaaaacctgcatatcaaagtcacattggctatgatcaatatggatgttttagatattaccttcctaggaccatctcatttctacttccatgctttgactcacacttatttcctcctacacttacgcatcaaatacgacttgcaggcagagaccatgtctgatatgactggggaagttatcacagcacttgttaaaggctgaataagaactcattgacctcaagtgattggtgaagggaaatctaattcaaccaccctccagctgattatttttcgtgatttcccattgctctgggataaagaatagaattcctaacatgacatcaaaggctgttttatctggcctcgggatgcaatttcaaactcttttcaaactttttgcctttttgatcttaaatgctcaggctacactagccatcttcgaacattatgaacagtgtcatccttcttcatacctcagggcctttgtacttgcactttcttctgcctgcagtatgcttccatttcttcatcacctggctaacttctactcatctgatagatctcaacttggagaatcactttcttggagaacatcctgttcactaggactggtgcctcactatatgacatctactattttttctttcaggaactcatggcatatgaaacgtatagttatgtgtgtgattatttattgatgtgtcattgtacctaagctataagcttcacaagagcaggaactgtgcctggttttgcttaccactgagtctccagcagctaccacggtgcctggcacagaaatcatagtggataagcatttgtggcctgagtggacaatgctgcacagccagtcctgaggcccatccctcaacagtattctccatattacacatctcctaaattcattggatgtcacagcagaaaaacgattccttttttttataaatttctcagtaattgtcttataagaaaaagacacaataaaatgaattcctcataaaaatttgttacaagagaaaggagaaagaaataaaatccagtgtttcttcagtcttttttaattggctttctaaagtttttttttccttaaaaatttaattaagattatcttaaacagcacggccattttaagtggcatggcattatacaagcagtccagacagacatatagttttccaatctttaactgtgttaagcaaatggatgatttctgttttaggtaggcagtgctgtgtgaagaatcataaaatgccatgttttctttgcagcaaaaattacactttgaccaatacctattccacagcaaacagaaaaagtttagtggcaatttgcacagaaattttatggttctggaagagtggtcagacttggaggagaaaggagaacaggtttttggggtctttttaaattttttgtctgcaagactttcaaagccccctttgtactcctatgtgagaagattctccatctgctaaagaacgatctggttaggataagttcttaccttagctgacaactaggttcctcttcctgctattatgctgcttggttcttatttagaggcctgctttaactaaggaaatgcccttgggcttgcattatttgttggctaaactttagaagcagactacagctgtaggaatttcgatatcacatacctgtacaatgtcaaatagcaggagattaaaaaaaaaaaacctaaagtaagaggcactgcaaggtagtttgtcaagagccaagagttctgcagcatatgtttccctagtggcactgtctgtggagcacagaggatttttagggctgtgaaactaatctatgattccataatagtggacgcgtcattatacatttttccaaacccatggaatgtacaacagcaagagtgaaccctaatgtaaactatggactttgggtaataatgcggtgtccttgtagattcatcaattgcaataaacataccactctggtaggggacattgataatggaggaggctatgcatatgtggggccaggggagtctgtgaaaaatctctgcacttctcaattctgctatggactgctccaaaaaataaattccattttaaaaaattgctgtatattggggattatatatgatttgatctactaatagccttgttactactgtttctgaccaaagttttccttctctttaacatatcctgcatattgtttccaaggcaaatcttggcaaatcataaatatctttgaaagtttcccatttctaaaagataaagactaccatatgtcaggtgatgccaagctcctttgcctttaatttcatttcatgcttaaaccctttaatacactgatcttcattcacatcaaatatgacctgtcctgaaagtataaggataagcaggtactaacgagcctctcttagacatatcagctcttgcagccataaagattttcctttatgctgcctaggatcttcccgtctgaaataaatcttgttcttgtttcaactaaacttgcagctctgctgtgttcttcccaaattgccaagtatataagatatccaatctgccagcaaactttatcctccctttggatgtgagaccccaaagatttcaatttagacagctttatttactaagctgtgttacaggatattttaaaataattcagttaaggtggttcaggctatttaactgcgtatttggagggagggtcggtgttgatcttccaatttgaatttaactcttgggccaaattattttcctatggcaattctgaaagaagattgatgtgtaaatgggcacgtcacagacaccaaatggagactccagaaacatagctcatttgtttggccttctgctatggctcatttgtggatcctgtgccatttatggtttagctgaggatgcctgatgcctgtattcacagagccatgctgcctctgtgggctgaacactatgctagtttgtctacgagattccttccagaatgacccagctgtaccacagggttatagctactttccatcatgtcattaatagttctttctgctcacctacactagctcactaatttatccccatccactgcttgatcctgaataactgaggactatgatggtctgtgctgtcaccttcagaatttcaaggccagaagtgtaacttggcataaatctagctagattttgaaggaaaaagagaaaaccatcctagaattccctctcttcacctctgattacttgagtccttgttacaggtcatcccgctcccatagctatcccctccctcttccaacttcctgaccaccggctcctttccatccactttcagatatgtggaagtttcccttgtcttgggaaaccaatacacacaaacacctgtgcttgactgtttgtctctactccttcctccaagtgcagtcgaatgttttgcctccctttaacaccagcttctttaagtgacatgcagtctcaggtgctcctaattcctctccttttagctccctcctaaacaactgaccagaattagaaggtcctctccctttgtcagaaactgttcaaacactttacaaataataattcatttaattatttgtaatcggtactcttatcatcttcacttgagatatgcagaaactgaagcatagataggtaaagtaacttgcctaaggtcacctccagatgagtggcagagtttgaattcaaatgccagcagtctagttccaaaacacatgtcctaaccacactctactgcctcgctccctccaaattctataattggttttcattcctgtgctaataaaactagtctcttagaaacttttggtatatgctctcatctttgattgtagtactcaggctagatatacctgtattgcatattaagttctagtatttacaaacctccccccactttttatgcaagtataatgaaacttcattaagctggaatgaacacattattctaataagggtagaactaaattttatattgttcgtgacataaaatagtcttaattggtcaaattaataagcaaaacaaaaaattaataaggtaataggagcagcatttgacctactcaagggggaaaatatagataattttagaaacacaaatccaggcttctgatatcagaggagtctttcctgatccggataataatatgtataatgcacttattgattcctgccttgcaggagtgtgtgctctagttgggaagcaattgaaataacaagaaatagtagaaaatggcacatagtcactctccagagcataggatggtgatattcaccatcatctactttgttagaatttgcagggtatattctgagcactggcaagttcttcttaggcaccatgccagctgccaccaagagggtagtgatccctgtgggcataaagaaaactgcacattttaaagctaaaaggagccttggagatgatgtaatccaactcttttatttacagatgaggatatgaagccactttcttttacagtcacaaagctagcttgcagcaaagtcctatctggaatctagctttctctttctgctctatcactaggcccaataatagatttgtagatttaatccacgcataaataccctagaacataccttattcatcaaatgcttgtttcttaaagaaatgaaagtatagataactgagcagggttaaaagactaaaacatgtgagctagccaattatactactcagtgagccccacaagagcagagattttcacgtttctgtttgttgatggaccctcagtgagtaaaccagagtcagccacaacgtggtttaattactatgtggtgtttgaatgaatgatttcttctacattttttatatgcaatgtctataagtgagtagatattatttctattttataggtgaaaaaaaaaaaagctgagtgaagttgacttgctcaaatctagacctagaaccagaactagaaaccaggcttctggtgcctaattcattatttagctgtaaaaagattgctttcataaaaaaattaattgttattctgtacagagaatacagacagatttgtcacttcagcaaaattctgaggaaatgggtacagctgcacgttatctactgtcattatttacttgctggtcttttgggtgtgagccatcatttctagtccggggcctgctatatcacactaacaacaaaaataaacggtttccccttcttactttccaaagtttccttcctttcttatctttcctctcagaattcaaactgcctggagaaacaaagtgggcaggctggggaccgtccttccattgagcgttctcacaccacttcgtgagactctgatcaactcaaactatattaaagactccaatgccttacaactgtctcctcaatttaatttcatcttttggagtttttacagcctcactatctaaagagattatacagttactaggctttgtaacttctagcactgcttcttgaatcttcatcttttaagggggttctgtgtttttctctttctacaacatcaaaatatattcttaagataatagaccttaaatgcagttatactggtctcttcacaatagcacagattgtagaagccttaagaattcacagaaaggggaaatattaaagtaattgaggggagttgaggtttcataaggaagtgcagagcatgaaaagaagaactggaagggaggcggggaagtcttgaacaaagacaggactgaatgagcaagagtggaaggcagagagcaaatacagctagttattgtggatgtttcacttttggactaagattggataggggtggatgggaattggagaaatagaactgttaccactttcaaataagtggggacttcgacatagtttggggggattgatagccaaaaaccttaggcaggaagaagggtaaactctagaaatattgcccagctggaatcctggttccaccagttattagctgcgtgaccttgggcaagttactgcaacttgctggccctcagtttccttcttggtggaatgggaataaaggttgtaactacccctataagattgttggtggaattaaaggattaatgcaggctgcccattatgtctgtaatcccagtgctttgggagacctaggcaggaggattcctggagcctaggaatttgagggatcccaggaatctgagccatgatggcaccaatgcactccagcctgggtgacagatcaagaccctgactcttaaatttttaaaaaaggggttaatgtatataaaacacttagaacagaatctgatgcaatgacacaaagtaagcactcagaaaatattagctattcctatttcagccataacaaacaggccatttattatgctagcctcacctagaggttcttgtaagggaaattccctggcccacaacttctgaaggggcaactacaggtcgcctattttgtgcaaagattctgtacattttaggcatacctgattggacaaggtgtgcaagctcaagcaataggttagccactgatctatgactttgccagtcaaggaacagtgaccttataagagacttccttttttgagaatgtcaagaaaataaggaagattagtatcaggaacagagccatgaggaagaagatgattaagctaaggaattatattgacaatacagagaaagaataggcaactgttaatagaaacaaaattatgacaagtagaaaataactgggtccaataatggtggacaataggcaagagattccatttactccagttgttgattttcaggatcttaatctactctccaactccagcctacacactccaagccatactattgtttctttttctttctccttttttttcttttctttttccttttcttttctctctctctcttccttccttccttccttccttcctttcttctttctttctttctttctttctttctttctttctttctttctttctttctttctttctttctttctttctttccttccttccttccttccttccttctttcttttctttcagacagagtctgtctctgtcacctaggctggagcgcagtggcacaatcacagctcattacaacctgacatcctgggctcaagcctcccacctcagccttccaagtagctgggactacaggcatgcatcaccacaccctgctaatgtttttattttttgtagagataggatctcactatgttgtttaggctggtctctaactcctgagctcaagtgatcctcccacctcaacctcccaaagtgttgggattacaggcatgagccactgtgcatggcccataatgctgtttctattacaataaacctcctcttgcttaagctaacataagttttgatctatttcctatggtccaaggaacgtaaataaccaaccaatgcaaacaccttagatgatgagtttgggtatccaacacttgctttagtgatccctggtacccatcaatcaattgactcatggccctccagtgcaccctccatgctgcccccacagttatcctcactcagaatgggctcccattctttttgacatatgcacagactaattttctttcaagggcaagttcaaattccactttctccatgaatacctggggactatactggacagaggtggatccaggttttgtggcatctgaagagtacaaaactttctttaataaaatgaatataaagctaggtgcctaggaaaaggcctgtgaaattgagagactttgaaacttcaacttcattcacttccctgtacatctacttctgataccaggttaagagggactttttctccatgaaattattctaccaggtatattttacaatactgtgtgtaatcacacagacctgctatataaataagctcagtcttacacctgctgcctctcactttgggaatatcatttgtgattggactgcagtattccaccccccaggctgttgggaagaaattcctgatgtctgacagatctactgtcagatttgggagggaaaacatcgatcagtatatgacactgctcctgctcatccagcatctagtgtatgccacctaatattggtagctaagccattctccacacaattgtttctaaagagagcctgctcattacacacatacatactcagacatcccaacatacatgttttgtaaaattgcttcttatttttctattagccttaaaataaagacaaacatttatttcatgggccacaagtctcctgtcatgtttccaccatcattcctctctgtctcccactccatatttgcagagctaaaaaatttactgtccatttgtggacatctatgcaagggagcagtcaataaacattaggagtagttatctctgctttttaaatttcactgttttttcattttctccttcctcattcacccttggctcagttgaagttctcggtaaagactcataaataggtgatagagttgttaattggcttaatttaatcattgcacagtgtaaacatatatcaacacatcacaacataccccataaatacagaacatatacagtgattatttgtcaattaaaaataaggtaaatcacaaatttctaaaaagaggctaaacaactaagtgaataaggagctttatgagggtgaagctttgaagaataaaaaaaggaggctccccagactgattagaagcacagtagagagaggacagccacctagagaaacagatcagagagagcctgaagggaactgtggaaatgcaaaaccatagcccagagagagacctgtcaggtgacagccagaacctaatgactccctggaatcatcagagtgctcgagagggactgcatttcatgaagtcacccaggatgtgcttgagttttttaattaatctgaaaaaaaaaacaacggaactttctatggctagaattggggatatttggaaacatccagagtcagttattgaatatcagtaccacttgattatcagttccattgaggcagggttcaaatctaccttgtttctgctctatgcccacatatcacagtgcctctcctatagtatgaactcattaaatatttagcgaatgaatggataatattttcaacaagactcaagctctttgaaatcacagactgtatcataaatgttctgtaactctaaagaacccagcacaatgcctgacactgagtgacactagttatgatttgctgtctgatttagaagctctttatatgtcaaagggagatatttttttctttaagcctggtgataaccacgcacacctggtcaaattcacatcctgccttatcttttatgtgctcccagctctataaaggtaaaataagcaaaaggaagaacaattattggtatcaaaaatacagtaatctagagactaatccttccctgaactatctttgtcacttcctgattcattgaatttggtcagtttgttccacacgtagagcctcctggctctcagaaccatgaggaaacagccatatccctggaagtagactttaaccagaggctgcttcctgaaaggtcctagtccccagggatttattgccatggaaagcctgaactggccggaagacgaacggtacacacaacctttgggttgagtatagaaaatgttctgtatggtttagctgttgtgactatctgctatgttgctaatcgacacaaatagtaacattattaaagttcattaaggctgggtgtggtggctcatgcctgtaatcccagcacctttggaggccaatatgtgtggattacctgaggtcaggggtttgagaccagcctgaccaacgtggtgaaaccctgtctctactaaaaatacaaaaattacccaagtgtggtggcacacacctgtaatcccagctacttggaaggctgaggcacaagaatcgcttgaaccagagagatggagattgcagtgagccaagatcataccactgcactccagcctgggcagtagactgagactctgcctcaaaaaaaaaaaaaaaattcattaaattaacaaaattattctaactattcaaaattgctctactaataaaacaataagggtaactctgcaaggccaaggtgggaggatcacttgaggccaggaatttgagaccagcctgggcaacacagcaagatctgtccctaccaaaaaagaaagttttaaattagtcaggtgtgctggtgtgagcctatagtcccagctactcaggaggctgaggtgggaggatgagaggatcccttgtgcccaggagttagaagatgcagtgaactatgattgtaccactgcactccagcctgaacaacacagtgagaccctgtctctagaaataaaattaaaaaaaaattttaagtcaataagcaaagcccaagaactcacatcttagttgataatttaaaggaaaaaaataagaaaaagatgtattttccaaaaacagttaagaataaagttacacaatttagaaaaattaaagagatattttagtgaaacaacaaaaatgtactctaaatcttcaaaaacttccaaatacattttcttgaattggtgataatattgtcttccatcccctccccactctcatggaaacccttccatcacgacagccctagggaaatgggagagctaatgccaacttcagcagcaggaggaaacctttgcaaggaagggcctttgccgacaaaatccttctagtgctagaagaggagacagcatagaaagaggagtaggagataacatccttacttctccattacgatggcctcagagtcaaaatccagaagcgggagaaagaacagaaacacacagagaatgaagaaatggtcacaagctctttagtacacaggctcatgaggtgtcaccgcatgcgtgtgtggacatgaaggagaaagccaattatgattccctgactctcctccagcctccctgaagtctccctggggcttatggaaggcagtggaaagctgaacaccatagagactgccatggagttgctattgttggaggccaaaagagtaagagtcatgatcaactcagtgtaccactggaggctatatgagtaaacagcaaactgtttctcataaatgcagaatgttggcgaactgacaaactgtgtatgccacccagaaggactacaggagggcagtcacaatccaggcacaagtgtttcttgtgattaggcaaatctgaagcctgttagtaataatgtgaacctgtgatcaattaagcagctgaccagtcgttacctcctcctccctgctctttctacccaataaatacaaagggctgcctttgctcgctagaagcagggagctctcttcttcccctggacccttccttaaaatagttacttttgtcttaagttttcatttctatgttcgtcactttgttcagtcttttaatgacggtctcaggcagtaacagtagtgacggtctcaagtagtagcagtggcagtctgtcacagctatgattagggctaagatgacattgtcagaggcatttgaaccagagcaactctgaaatctactgggctgcattcccagatggttaggcattctaagtcacaggatgagataggagatcagtgcaggacacaggtcataaagatcttgctgttaaaacagcttacagtaaagaagctggccaaaacccaccaaaaccaagatggcgacaagagtgatctcaggtcatcctcactgctacactcccaccagcaccatgacagtttacaaatgccacggcaacaacaggaagttaccctatatggtctaaaaaggggaggcatgaatactcagccctttgtttagcatatcatcaagagataaccataaaaatgggccacaatcgactctcggggctgctttttctatggattagccattttttattcctttactttcttaataaacttgctttcactttactctgtagactcaccctgaagtctttcttgcctgagatccaagaactgtcttttgggatctggattgggacccctttcctgtaacgccatggcagagacagcagttcctatgaggggacgagcctaaggcaatggactggaggaaggaagtggctgtgcctcaagggtcttctgtgtcactgagatgacagtggggtcaaggaagcaggaccacaaggctagaacatgttgaggaaactgttcccagatttcaccagcactgaaatcaatggtggatgccagtggctgtctagcaaccaggcaagacaacaattgattctggggatttcagggaggacccaaagggcaggatcaggacctgcttttgacaagctgcctcccttcaattacctgcattatcacaagggtatgtgagctttctccttcacacagatgccatcttggctaaggaaagggcgtgctgggagaaaccatgaaagacaacatttgcctcaaagagactgaattaacccaaaatgagaaaataatggattgataaaatatcttcaaccgcaagatcaagaacccatctcctactcttctacctcctagctcctgctccagccagcagagaccaaacatctgtaagagttttgttctttctagaaaaattttaagcagatatctttaagcacctaaaattgtattaattttacaattagtatttactataattgtattacagcctagttgtacactgtataattttcaccctggccattagcaaaaacagagactctaagagccaaacagatatcaatggccctaaacaaatatggttatggttctcccctttataaatctgtgaatgtgagccttttcttttccagtttgatgtattataaaggtgaccaggaaggaaatggaaacaatgtcaaataagaacagccattctaattccaaacaagttaagaatatatgtctaaagacaaattaagtctgacaaaacgtataagttatgttttgttgtataatcagtaataggagtcaatcaagggtctcattgcaattttatctacagttttttacaaggtaaattacaagaaatatagctcagataaaaagaaaatattaaatgcactcttctagtatattaccacatcagtaattgagaaggattaaataaaagactataataaatatggtaattgcactaagtagttccatgataaatcgattcttattctccaagtaagagctgatttgattgatctctatgcacttcagtgttctggaggatttcctagtccctgaagctgcaggtgtggtcactgtcaggggcaaaacacttaacacagctgagaagtgatttgttccctgtggtcccagctatgcataggcataaccacaaccacccaatataatcaaattaaatcccagctagtgtgacactgccataagaataatgattggatactagcagaagctgtcaagggtcttttatacatccgataaataaatccaactgactagtgaaggtcaattcaatttagcactcattgattacatatctttcatgtgtaagacactgtgctaggcattaaaagaaaactttgactcctcaccaataaaaatgttttattgttaaacagctctcattacgtagtgtaaattgtatgtagtttgtggttatgaagcgtctaaattcacaatgcattctcatttctctcagtgacaggagtatcaaaataaaaatgactaaagccccattagtcacaatatgaccatttggaatctggatcttacataaaagtgtttaaaaactcagttgtttaattttaaatatgaagtaatacagcaaattacttatcattcagcttctcttattcttaataacatagtaactgtgatcttcaggcaaaaccttgataaattctttcccataaaataacccataggaagttttaaaagtcatgcaatatgggtacataaaataaggaaccattctcagactatggcagagccttccaattgcttcctagcatccactctcctctctttctaccagagccctgattatgaggtggataccgactaaaacactgcatttccagactctctcccagttagctgtggcaacgtgaccaaattccagccgattatttgtgagcagaagtgatgagacttctaaaattctccttaaaggaaagaggcacacccttctttattccttcctccttcctactgaccagaaggcaaaataatggctggagctcgagcagctatattggattatgaggatgtaaactaagaatgacagctagaaatagctccaatctctgataaccaggaagtagccagatcagccctggactatctacatccagaatttacataaataggaaagagatacccatctgtgttcttttaatcattgttttatttattttttgtttttttctgaagctgaccaaaacctaacatagtgataaagtcatcccatcagccagaataaattctgagcagttatcaagagaaaacttaaagtaatgtgaagagaagccacacttataaaggaaaccaagagctttcattatagctagcctaaaatgaagttaattacctaaattgttcagtcaccaaggctttgggagttaacatgaggaggctggttttattgtgtatcatgcccagaagttccatgataatttcaaattgtttgcatgtaattccccccccaaaacttgtacaatattttgacattcttaaagaggagaggtgacacagtatcatactactgtgtaataaaaatctgctctgccctcctaccgggtttacaatacagatagtggcacaggaaagcgctcagaacagaaatcagaatgcttgaagcttacttaactcactacagacctggaaagttgcttaaattttataaagcttggttataaggataatgataacagcagctccattttctacgcagggaagttgggataatcaaataaaataaatgtatgtcaaagtgttattgttgttactaaaatcattttggtgctcacttatgtttcactgggagaagcactctgttttcagttttctggaataattaccttttaaaagggactcttttttgcctgcattaacttattttctctaccttctcactttcatggttctgcaggataattttatttttatgatgtctgagttttcatgagctacatgtatgcaaatatttttagctaaaacaatattattgagaatgtgtatttggctaactcataactgcttattttgaaactagctgagaagcacttggactgagactgaaaataaaaataaatttattaacaaattatagaaggctgtgcagttagaatatgtcacttgctgattgaaatccaagtgctatatgcagtaaaatttcttcaacccagaatcaagcatccagacatttcacatagcagcatttactttgatagtattggccagttatcaatggtagtaaaaatgcccctggacttacaaaatattgaagtgccttctgaattatcaaaaacatattaccagtcaatggaacctacacacacacacgcacacacacacatgcatatatattttcacatatatacatgtatttgtaaaaatatatatgtgaaaatatatacatacatgtatggatgtgtgtatatacacatcaagcttctgggcatgatatacaatacatgtatgtatgtgtacatatgtgaaaatatatatacacatacagctgggtgtggtggctcacggctgtaatgccagcactttgggaggccgagttgggcggatcacgaggtcaggagatcgagaccaacctggctaacacggtgaaaccccctctctactaaaaaatacaaaaaaaaattagccaggcgtggtggcgggcacctgtagtcccagctactcgggaggctgaggcaggagaatcacttgaacccgggagacggagcttgcagtgagctgagattgcgccactgcactccagcctgggcgacagaacgagactgtctcacacacacacacacacacacacacacacacacatatatatatatataaaatacatattatatctattatacatatgtatcaatgtataatatatatatacatatattatacatatatatacacatatatgcattttatatacatgtatgtatgtacacatataaatacatgtatgtacatgtatatatatttgagacagggtcttgttctgtttcccaggctggagggcagtggcataaccacagcctcccaagtacctggtactacaagtacacactactacacctggctaatttttatgtttgtagagatcgggtttcacagtgttgctcaggctgtgcttgaatttctgggctcaagcaattctcccacctcagcttcccaaagtgctgagattatacaggtatgagcaactgcacctggctggaactaaaatatttaactaactgatatgtaccactccacaatcatataatatggagattaatattaatggcaataaaaacactagattatctgtgtttacctggagcagaatgaaaaatgctacaattccgtttcacaaatagtgaaggtaacatttaatttcttgctcaaaagaaagcaggttatttgaatttattgttgagaactgccttctgaacgtcattcacttcataggcttccttccaatgtgcttctcattgaccttgggcttccatttgattaataataaaagtcacctaaccttaaacttcactcaattcttctctctcagacactcacacacataccattagaactcccactctccaatacaatctagaaaaacaagacactctgcaaggatatatactcagggcttggccctaccctcacacttttgacagtccaaggaaacatggagaaagaggagctggcctgtgcacattacactttggttttactgctcctttcttggaaaccctactcactctctgcccactatccccgaggctgactggtgagacatttcctctcttatcctctcctctccaaaccctcagtcttcccttatgagcctgctttctttctttaattttccactgctactttcattacactctctgagccagaatactagggtatagagaatatatgtggagtgagacagggagggaaggtttctagggagtgagcacaaggagaccctgacaccagtcctttctgggaactgcagggagatgcattccgtgcctcagtctctgaggtgggcccagaagagaattttgaaatgggctacaatagcttcaggtgtctgtcttctcttgagattcgttccctcccagcccttcgtgtctttcccaggtttttccaaagaaatcctaactctaactcatcattaaggcttaactgttctatgtcccattcctctatggccttactaagtggctagaggtaatggaaataattatttatgagatatgagagagtgacagtgatttactgtgttattactcagataatgcatttactttctaagaagggccttttgtgtccttgctcaaagaaatgaaaattcttagattataggtcttatggtggatcctataaggttaggaaagcttttggaaaccctttaaacaataataataggctatatttaattggttatactaaatatcaagcacttttctaaaagctttacacattttagctcatttgatgttcatagtaatcccagaggaaagtactaatacctttacaaatgaaaatactgagccctgaggagggtgagtaatttaccctcagtcacacagctagtaagtaaatgaactggggtttgaacccaagtagtctggctccagaatccctgctctttattcatccagatagctgtcaaacacagcatcaaggctgaagttagtctgggagtcagaaggcccgagttctagagctggctctgcctctaaggagctatgcaactttgaacaagccacttaaactctctcagttgaactgaatttgtggttgatatccttgtttttttggaagcagagcgatttctttaaatgaaatcctaattaaaagcctgatatacacaacagataaaagggagatattgagcctaggctgctgttatagcgacccacatgttgttcaaaattgaacccttcaccccttactaaagatagcgctctgttgaaccagttgaactccttttgactcaatgatctctactgtttctttcagctacaggaccctatgtaaccaattgtgtagacacacctagcagcttcatgtctcaaaatgtgctcttttctctaccatgcactcaggtggaaacagcctagtgttacagagagaaaagaggcaacacttgagcaaccaaggacatcgatttcatcattttacttgatttcctttagggctcaaccaaataaaagatactaattaaagcctcaccctacactatatatttccctctgagaagcagagatgagaaatgcagcttctaagcacttagcacagtgactaccatcttcgaagcatttgattaatgatcatccatgctaatttgaatactatagcaacagtataactaagacccaaaacatttataacaacattgccctgggtagaactttttgagattaatttcattagatacttgaaaataaattcaattaaccttgtttttcttcttcaataaaattagatatgaggtccctcaatgttaaattcccccctcttctaacaagtatatctagatatagatctggatatacttactttcttcccacttccagatattctcttatgaacctcacttctctttttctgcatagtggaacacattcatctttaaaccatttgtttttcagtattactgtcctacgtttgttacatatcccccactaagaaagcagatgtatcacagatggtgtccttgttaaagggaaaacttctagagagacagcgcaagactcctgggtctttggtttgctttataaagcgcatgtgtatacatgggacatgggtgaatatgtctgtgcgatagagcttatgacaccctaaaagctagaggaatcatgctatactcattttctgagaaattcaccaagtattgaaaagtgaactggtcttgggcagaagtctacattttgtacagttaggctaaaatgtctaaccatgttaggctctccttttgcagcagcccattaacaaaactgaggtgtaggtgaagagggttaataacaaaaagctctgtagtctctggagagctcagaagaaagattttcaggaatgactgggaggctgctcaggtgtgctttggagttttccagtctttgagatgtgttacttgcattctttgctcctcgagggcatttgcatccccactgtggttaagtatagtaataagcagaaattagaagctgaatgcaaaccgagtgagtgaaagaataagggatgcagtgaacaataagaagaattgatggagaaactgcagtctagtgatatgaacacatggcaggaagcaaaaagaatttctaaatgtgaacagatcaaaaccctgttcaacttccttgtgccccaaaaggaggtggtcagaagttttcttcaaaggctcttcgttcttggaaggaaagtgttttttcactctttatcagcctctgacttcatagctgtgttaccaaaagggctgggagcaaggatgtgggtttagaccctgcggccaaaggctgctctgctctttgccagttgctctgttcctgccaaccacagctacccttctctcttctagcctggccgctcacctctcagcctggccattctccagctagggccattgcagacatctgaattaatcaaaaactgtcttcccttcatatcacctcagaaacttaatataagaacgtaagaagtgttgcacccactaagactagtagttcattcaatttaatattctctccaatggtgacaccaagggacctttaccgggatggaaaaagaggcattgtgaatagcaagcatgccaaaagtttggatgccattatctctaatttcagtccctaattatagttaactatttacggaaacatgtagtgtatgctgtatctatcaatgtggtaagtctgtaaaccttaatttttttttttttgagacagagtttcactcttgtcgcccaggctgcagtgcagtagtgcgatcttggcccgctgcaacctccgcctcctgggttcaagtgattctcctgcctcagcctccggagtagctgggagtacaagtgtgcaccaccacgcccggctaatttttgtatttttagtagagacagggtttccccatgttggccaacatattcttgatctcctgaccttgcgatccacccccctcagcctcctaaagtgctgggattacaggcgtgagccattgcgaccagccaaaacttaatttttataaactaaaacctcttctgggacatcattgccttttttttatttgtactattttttttggtcatttaaatcaatttaataagtatttctatgtctactgtgtatctataattcaaagccttcacattcttggaagctgaaggtctggggaggagaggaagtgggagggactgggacactaagattaaaatgatgtgtctttcattcaagaaggtaaccatccagtgggggagctagaatcacccacagctcactgtaatataagtagagcagtgagaagtaatcaccgaggcataaatgaggtgtttatggatgtacaaaagagggaatcagtaattctgaatcaggcataaggaaacaactcttagggtaggtgtcatttgagctgggctttaatgaatgagcagaattttcttcattgaaattaacatttaagcaaagtaaacactagaaacagaattgtgaatgtgcataatgtgtttggggagaggattcaaaaaaggctggtatcagtgttgccagaaaaaaattggaatggtagattgggattggtttactgagagctttgaacaagttaaagcttttgggctttgtacagtgggcagtggggaagtagtaaaggacactctaagtctctgctcttgaaatagatagtctaggacactctactatctccactattcaaatgagaaaaatgagattagaaggagtaagaaactcactctaaagaaagtatgaaagtgatatttgagctgaagtttcactctagcgtccaaatactacacctagtcttagtctttctttaaaaaaattttagaattattttaattgacaagtaaaaattatagtaataacatgatgttttgatatatgtcttaatctcaatttaattatttataaaataggaataataacaacactccctagctaactaaaaatttgatcaaataaaactacagatggtaaaatgccttagaaagtacaaaatacttttataagtgttcactattaatattattttacatttatcactattcaactaatataactcctaaatatagttctggaaaggaaattagtgttatttgatgttaatattgtctataaatgattgcattcctactgggctttatatatacgtattatctcatttccttgctatcttgtgaaataggtgttgttatctccaatttatagatgagtaaacagaggctgaaagagattaaaacctactcagtcacacagctggtaagtcaagaaccatacttcaaatttatgtctttaaatccccaaatcccttccataaggctactcattgccttccttattgatgatgctataaaccttggagtttacagtggcacactgaaatgacgtcttcagggaacaattaatgatgccagaaatttcagcatttccaacaaagatgtgagtgtctggttttttgtgctttaaaagagatgtaactctttctaatcctgttaagaattaggttgaatagttaagtagtaattaggcttgacttacctaaaaaaaaaatacccattctatcctactctctgagacaaaataatgtctttaagaataattttactgttgatttaaaaaaacttccctgtttaagtaatggtattggttccttataattattttaaactttaaaatcttccctaaacatttactgaatcatttgtatctattttgtttttgtttttgagaaggagtctccctctgtcacccaggctgaagtgcagtggcgcggctcactgcaagctccgcctcgtgggttcatgccattctcctgcctcagcctcccgagtagctgggactacaggcgcccgccaccatgcccggctaatttttttgtatttttatttatttatttatttatttatttatttatttatttattgagacggagtctcgctctgtcgcgcaggctggagtgcagtggcgagatctcggctcactgcaagctccgcctcccaggttcacgccattctcctgcctcagcctccggagtaggtgggactacaggcgcccgccaccgcgcccagcctttttttgtgtttttagtagagacggggtttcaccatgttagccaggatggtctcgatctcctgacctcgtgatccgcccgccttggcctccaaaagtgctgggattgcaggcatgagccactgcgcctggcctgtttctatgttttgaagtatatttcttggctgggcgtggtagctcatgcgtgtaatcccagcactttgggaagccgaggaggacagatcaattgaggttgggagttcgagtccagactggcaaacatgataaaaccctgtctctactaaaaatacaaaaattagctgagcttggtggtgcatgcctgtaatcccagctacttgggaggctgaggcaggagaatagcttgaacctgggaggtgaaagatgcagtgagcagagattgcactactgcactccagcctgggtgacagagggagactgtctcccaaaaaataaaaataaaataagtaaataaataaagtatacgtctcttctcttggttatgaaacttaaaaatatatacataacaggttagataatattgtacaaaaatttggtgattgttattcatgatagatttattcttctgaaatatgtgtatattttacacatagcaaaaaatgatcagaatagataataagcagagtttgatcaaattcatattgttggcagactttcatattcgatgaagtcaatccaataatccaattataattgttattaatgaccaccagatattctgatttaattattggaaagtaattgctgtagctctttttaaaaaaacatttttgctgttttatgagtagttttccaaaaatgttgtaaactgataaagtgaacatagaaatcatgaaattctagctttgagattagggtcaacaacaatgcatttagtgacacataaagcagaatataagccacatctgaagaggttgaaagcagaacactaagctcagcagctatattcagacaaatctttgtcttttacaccaattccaatattgtagccatagtatgactgttttgagacatagaatcataaaatcctgagttggaagaagacttaaagaagatatttgtattccatccatctacagcaaactccctagtggttttctggtatgtgcttgaatatttgaagtgacagggaactcattattgcttaaggtcagccctgccaccttagggcacattggtttagcacctttctagattaagtcagactctttctctctgtagcttcttagtccgcccttcagggcatatgaaataaatctctatttaatgtgacactccttcatgcatttgagagaatctcaccatggttcttagatgcagtcaggtttgaagggaaatttacaaagacaaatatttgaaagaatattaatcaaaaccataacaatgattaagtttgagtggtgaagtatagggaatttttctttggtcctcgtgctttcctgtattgcttaaattttatacatgaatatatattctaattacaatgaaagaaaatgtagagcgatttacactttgggaaagctatttaagtcctaaatgcaatcagtgaaaactgagacttcgctctgaagaatgagagaatctgaaatctgaaatctgcaagtgataaacctcaatgtccccacaacctagacccacatgatagaagctcattaaaaatgtgaatatgactaaataaatcaacaaatcattcatttaattggtggtcaaaatctacttggagacacagtcatcacttgggaagtaacagctccactaagaaccaagttgttactgctgtgaatccaagtactaagaggaaaagaatcacttccatcctaattcaaattgatttaatgccccttttaattgtgtatttctcaaatacatcacagtccggaaattctctggtagttctgtttgtgactttacagctagagatgaactgaggtactcagaaataaattactgttttgcttgaatctcgatacatctatgaaaattttgcacagggaacgacgatggtgcttattatgatgacggtggataagtaccatatttaaaatctggcgtgtggctgggcacggtggctcacgcctgtaatcccagcacttcaggaggccgaggagggcggatcacgaggtcaggagatcgagaccatcgtggctaacacggtgaaaccccttctctaccaaaaaacaaaaaattagccgggcgtggtggcgggcgcctgtagtcccagctactcgggttgaattcattcaaataaatgtcaattgaccccagagatgcctgagaactgttgactattgtcacacttacattgaaatattcaaaagacaatgtacaaaataagactaaagataaacatcaagatgtacaaatttttccactttatatatctatggataagttgcattctgaattcatttagtgataataatagaattagagtttggagacgctgagattttgtttccttgaacaaaatgttttgcacagttctaatcagtctgatcagttctgtggaaatcagagagcagtcagttgaagagaaaactggtgaatgaataaaatatcaaatgcatcaaatagatttcacctgttagcagaaagggatggaaaactcagaaacagggggcaagaatttttctttctgaaagacaaaatgtgctccactcaaactgcattgtattttaccagaagaagctaaagcaaatttcaaaattaagcagggagagatgataatcagaatagtttcactgatgacaaatggtctgccctaggtcctgaattttctacagtctcttaggagttcctctgtaactaggaagcacaagtatcttctgcttttcagtaagcattctcccaaattacaagtccgagaggacgggtaaaaggaaaaataaaaaaagagacaaaagccaatagggccaaaagagatgtattcttagtaacccaaattgtgataaactcttggctttagcaaaaaccacaggcctgtgtggaagtagaagtgcagtttttctgtacaaccatctgctgccaggaaaccaatagtttctccactgcagaagtggtcctggatcaaacaaggaaggatctaaatgtttgcagtcatgtgcacacacctagattggacatatggaccttcacattttttgctgagaatcttgtttgcttaatctaatcagcactcttagaaaagctgcctcaccactgctccccaaaattatttctggtggtttgaaaatgtccagacattgataatagagtcaaagcctttcttccatggggttttaaacaaaccctcgaagataaacttgaagcttctgaaactaatcacagtagtaattatttgctcatggataacacatgattatattctaaacccaagtcaggtgtgaaccccagctttatttctcattaactgttgtgtatttggtcaagtgacttttcttccacaaaccccagtttccttatctggaaagtgctgataacacctacctgctgtcattgacatgagaatttgataacatacgaaaagtgtaggtgctcataaaatggtatctgccactatggtcattatcaccagttcaaatttctttaaaacgttgttagtgttcatgtgtccctgaaagcattctctttccatttctgggagtttggttacttaacatcctttactattaagaagctcattttaaagcagatgtggtcaaaatgagtgaataattcaagaaggatgaagacatgggatctagacaaaggactatcaatataaataaaagaggcaaaaggatgaatagcagagaaaaccagaaaaatgttagactcccaaagtgggtaaagattatcagataggtttgggcacttggaagactattaagatttagccactgttccaaagcaaacttaagcaaattcaaaacttgatgagttcgtaactctagaaaaaaagagaaatgtattcaagaaaagaaacataattacagtactactgattcctcagtgaaggatattttcattatcatgaaaatgcaaacattgaatgttgatttaatgaaagtcagttataactataatgggagaatgggtgaggagagagctaaatccagcaaaatagaaaatcagcatataatgtctataaagttgattgagtgtgagataacaatatattatttaaaattatggtgtcatatgctagaaaaaacattgaaaaaataagctgaaaggagtagccactggaaagcaggtggtctaggggtagggttagaatggggactgtgggtttcatgcatgataagcctttcagcactatttgactttttaaagagatgcacatagtattttaataaaaatttatgaaaaaacttaagaaaagaaatacacatttgaggtataacagatatctctcttgctccttcacacacacacaaataagcacaagtgtataaaaatctatgtaacttactctttgttacaagagttccttagccacaaataaatgaatatccatcatttaacaattaaaggcataggatttagcagttaggatgaagagtaaagcaaaaggaggcagaaaatcttaacaaatggaagacatggtacctgtattcaaggattttgcaatttggttgagaaaagaaatccatctcattcaggagaaagagtgggaacctgaaatttctttttggagaaaaaaagaatctatacttttgagtcttgctatttttgtctcctagagttttcctgtgagctgttttccaggactcagaagagaaaagcttatctgtgtttagctgacaagaccaccttcatgacatttccagagagaaaggagaatcatggcttttcagtgagaagataccacatagaaatatcatccccttattttacagatgaggtactaagcctaaaagaagctgtgtatttttcccaagttcacacatcctgtctgtgacaagaaccagctttctaacgtcacttgtgtgttctggtgaatgtgcgattgcccaatactaaactgggaagtctgtagtaaacatgagatgagaacaatcataattaattttctaatattgttcaattaatgaaatgaatataacaaagtaacactaaccacttgtatagcactttcaagtgtctttactgggtgcaaagcctcatacctgtaatcccagcactttgggaggctaagacaggaggaatgcttgaggccaggagtttaagaccagcctgggcaacacagtgagacctgtttctaaaaacaataaaaaataaaaaaaataagcctagtgaggtgtcgcatgcctgtagtcccagccactggggaggctgaggtgggaggatcacttaagccaggaggctgaggctgcaacgagttatgatcacaccatggcactctagccttcgggacagagtaagaccctatctcttaaaaaaaaagtctgtattttcattatctcatttaattgtaacaatcttatgctgataagaaaattcaagttgattcagagacatttaatggattgtcaagggcaaataaccagtaaataacaaatcaaataattcgaccaaggtgttctggctccttgtccaatgtagaacattttctctttcattatgacacacaaaactttagagagcatttttgtaaaatgactgtatttaaaatatactttaaaatattttaaattacatatggccaaaataaatgaattagttcagctttggattattaatagtctgaatgaatagtcacagggatattcaaaacggtcatggtgtgagaaaatctcggacagggataagagtcatgcatatctaattagagctgcccaacatttaaggcagtgattacacttcatgatatgccaatattatttctccaaaatatttcaagtaaaaacccgttttgtcccgttaattcttaaaataaaagggttgggcaaaaaatttaaatggtcaagaaatgttgaaactaacaaaggacaattgcttttcctctaaaaacagctcctcctggatctcctaagaagaagactccaactcacagaccactgctgactcattaaaatcaacttgtaatgtcatgcacatactgtgtatctgtccaattcatgcacatacatccagaatgtaggatgctttggtatcaaagagctgtttatgattgacaaatacttcaatgctctaagattccattttcatcttctttaataaggaaagacaaatgcaaaaatacatgtcattaattgctctgcatttttccctccagagaaatgcaaaccataaacatcagtaagattctactaatagctttaaaagttggcttaaaccattattaattatacatttgtaagacggtctgtgactgcatgccttgctttcttattcaaaggttcaatcaataaggtcatccctgccacttgcactctgaatggcaatgcacaaatttagtgcctatagaagtataaatagatatgtgtctacatatatatcctagtatcatgaagttacattttaaccatgtagcttgcttgtgtataggagattacatttttccagggaggtgggtagatgacatttttattgattttttaaatagctacattataaatctctcttgttgggccagcacaaggcaaaactaaaacaacatctttattgtaaggcaaatgcatctttggataacttgtaatattttttttaaatgggtctttcacttttcaacctgttttggggtgagtaacctatattgctcctctcagatcaaattgtgttatttcttatcatcacatgattgcaacttttagagaaaaatgattgcagttccttataataattctacctccagttacattgatttactgttatggacatatcgttagatagatgtcaaggaattttggcattcactgggaagtaattacattgacttagttccagttttaggtttgagtttcctaaccaaacgtggaaagctttgcagttccttaaatcatagaggctctcacagaaggatttcttaacctatgggcataaatgccgaagaggtctatagatagacttcggcaggtctgtacaatttctgacactgtgcaaaaatcctctgcaccttttgtgggagtaccacatacctatcatcaatttctcagaagggtcgttgatcctaaaataattaagaaccaatgttctttctaattaaatatcacttaaaacagcctcaattgtggatttcagaattattttctctcaatgttctttgcaaaatcagattcaaacaaccttgtatgttatattcaaagccttctttttaaaaattgcataagaatattatgcataaacactgattatccatagtcttttgtaacttggcctcagaaacttatggttaacagattaggtccctcattctaattgtatttttttatcagactttgattttcagtgtggtaggtaaacccatcttcccattttatacaaacaataggtttcagtagtgtcagttatagagatcatgacttgaactctgttatcaaaatgtatgataataactctagacctgaggaattgaagactggcatgaactcagaaagtcacaggctcatcaagagacattgcccaatatttgttctttgataaaaatcatctttcagataaaatgaagcttctgcagctttgttatacagactaaatatgcaaacatctaatttaaggaaatagtttgataaattagttttctccttcggagagaattgtctggaaatgtgtacttaaagatgtagaattataacagattttttaaaggtctttggagacaaagactcactttaggtatcactttgagagacatacaaaccctaattccttttatcaaaaagagaatagagattggaggcatcaatagaaagatgatactttctaagaaattgtgcctaatcatctgtgaataggtttatgtgattatggaagctgatcagggcctgtggtgatccaggcattgttgtagtggcagcaccacatttttgtgcagtcagacacaaactggcattctagtacctgctgcttcaggaaatgccagaacagtgcctatgtggaccaaggccccacagatggcctcacccctcaaacccttgggtacatagcacctgtttagtggccctggcccttgcttttaaggagtggttccaactgagggcaattatgtcccccatagtacatttggcaatgtctgtgaatatttttgattgtcacatcagagaggtattgctggcatctcatgagtagaagtcagggacattgggaaataacctacaatgcataggacagccctcacaacaaagaattacctgtcccatgtgtcaatagtgccaaggttgagaaaccctgccctaaagccatgccactttgatgaccctgagaggttatatagaaaggatctatgtagagccacactacccacaggaccactaaagtttagtccatttgacagatttggaaactgtaatgctttggacagagtgaagtgaaaaaatatcctacaatgtccttcctttacaggttaacacctattcctttccccaaaatgaggattaaatgccaccttctacaggaatacctcccatgttagcatcacgtttccatgtattctcatgataccatgtgcttactctaattgcagctctgattatttcctgttcccctaccaggttataaattcactgagagcttgctgtttttattaattcttgggtcttagtacctaccagagcttggcacttaataggtatgcaataaatatatgttgaaggaaagagcaagcctgcagaagtgacttaaattctccatgacaaacatccatccagaatggatttactcaaggctagtactagcaagcacactggccccaaggacatttggccccatgccctctgaggacatgaaactggggaatgtctcaccccatggcctgtaggtttaccagcatgatggtggaaatttcgggtgagccatagccatagtagtcataatgacttttaaattttatttatgtatttattttaataatcacaattgtacatattcgcagggcacagagcgatgtttcgatacatataatgtatactggtcagatgagggtaattagcacatcatcatctcaaacatttatcatttctttgtgttgggaacattcaatagcctccttctagctatttgtaactgtatattagcattaactgtagtcatcctacaggagtatagaacactggaacttatttctgttatctctcttatctagctatgatttttgtatactttaacaaaactctgcctatcctgaaatactaaagaatcaagattgtagagacaataagatctggtcctaggcctagaacccccacatgggaggaaccagggacagaattctccttggatatcttttctcacgaagaaagagggatacttttaatgagcttgactttgcagtctacatttgacagagcttctcccttcattgaagaaggaagaccaatagtgacctcaataagtacatgaacaaatagctggggatcccagtattcataaccaccaatactcagctcacaccaaaactcaggcacaagtcaattaaagggttgtactatgagcaaggacaattcttattttggctgcctgtaaattacaccaaaatccacaagaaagggaaataactaagcttacaataatttataaatgcactctgtgttaagaacaataatcttgagataataaaacaaagaaacatcatgttgaaaatcggaaaagagcaactctcatatttatattaaatcaacaataatttgttatgcacatgattatggaatataaaacaaaatgatctaatttttccagatagcatggggctgttgcattacattgtgctattatttgacaaagcacatcaaatgggatttcagcaaaatacttaacatagttataggtaaagtattcctgacgtgagttgacatcaggaagaaaacacagcgacatttcagaatattcaactttattttccattgacaaacacgacataaataacacacatttattaaatacacagactagccatgacttgaatgccagcaaaagtctaacgtacttttcatacgctcttttattttttgtctccacagtattgaagaccagcctttaaaacatactagaagatatatttaaatacactgacgataactacccataaaactttacatagaggtgataaaagagacttttccatttaatcaagtatatagagatggatgctgaggaggagaggtgaagaacactatgcttttgatactgatctttacaatatggattaaagtgccaatgatttcagctcctcctaggcacaccatgtaaatagtacttacattcatttgttacaaacagatcaaaataatcagtgcctattttaattggtttgcttaaacaggcttacactatttgtacaaaaacatttgataaggagagcaagaaggcaaagtatttttttctctttcaaggaagagttgggaaggaagagagttcagcagtcaataatggcctgagtgaacttatcatttgctttgacagacaagacccctggccactcagtagtactactgatgctcaagtgttcaaagataaatgcagtcggtcccttcctctctttgcttccagggcctggcacaaaatgatgaaggttaacaggtagaaaatggacaggttttccatcatatctttttctatgttctctgccccacccacatgagtatcctttcaaaagtagaacgttgaagtgtattagtaaatcacacgcatttccctctgcttaacattacaactttgatttctacagacatggaaaactgtatgagaaatctatatttgaattactattaaagtttaatgattggctgtttttgcctagacgtttggcttactttaattaaaggatcaaaatattctaattctaaagcatttaacaatagcattgaagagatgcacaaatgataataacttgagaagtggaatcatctccaaaaatgctcaaaaaagcatgaaaaggctgacttgtttctgatggtgatctctttccttcttatctttactcccataataaattcttcaacaaagcagacttactacacaacagattctgatctgtttcacatattaggctactggcactttaaaaatatgaagttattatctctcctcttaaaaacaatcccagcctcatcaacaggaattatgtctgttactttctttctgtgaaagaatggataagcacagtagagtcaaggggactaggagaaaacagtgtagtttcaaatgaagaaatacataatctagtagatatctgggttgcttattacatgaaactgattgatacaaagcttctgaaaataagataatttttattctcagtaaagaaaatgtgtgacataaataaatataatacatatctgattgaattatatttctagagaatcataatgcactctgcttatggtatcataatgtaatggtatatgactaaacttatataaattataacccttaaatagaatcttcattttaggaattataaaagggaatatatcaaataaaatattttccctaattcttttatcatcatcaccacctagttagtttccttacaatactgaactgatgtcagcttcttaacaaatatgtatgtgagtttaggttggttattaaattttgtaaattggctcgatcataacctatgtcatgaaacatcacagacatctgtcactttgtcagcactttgttgcaactcagaaaagtcttatggactaggccacagttgcacaattctgcacattttttagacctcagttttaacagattttgagatatgtaaacatataaaacaagcaataaacaagcagctgtgaaaatttgtcattgttgatggtttgtacttgttatacagataaaaaatagaaattttaattcttcaagttaggctttttatgtgtttgtaataataaatactctgtagtctccctgtgtcattcagctcctagaatcctgtgtattgcaggagaagcttttggggttaaattatgaaaataaatagatattatgcatgtctaaaatttcaaagaacaaaagttttctattttctttttctgagttgatctcaaccaaaagaactattagtgattgctgatgtggagaaggttgaaagctgaccaataatttggagtcaaaaagaacaaaattataaaaagcgttgaataaataaaaagcctaatctacttgaaaatccaatattagaatactgccacagagtgacccccttattaaaatactgtttgccagtttttagtttgtctgtcactcaatgccaatgtgctcacaggatctttcatagttaacttacatgaggttttgcattattttctgcaacatggtcggatatttcataaaataaagaaatgtaagtagaaatatatgtataccctatatttcagactagtttaaatctggcatgattaaacacttacatttacctaaaatatcttgggatatatacagcactaggttaacttggtaaatattgagataactcatttttgtttcttcaacttcaagatatttttaagacattcatcatacctattttatttgaaaagtaaactgctctcattaagtaacatgtgatcattcttctctgtgactcagcatagtatataaattcattgtttggaaaatcaacactacttggtaaaattgacacttgctaattttacatatatttctacatttcattcgcttacttcttccaccatggttttcttggcctttaattgtcttttaaccaatacttcaaaattcaggaattgtcataatctatacatgcatttttcctgattagacatatgtatggacaaactaagtatacatgagtgaacttgaaagccaataaaattaaacttagacacgtctttctgctgtgactacatatatcctctttctaaccaccgctctagtctctgtacatctctgaaatctaacctcaaccatcatgaaaaggctgaaatcatttgggattttcatttcttatcaggtttccccatactaacgaatgcctagataataaaactcatatgccatttacataatttctttgttttccacctccctttcaagcttgttaaaaaaaacacaaaagctgccattcatcccctcctaaaatatatcccctgggcaggaatttaatttgcagttaagaataagtgtcaggttttttgcctttctgtatttttgcagtttgatgaaaagtgatattcttgtgatagtaatgtccactatcatttggaagtatcagtctcctaaattattagtataaataaagcactgtgttgtacagcagtatgacactacacccttgaagataaattcatatttctgtaattaaataatcagaaataattcactttatcagcctgatggactgtaatggcatgaagcacttcaatcatatggtatgtgccttgccaatgtgtactgtcctggcaaacttctgctcattgattcactgaataaatatgtattagacagtttctatattccaggtgctatactagatgctggaaggaataacctaatcatgctcatgccactcaaattcacattgcctctgtgtctatctgactagaacttagggtcacaggaccaaccaagaggtaaagcctctttattatgtgatttcagtgcacttttgaaaaaaagtaggtagttttgtcttatacccaatgagatgacctacaggataatccaattctatggcatagagagattttagtatagtctatttatcaccttttccaaaatttagattagtagaaccatcattaattacataagcactctcaacagattttgtctccaaattcaatttgacatggtcatttaaaataattagccccaattgacataggctggtgtatatatcaatctgatagacatattgtacctatcaaaattaattctttaccactaaacacacacagaaatatgcagttactacaagaagtataaataaatctcaagcttttaaaaaactagaaaagcagtgcaagaaactgcaaatgaaaatcttcacaataaaaagttaatgggtttacaaaatgaatgcaccaaagaatatggcaagctttgtgtaggcataactacaggattactatgtttggtggggagacatttttaagaagtgcaattcccaaaacttaatgtagtgatctacttgtgcacaaatacgtcaagcttagctattgaggtttgtattcatgtagactgtaggaaaaacattttagtaataaatatttagatagagccactttgaggagcaggcagaagagctgtgaagggtcaatgttattaactttcttatataaataggccaaaatatggaaagtattcattgagtcttcaaaatatttatttgttttggaatcagtattggaatttaaagagtcaaagactggggaacacttttggtgaataatcaagggaaatatatattcagagtacctatagttagtgctcaaatcggtccttacatagcattctgaaaaaccacttcacgactctcataggtcagtttcatgaatcttccttaggctcatagaaatgtaaaatatattcaaaagaaagaataattagcaatttgggtagtcacaaactccatatttcaaacaaatggaattggttcttattcagataaagagtaaacctaattatcaatccaagtaaacttaaactttgttaggttaggagctaatttgctgtattgagcaatatttgaataatggtatcgatgaatattataaatacattatacatttttaactgtaattaaacttttctttaatgtaaggaggaaaaaagtgacagaaagcgagagaggcaatgaaagagaacacagcaatgtctttgaataaaaacaaactgctatcccttgtcttcaatgatgtatgtggttaaattcctcatgtattcagtgtactggaatattaactatccccgctccccaatagaccaagatcatttataaaaaatgttttcatcacataattaatcacatattcagctacgaatggcagactcaacaaaaacactagactgttattaatatattttcctttgtttgtgtttcactacttttggcacatagggattttctatgcttctaagaccatttagctttataccaaaaattccacttcaatgcataaacagtggcatgccagagatgcctaaattcacagtaaggtttagcgatatttgttaccaaaagctgtgcacatgcaagttaagtgttttctttcatgcttctgtctgtattatttcattagataatgagataggctgccctttctgtccatcattagagcagctggagacagcatttgctacctggcaaaactttcgaagaaggatctttcttaacagcaggtaaacccaaggatccaagatctggttcagtgaagccaggcgaacagctattaagaagaagttgcattctttctgcttctccgtgtgtgtcttgcagtgctcaactgatgtctgattgaagatcattttcaacatcattatctaagaaaaggggacaaataattgtttcaaagattagtaaggtcatatgcatctcctctacactgtactttgcacatagttggttttcaataaattggttgttggattgaaatgattaattcaagcaacatttatacttggataacacagtcctgaattatacaagacattcctaggtattttcccacatttgtggctatttatcatgatgtagcttttaaaacatgcatgtcttcaggctcttgattcttggaatttaagaagcttgaaaataacacatctcaaaatgagccaaagtcatgtttgttgcagaaaacaccacaagttcacccaaatgagagccaacacttcaacaataacaaaaacatcttaatcttaaatttccagtagttctaattttaaaaattactgcagaaaaagtagacgcaagaaaggaggaaatattattattattattattattattgccactagcattttcagaatccttactatttagcagacatggtgccgagttcttcatatgcatttaataaacagcataacacaggtagtattaccacttccttctggatgagccagactaataccatatgatgtacaatattatacttttctttgcccccacccaatatacactgcaatgtaaactccatgatagcaggaatttgggactattttttccccaagtgcctagatcaataggtagcagatagcagatgttcagtaagtatttgtgagagaacaaatttttatatttgaaggaatatattatacaacataaaaatgacagtatatgagttatatgtatttgtgcgagaacaaatttttatatttgaaggaatatattatacaacacacaaatgacagtatgttatataatatgtatttatatttgaattaaaaagatgttcttatgcatattaaaaatgttcaggccaggtgtggtggctcacgcctgtaatcccggcactttgggaggccgaggcaggcggatcacttgaggtcaggagttcgagaccagcctgaccaacatagagaaaccctgtctctactaaaaatacaaaattggctgggtgtgatggtgcatgcctgtaatcccagctactcaggaggctgaggcaggagaatcccttgaacccgggaggtggaggttgcagtgagccaggatcatgccattgcactccagcctgggcaacaagagcaaaactctgtctcaaaaaaaaaaaaaaaagaaaacaaattggaactatttcacctgctgtttcccagctatgcaactcctaggaatatactgtccagaattcctgcaccaagagtactgtatatgactgtttcataacagcattgttcataatagcaaaaaaagcaggaacaactcaaacatgggttcacaatcccaagcaaagaaatgagctgagtttgtaactggctcctaagtttcccattctagacctatacagctattgagtacttgacatgtagccaaagcacactgaaatgttagaatatgttgattccataatggaataataatatttctatatattgtgttaaataaacatatattattcaaattaatgtcacttgtttcttttgactttttaaaaatgcagctactagaaaactttaaattatatgtggcttgtggtttttttttgctcacagtacatttctattgaacctaatctctctctcttgaggcttacacttatctgtatgttctgccctcaggtcacataacttaaattgaattcaacatccctgagcatccaaaacatccctaaccacttaaccacaattccagtgatggcactttgatacactcaccctggatcaacatttcagagtctgtgaactcttcttttcctcatcctctgcaatgccttttgctcttgcttcactctcattcttgttcagatcttcctctcatttgaattatggtaataacagacacccagatggtacatgtacggactgaatgtttgtgcctcccttcaatttatatgtgggagccccaaccctttatgtgatggtattaggaagtgaggcctttgggaggtaattaggtttagatgaggtcatgagggtggagctcctataatgggattattatccttataagaagagggagaagaacccacaggtctctccttcagccatgtggggcacagcaagaagacagcagtctacaagccaggaaaagggccttcaccagaaactgaatctgggggcaccttgatcttagaatcttcagcttcctgaatggtgagaaataaatgtctgctgtttaagccatcaagtttacacctttgttatggcagcccaagcagactaagacagtgtttacagatatctgcccatcacaggtgcagcttccaatcccagctgtgatcaaatcctctccaactagaaaatcatcaatgtcttcccattgtccatcgaacagaaatttaactctggtattcaaagccctctacagtactgtccaaactattctttccagttttgtctcccactaattgcctatacagactccaaactctagctatagtccattggttttattctttcctccctcttggcctttattctttcttttttctacccctgcaacacttttaatcctcatcatttctacttctgagacttccaagtctttcaggactatctcagttgttcctgattattccaaaccactggcctctgaaggcctacaattgtgtgtgtgtgtgtgtgatataaccacatatttgtagtagatagacagatagacaatactagcaggcatccacatgtccctcaaaaacttggacgtatgggggaagaaaatgtgggtctctaagatttaaagtggacataacatcaacacgtaggaacccagctccaaggttactgaacttgactgcaagcaattgaacaaagtatcgacatatctgaaatcgatttgctttgggaaaaaggatacttaaccatcaggtttgagtattttctattcttgttggcaaaattgactactattgtgagataaaagatgtaattgtctatattagtttgaagtaagtaaatatttgattcttttaattccccatcttctgtgtctttttccactaagctgataatgactggtcccagtgttgataagtcaacaggaaaagagagctgagtcataggatttctggtattgccaattctgctcatgtatactcaattttatttcaaaaatacaattatataacaaaaaagcaggtagagcaggttaagcagacagacaagagagagaggaaataatacacgaaaattcttacaagactgtgtgacactggtatccagccattttcccttttgtcttatttagtcacagtttttattcttaaacgaatccctggcaaaggggatgggaatttccagttttggcttataaggcaaactcatgctctggggcttgactcatattttgttttttgagacagtgtctcactccgtcaccaaggcttgggtgcagtggcacaatcatagctcactgtagtcctgaactcctgggctcaaatgatcctcctgcctcagcctcccgagatgctgggattacaggtatatgccaccacactcaattaatatttttattttttgtagtgacggggtctcactatgttaactaggctgatctcaaacttctggcttcaagcaatcctcttgtgtaatttctttcacaggaatttttccaaatgatttatccaataaaagcaaatagtagctatacaataaataaatgttcagaggagcattatatatgccagcaagaaattgcagacacatacatctctaacatcaggtgtaaagcttaataaaacaataattcacaaatagtatatataagtattaagtgaaaaaacagaatataagatactttatatataaagttttgttgttatattatttaaaataggcagacttgtggaaggcaatggaattactgctatttaacaataatttacttttaaacaatataatttaattttaaaattgtatgtacacaggccaggtgtggtggctcatgcctgtaatcccagcactttgggaggtcgaggcagatggatcccctgaacccagcagttcgagaccagcctgggcaacatggtgaaaccctgtctctattaaaaacacaaaaattagccgggcatgatggtgtgtgcctgtaatcctagctacttgggaggctgaagcaggagaatcacttgaacctaggaggcagatgttgcagtgagccaagatagcaccactgcactccagcctggatgacagagtgagacttgggctcaaaaaaaaaaaaattgtatgtatataaaaacatttcaaatgatgttaatgaaagtcttttatttaaagaaagcagatggttattattcccttctttggtaaatatggacaattatacaccgaatttacttaaaataaatatatttacatcaatatattctgatgctggctggcttatcatcctatgagctgaatgctaccccccatcatagaaggcagaataatgcccctcctgccacacacaaagatatccatttctcggtccctggaatctgtgaatacgttaccacacaagacaaaaaggactctgcagatgtgattaaggtaaaggacccagacgtgaggagataatcctagattacctgcgtggacccaatgtaaaaacaagtgtcctaaaaaatcagagaacttttcccagctgtggccagagggagagatgactatagaagaatggtcagagatacacagtatctctggctttgaaggtggaggaagggatccaggaggtaaggaatgaggatgacctcctctaaaaactgaaaaaggcaaagaaacacttttctctcagagacttaaaaagtaatgcagccctgtagcacctttactttagcccagtgagatccatcagacttctaacctacagaacagagaaatgtgtgttgctcttaagccactgatatggtctagctctgtgtccccgcccaaatctcatgtcaaattctaatcctcagtgttggagaaggggcttggtgggaggtgactggatcatgggggcagacttcccccttgctgttcttataatagtgagtgacttctcatgagatatgcttgtttaaaagtgtgtaacactttcctctctgctctctttcctgctccaccatgtgaagatgtgtctgcttccccttcaccttccaccatgatcacaagtttcttgaggcctccccagccatgcttcctgtacagccagcagaacctgtgcttttgagacagtcttgctctgttccccaggctggaatgcagtggtgcaatcttggctcactgcaaccttcacttcctgtgttcaagccattcttgtgcctcagactcccaagtagctgggatcacaggcacgtgccaccaggcctggctaatttatgtatttttagtagagatggggtttcaccatattggccaggctggtctcaaactcctgggctcagggaatccacccgtctcgaccttccaaagtgctgggattacaggcgtgagtcaccaccacctggccccaggtagttctttacagcaagtctcaggtggactaatacagccaccaagattacaataatttgctacagcagcagtagaaaacaaatatgcccacacactgagctctcaaccaatgttaagaggaatagaaggaatgagcttgaaaacgattttttcattctcatagataaaatagcctaggaagcttctttaaatttttttactttcctaggaaacttaaaaataaatgaataaagtaaaagtaaacttcattctaactcctgtcccaattatctcaatttctaaatttacaacatgcaaaaccgaatgcctgttattctagtggcatcagtcaatgtgtttgactaaaagttataaaattaatattttcaactcagttggctttatgaaaaaaagcttattaatccctttcccctctttttataaactattagaaaagttttgcttatctttttcagtcctttaccccacccaatagttaaatatatttgaccacttactatcctccagaaagtgttctgggcctcgtctagaattatctaaaaactcacttaaattatgtttttattttctctataaaataaagaattggatttctctaactttttgtgatcaggaaaattcacaaaattacttattaaaatgatacgtcagtcattttacacagtcctccttgattatttgaaaattaatttttgtgaggctaataatttaaaattattgttatgaggcaaatataggtttcatatgccttacattgtttagtacactgtaatttcctattgagaatgcaatgattctgaaattataaaatcagccagtagctggcacatgaggagagacattagctttccccagaaatcatgagatgtgcaatatagagataattggaattagaagcagtgagcatgctactgccatttccaaatggcagcagagatgaaactggggctccaaattcttcatccaattttgaacataaattcaaattagcatccatctgttgagtctttatatttaagccataattataatttctgtgtatgtgtttgcaaatatctttcagactgtttagactttgagagaaaaccttaggcatgaatatggtagaattaattattcctattagtccaattctgtgtcatacaagggagagggaccaaagaaaaagcaggatgctcagctaacagagaggctgtttactggttttagcaaacacacatataccctgcactatttctcctttcaaacagcctcatataacaaatgatctggtcaagggagtcgtgagaccaattctagctgaacggagctgcagctgttctgtcagccccttccctgggttccacgtgactctcccaggccctctagcagagctctcccttggttatcagcagtaatagagagcttctttatgcacttgagataactgggaacacaactacatcagtgacctctaaattcgccatccctgtctactgtcaagtacaattaccttgttccatcctaaaggaaaaaaatgatttaccctttccccagtgataacgttcttttaagtgttcaaagcattaatcagggaggctgtctttaatattctatccttggattttattctattgcagcaggatttataatcacacacttaaaaatctttagtacttcacttcttaatttaaaaatgccttgggttgtaggccacacatatctattaaagatgataaatgaggaaacccagaaaaattaatttatgggggaggaaataaattggttagctgcccttaggctcaattctggggtgtttctgcatttccagtttattcctaatgcaagtgtttaagagaagtttcctcacaagccaatttttatctgcgatgttttgttttccgtaattctctgttgttaggttatgggagaataacctgctctactggaaattcccccctataatttgataagtgtatttcatcataatacactaaaaccagtctgggccctttaaactagttaattatgtaatttgaaggatttgcatgggaagaagcttcactgtggattaagaaacaattgtagtctctccaatctggttacaacagttctccagttgtcaaatcatctctggatcctagactactgtttcaaaagctttccctgccttatttaaactgaaaacattacaaataaacagctcataaacattaaaaaaattagtagaatttgtgccatttcgtcattactactacgtaattttataagattttttaaaacaacaatggattaagaatcaagtaaattatattgctagttttgccatcatttacaactttagaaaagtcatttatctctgaactttattaaatttattagtaagcagtggggctggactggatggcctctgcatacacctctacagtttttttttgatgatttttggggcaaagctggaaaatgaaaggatttcatttggcaaataattaaaacctacaggaaataggtgtgaaacaaaagtcaaaattcctcttcaaaaaaaaactccaaggggcaaatggaggaaagagaaaaattacaaagttagaagacagtgtatgagaacaagggactagattcatgaagctttggtgtatgttagcagagtgtgtgtgtgtgtgtgtgtgtgtgtgtgtgtgtgtagtggggtgggggtatttttattaaaagaaatagcagattctggcaaacatactgaccaagagttaaagaacttccataagtctgactcaattctgcttctagtttggagactagttacctaattttggttcttaacttcttccttctctaaaacatgattcacacacacttactgtgtatcgtctccaactagcagagcagttgcaaaaattaaaatgtgataagaataattaataccttcaatttatatagcatacctcttcccatgcctcaggcactcacactattgcagatgcttccaaaaaaaaatgtcttgacattcacaaacagaacaaaaaaatgcttaggggaatacgacaaagaaataaatgaattgtgtctatattgcttgaatttcttgctaataaagtagttttagaaaactcacctcaaatttgcactttaaaaatgtttagtaatgcagaatcattattcagttactggatatggaaaatcaaaattataaagaagccagcagcccgctaccacattatttgctacataaaaatttccctttcaagtagtataaattgtaaattctgtatgacttggctcagaatagctcaagacgtatgtctagataaatgtttatctttctattagaacagtcacacaatgtcaatatctaagtaagtattcaaattctggctgaaagggggaaggcaaaatctattctatcaaaggattcatttcttggattatggatgatggattagctgggtgacacacaagttagaagagttatctttactatatttcaaacacctatatttcagatgtcaaaagaaagtctagataatatgtcattgtcaaggcttaaagtacattaatccttaaaaatgcttagatttcagagttttttcctcccaaaatatagtttcatttaaaccccaaatgttcaattttactctcatccattcagaaaatcggagtgttcgtgacaattaaaaacaactaaacacttaaaggaaaaaaatcagagatgtgaattaattgtgtgtgcagagatagtcacctcaatataaaaatagaaagttagaaaaacctagatgactgacaatagagcactgcttaaactatggaccatccttcatatgcataatttatatctattctaatgctgacatttaaaatcatgctgttgaatattagtaacatgaagaatatttagtaacatgaagaaatgttcagaatgtgaaaagtgaaaataaatgttgcacagtataatccaaattttaaaaaataactgtgcttatttatagtaaaatatgctagaagtagttttctctgggtgagaattatggcaatatctattttcttctctgtatgttttccccaaattctttacaatacacatgctattttttacactttaaaaagcattacatttagagtagctggtgacttagctataaacaatcatctatccatgtattggtaaagtgttagtgttgcaatcctagaactataatgtggtcattttaggatgaattcttaagaggtcaatgtgtgcataatttaacaagaggtaagcagtctgacactctgtatgttcaaaacatttagcttgatcaacaaattaattatggcttactaaatttagtgataaattaagtggcctcagtgatggacttgatggacaatacagacatgacatacaaaagaatcccttcctgtgacatagtgggtacacaatgcagggtgatgaatatggttctaatctgatatgatacattcttattaaactttgcagtatgtcaaaatgacactgccttttaaatctattaagacttcatctcacaggagaatccaaaatagatgcatcttatattcaggatggacactgggtgaatatgagcagattgaggtgtccttaaatgtatgctcaccaatcctaattcattctctagtcagtgctctctctctctcttacacacacacacaaacacacatatacacaggcacacacacacacatacacacacaaatgaacagaatctgtttagggggcttcccaccttcttgccaccaacttcagcatctgcagccatccattctttccttcctcttatttgactggaagaggtgtcctgtctatctaaggcacaccctctgtctagcccctggatcttatccatcctgaatttcagagaccatatactctcaattgttcctgtcctcttttatagttaacttctcccacttttggcagtttcccagtcacattttaacatgtccaaatttttgccaccttgagaaaataaaacctgtgtggaattctcacctacctacatatagactgctccagaagttacagccaaatttcccaaaagaggtgtctaccctccttacctttaaacttattccaaaacctgctgcagcctgacctctgtgttcacaaatcctcagacaaggctgttcccaaggccaccaacaaggttgcagaatcaacgccacagtcttacttgtctgtaacatcagacctaattgaatgtagctgtctcttgaaacattctcttccctaatattcgagtcaccatttgttctgattttattactaattttcctgctacctttctgggtattcctctgcagtcccctttatatgctcctgtttctcgctgtctcaaaatatgttagcatttctgaattgtatcttagagagcctcctcttcttactgtgaataaactgactatgtgtggtctttcatctcaatggcttcaaaccccatttatgtgctataggccataccttttctctgagctccaaatggattagtttagctgctattgcacggctttgtttgaatgtcttacatcaaattcaacattttcaaaatgaaaattcttatctttttcctcaaaggtgtttctacattaatcttccctatcacagtaaatccccatctctaaaacagaaacctgggagttacccttgattcatttctctgtgtgtctttctctacgtctctctgtctctctccacattccaccacattcaccatattcctcacatccaatcaatcacggagtctccaactaacctcttatggttttttttttaatctatcacttctctcatttacacccccaattgaccataaactgaggtctccatcgtctcttgtctgaactatcacaatcatcaatgacatgatttgttggcctccatctggcctggcccatgctgctgcttaaaaaagatgcttgtaaaatgaaattttaatcttgttattccactttgcaaagtccttcatttatacacattgccctgagtataaagtccaaacacttaaattcaaagctcctctttacttggtgagtacctgttgtgttctctagcctaagttctcaccattttttaccctcatgcatcagtattccaattatcttgaacttcttgcaggtctttaaaagtgacagttctttcttgcttttgaggcattacaaatgtggatctttaagtcttaaaactctcatcctctttttctttacttgaaaaattctgacttatttcgtgcgtggtcttgaaacatcaatttatttgatatttctcttgacaaaagcaagccttaatacaatcttcatatggattcccataattctctacttctctacattttatcttgctgcttgtttttaattgttggtctctctcaataatcgaaaattgttacaagagtagggatcaattctatcctatattctaggtatatcacagcaagggccaagcccagtagattaataaagtttttgaattaacaaataagtgaatgagagcaagggtatagtgcatcctgcccatttgggggtacagattctagagttttgatgtaatggacaaatctaccgacattctatccttttctttctttttttttttttttttttttgcctcagcctctcgagtagctgggattacaggtgcccgccaccgtgcatagctaatttttgtatttttagtagagatggggtttcaccgtgttgaccaggctggtcttgaactactgatctcaggtgatccacctgcctcaacctcccagtgtgctgggattccagtcatgagccaccgtgcccggctgaaaaaaatacttgattcttttatttatttatttatttatttatttatttatttatttatttatttttattatactttaagttttagggtgcatatgcacaacgtgcaggtttgttacgtgtatacatgtgccatgttggtgtgctgcacccattaactcgtcatttaacattaggcatatctcctaatgctatccctcccccctcccccaccccacaatgagaacacatggccacaggaaggggaacatcattcaatccttttcaagattccaggcccttccttccttccttccttccttccttccttctttccttcctttttttccttccttccttccttcttattataattagccaggataacagcttcaaactaggtgctaatggactataagcacatcttcttatcattcatgattttaagtggaacgttctggtgttcagatgacagccagtagtaaccctgaggctggtaagttggggttatagaatgaaaggagaaccaagtatttaaaataaaatatattgaatctataagaggatattctattaactgtatatctaataacatttatttaaaatatagcccaaggaaaaaaagaagatattatgcatatcaacacagtctttaatgaggatatcatcaaatttctaatacttagtgtcaaaagtccttttattactgtaagtgttatatatgattctagcactccttgcttatagaagttttgcccaaaaatataacaccatatcttatgcttaacaactgaagacgaataataacaaaacagcaactaatgcttatataatacttactataagagactatgcttgcctgtgaggtgagtgagttgcaggaatgtcttcaatgctgctactgggtagccccaagaggagagaaagtcaccagaaatatttggttgcaactttttcccttcacaagagccaagcagtaaaattgtgggttaaacccagttaacatggctctctttggaaaggttgaggcattgaaggccaaacttcctgtcatgattaggaaatcacagactgttcttaatgttaaagcgaaagcaatgctattgtgtgatactttcagctcctcaagttgtgaatctggcattgtgtgattactccccccttgcttatactgtaataaatatttaaaataccccccagaatctgagataacacatcagtaacagtttaatttagcacttgcaaaattccctccccaggttaggcttgtactcagtattggcatcaggaacttcctaacattatattcattcattttccttttcccaacacaaaacacacccctggctaaatttaccagctttctttacagctaactcttgtcctgttgactgtaaataggaactgagtaatactcacagtccctgacctatataagtgctatgtaagtactacttgctgttttgttattatttgaatgttatgtattacaaacggaagcaacacataggtggcagctgaaaaccagcaagtgccatgcgatatttatattactcattgtaaactttagtttccgaaacttctgaaaaaaatgtttcttttgtttttcaggaaatcggactttaaaaactcacttaaataatggttagtacttacaattttataccaggtttgaaggaagtttgaataagacacaacttgtatgcaatgcaggaaaatggaaaattataatgtgttcatcttccgtgtttacccccttaggctgcttttgtctcttctattgatttatttggattaatactatattattactaatattatattatttagattaatactatattattatttactttgctgtgggactttggtcatggacatggctgttggacatggcttcaaaaatatgttactattataatgtttctaagaataaattagatagacggtaaaaatggacccccatcttttattattaatatcccaattttggataactttttctctgtattctgggttggtccaacagcaaagtaaataataagaacaagaaggaagcaaacatgaggaagaaacctgttcctaccatgactcaaatgcctaactcctatgaggatcacaggctcccaggctcctgtaaaaagataaacagatcccaacaccattgactccctctctccttaacgtgtgaacccagtgagagcaattcttactgtactacttaccttctagggaggaccttaaacaagtaataataaaacagttcctacaactatcatagggaaaatgcttttggtgaattcatctaaaatcctatatttgatgtaagtttcttttgttattttttttaagagacggggtttctctgtcaccgaggctggagtgcagtaatgccatcataatttactcactgtagcctcaaattcctgggttcaagggttcctccctagtagctagtactacaggcatgtgccaccatgccgggttaatttttttctttttaaatttttgtagagacaggcatctccctacattgctcaggctagtcttgaactcctagcctcaagtgattctcctgctttggcctctcaaagcactgaaattaaaaacaaaagattttatgcaacctcaccaaggcgaagtagatattttcaggaatggttttgcaggaattggcaaatagatctattgagacttggaactatccggttccccaacccatttaaccagaacaggtctgttttcatctatttctctaaagagatgtattgacatagtccccccggttaaaacaattggaaaatcatcagtctaatgcagtactatccaagagaaatgtaattcaagccacaaatctgcagcacatgtatgcttttgcattttctagtagccagattttttttaaaaaagtaaaaagaaacattttgaattttaattcacccaatatatctgaaatgttacatcagcatgtagtgaacataaaaattattaatgcaatattttactttttacctttttgtatttaatcttaaaactctgctgtgtagtttacatttaaagtatctcaatttggattaatcacatttcaagaggcaaataaccatatgtggctagtggctactatgctactatgctgtatagatgaaagtttagtgctttattctttttgagggttttccacctttattctgtcaattaaactgtgtaggtatcatcactgcagtgtccactattggtcacctacccagggtccattcatccatctcccctgctcatggacatagttattttcactggatcctatgtgcttcagggctgaccccatccctagctacaggaatgtgccggggttagggatgatcatgtgaccccatactagctaatgagatccaacagtttcctcgtttttaagagaaagtcatagaaaaacacagcttctctctcctgctagaagttaaccaggaagcacgtactacagctaccacttgcggggaacaagccgtaggatgaagccaagactgtactgcgaaagagagatgcggcaaactttggtcctagatgacgatgctgagctttcggattaaccaactctgaaggctgccctaattttggatttcagttatgttttttattcccaaaccactacattacatcatctctaataatgactgagggcaacataaatatagtgacactctggagcaacttttgaagcattatgttttttcctttgttttttattttttactatgtttccctattgtcgccgaaattcctcatgtttaattgttatccccagggcacctttccaaacatccctttcattttttccgtctttaaacaccaggcattagagcaactgttttcttgtgctccttcccattgcttccaattaacttctctcttccattataaaaacaatgttgtctctcttacagttgtctaccctaaaggtatgtttaaatcttctctagaatttttattactaacaacaaagtggagacaataaaagtaaagaataaagaaaaatatgcactattatcttaaatactaacaacttttactgtattaataatacccatgattcattagattcaagttggattagtggctttagaatgaaaaagatttgagtttgattcactcaacactatttatcatctgtggccttaaagcaagttgcttactcaacaagtgaaaaagtaaaataaaataaaacaaaaaacaggaactgatgtcacctacatttcaagatttatgtgaagattaaaaaaccatctaatgtatgcaaaactcttaaagctaggatttataccttgatcttcttattcctattctagtgtccttttcacttaattacacttcccttcttcattcatttcacaatcatttattgcgtgatttctttgggccaggaagatttattgaaaaacaaggcaagatctctgcttttaagcagtttataatttaaactgaatcagacaaatagagggagaccataaagcttagtggttaattacataggcaataaaatcagacaaatctggatttgaccccaagaaagttactttacatctcaaaaccagtttcctcttctgaaaacgaagatgacagtatcccctcaagttgtcatcaatagaacaaaatgaaattatatctgtgaaatgcaatgtgcataaattataaaataagcatttgtctattgtggccaatcatcctcattgccataattataactgtgcataattaagtataaaggtatgcacaggcactatggagtaaagaggaggggcacttaaatcagtttctatggccgggcgtgatggctcacacctgtaatcccagtactttggcaggcctaggcaggaggatcacttgaggtcaggaattcgagactagcctggccaacatggtgaaaccccatctgtactaaacatacaaaaattagctgggtgtgttggtgcacacctgtaatcccagttgctccggaggctgaggcaggagaatcacttgaacctgggaggtggaggttgcactgagccgagatcacgctactgcactccagcctgggtgacagagtgagactccatctcaaataataataataataataataataataataataacaaaataagtaaataaataaataagtttctaggttcagagaaacccctgtctgccaaaacagcagatgctttgtaggtatttgagacaaagtccacatttctgagtgtgaaattgtgtgaatcattataagagctgcaaactgatttttatcactgaaggtaaggatgctggggtagggatggaaaaaaatggtacagtggtaaatgtggccaaatccaagatcttgaggattaaactaaggaatctgaagccttttaatctgggtgagaggctactatagtaacatgcctgaattccatgttagagagtcaccgtggtcacactgaggttctctaaggctctttctcttttccctaattataagaaaaaagatgaaagcaggtttgcaagaatcccaattgcactgtatcatactggaggctttagaactgtcaaaacaaagtttctaattttgactgtagtcaaacactttcccaccaagcaaaaagaattcaatatacagttttatttgttttataaatagtttagtgaaaagaataatatatgtgacttgtactagctgaaaaatgtttgcctagtaaaactttatcactggatgtgaatgttctaagcctaaaagacacacagaagtaaataaaattgatgccacacctttacaaaaaacacttcctaaattgccggtatcgtggtgaatggaatcatttaacaagttactgtcagacaagtgaaaactcctgtcaccttctacgggatttttcagaatatgctccctagatactcaagctcctacaaaggtcaatcagttgatgaatcaatagctattctacaggaaatctccatcaccataattatctgacccagacaatttcagtgattttttttttactattctcaatcaatttgttcttttttgtacaatattttcaacgaagtgatttgaaaatatttttataaactaataagagagaaaaacgtgacacatagcattatagtgtacaaaagcctaagatctactaattactaggaatatgattagagaaagttataaaatcttttctgtcttattatttgcaactgaaacatgggaatgaaaggtaacaaactcaaaaattgttgtgaagattaaattaggtaatatatggaaagggtaattgtcaagtatgtacctgcacataacaggcattcagtaaatagaagtccttttattttttgtggctctcttcagtttgcgctccaccagtctcactgctaccccaatttcccaacagataggtggcaggaaaacacacacacacacacacacacacacacacacacacacaaacgtgcacacacgcacatgtgcacaaggcttcaaaagtatgttactattataatgtttctacgaataaattggatagatggtaaaaatgaacccccaccttttattattaatatcccaattctggataaccgtttctctgtattctgggtgggagagaaatcccagcacatatgtcataaaccaagtgctggaggtgcctgagccttcatcctttgttatagcataggggtaaataacccaagctacagcagtcaggctggcaacagaagtttgaattttacaagcataacacaaagaagaagggggtttttagacattggattcatcacagaggcatgcagcaaacatttttccagcaggactttggctgtgcagcctgaagttcatcatcaagaacatcctgggtcttgcctgttttccaaacctgacctgccagatttctctggactctgtgagctcctgaaatccttctacatatgctctttgcacttggagtcacagttggttgtttgcaacccagaaccatgtctaaggaggagggtagaattctgaagtcagaagatattccatgcttcctgatattgatctgtagcaaaatttaattagaaatagatgctagagaaaagaattttaaaatgttccctaatgtcttttatagagcaaaagctaatattaagaaatttgcttttggatccaggcaaatccctagtctattcttggagaaaattactaccattaaataaattcaaaagtctgccacccagcatgttggccgttagcacagctactgatttataaagaaaaagctggttgccagaataacataaaacccagactacaactcatcctttatggaaaaatcaagaaagaacttcttttttcttctctagtcatctcactatggtgttaatggagtattcgtgagattttcgtcttataaggccacctctcattatactcttacttctggaaaattctctgagcctgaatctggaaaattctctgagcctgaatctttcctcatagcctagaaaactcatactagtctttgaaaatgcaactttgtcatctatgactgtttcttgtgtttataaaacaaaacaatagaaaaaatctatgatgtctaaacagtgcttcaagatgatgtattcagtaaaatattgtattattataaaagcaaaattaaaacctcacatgtagaccacaaatataaacttattaacttgaagctttgaaaaaagaacacaagacctagccaaagagctgcaaagctatggcttaggctggttccttaggagcagagcctgaagtggggattctgatacatagcaagaagctgaagttagagtctcagaaagagacagtgctggcttccatcttctataaggccacctccactcttcacactcctgcaatttatgtgaatcaagcaactccccctacctttttatatttatttatttgcttaagctagtttgcattagttttcgatcatttgcagccaaacaatcctgattttaaaagtagggagtattaatttgagaactgctctccttttaggagaaaaagaggccaacagtaaccagaacccgtttagaaagaacaatgacaacaaaaagtttcttctgagacctagcctggaaatcagcatgctccagatcttctggggatcacgaatcttatgacattctattattttataagcaaattttggtaacttctgtgtctctgtgtgactgttctgattcatgtctcagaaaaaaggaaataacatctattagatcaaatttacctcctaattctctcttcctagttgtgtaagcttagagcagtcacttccttcttggggagccaaatggaaagccatatgtagatagctggccacctcaaaaccaaaggcctggagaggaagagagaggtcctatttcttgtcagagtcataggacagggattagagaaatttcaaaatgtctggcaaactgtctccaaaacactatgtcaatatgggtacttcactccaatcccagttgtcaccgcctcttacctggatgacttcaacagccttctacctggtgtccctgttcccacacatacctttctgcaatccagctccacatagctgccagaaggatgcttcaggctttattctggcacactgcttcattttcttaatggtatttatcacaatcactagacttctagtttatttattgcctctctccttccactagaatgctaattccctgagagcatgaaactagcctaattcactgccatatttccagcacctagaactgtgcctgacacattgtatggactcaataaacaaatactgattgcatgcatggataaatgaattctgaatggttctcagctttgtttctttttttgaaaattaaagatggaaaatgctgctgcttttttttttgagtcaatttcaagtttctccaggaaatcgtcttaaagacaacacattccttgaggacaagggtcacgtcattgtagcactaccttacacacaatcagtattcaataagtgtctgctaaataaattataaatcatggctcctccttctgccgtggtcaaggtaattttttgttatttttctgcttaaaaacttagtagaactcctcattacctaataatataatgctgcattagtaatactactctgtatagttattggtatagtatttttatctttaaaaattaaaaaaacctttaaaaataaaagatgtctttaagtaaatttagtattgttatgatgtgtctgtatctggattctttatctggccagcattttgataggatttctttgtaatttggtggaggtaatattagttttatcttattttattttgagtgagaagaatcttattttaaaactcatttatgtgagttatattaataactacaaaacaatgatttatactagcagggaaaaactgttaaagtttttaaacctaatattttaatctaacatttttatcgctaaattttcttttaatgtgttccttttgtcatttattgattttcctggatttgacataacaggtattttataagatgatatatatgctaccttttgttcacataaattgaaatagctaagtccctttatgtttgccatatttaccaaagtacctggcacaaaatgcaccagaatctagggcagtcattttatgtaaatgcacatgagtttacattgctaatataattgttgatccacttataacttgtgcaataaagtatgtatgcagtgactgagttgtcagtaaaaaatgtaacctctttgtgataaaacataatagtaaaataaaaataaatgtagtattgctctaactaatccaagagctagtattagcaccgaagggtggaagcaaaagggaggacagattctgactcagtcaatataagggaaatgaatttttctaatacaaagaacagctcaagatgaattggggtattctaaggcatcatggcatggaggaaacatggacaaatgaattctaaatggttctcagctttgtttctttattgaaaatttattggcctttcaatcccagcctgtctacttaatagctttgctaccttgaacaaatcactcaactcctctcagctttagttttctcatcataataactttggcgacaaaaatgcctatctcatagggttattgcaagaaattttaaaaaaagtatgtgtgagaaagagcctggcacaatcttggctctaagaaaattcctagagttcttgaaaggtaaaaaatttcctattattaagggtgttcaacaaagtgtaaacaaagctggaacaatttcactaagaatattctagaaagatatcaaatattagatgagttgttttcctaaacgaggtttgtgaattcaggttttataatgcacactctcttattttacaaatatagaacagtatagaaaatcaatacaaattgcccaaaatgaaatacaaattctcattcctaatcttaagcaatctacttatgtgtttctccctttcccttcagtctctatttgactatatctatagtttttgacattctcaaatgtacttctacaaaaacagatctgcttaccattcccagcacatctggttcaatattttccgtggtgcatctgcacagatccactgctgcttcccctctctcaccgattctaggccaagctacttcccactcctcttttaaagcaacatttaaggaagaaggcttttctttatattaatgtctctacatctccatctgtcctcagtactcgagggctctgatgctctacccatctaatccattaggcaaccttaagtggtcttaaaacatgaagcagatcaaatcattcccctacagctttcagttgtttttcattgtacttgtggtagaaatctaaactcccaaacaaaaatgacaaggttgtgaattatctggccctgcctccctccctagctggccttgcaggcaatctcttttttactcactctaatccatccatctggccttctttcagttcctccaatgcttccagtgtattcctgcactgacaccttcacatactgctctttcttccttgaggtcttatcttgtaagactcgtcataaatgacctttttcccagagatgccctccctaatcccaatgcatcagtaggagatcttccttgacactctctcaaattacctttctcttgccttcataaagtgctcgtttttgatgtataaaaaggtatgccagcatccatctgcacttctctggtcaagtgggcagaacaaattacattggagcagaagtttcagaagaattacttattctggtaaatttggaatcattagctttacacaggggaaattgtgtggtataccaaaggaaaacccacacaacactctgtggtcacttgggaagaggtagatggtgcttaaggggcccagggacttctggtcaaagaggagatcaagaaactgaacctcttctctcaagatttgaagccaaaaaacttggagcagagtggatttggccacattcactacagggaaaagacatacaagccttaaaagaaaacttagagaaagggaaaaactgggtatggtggtgcacaactaatagtacaactatgcagaggctgaggctggaggatcacttgagcccaatagttcaaggctgcagtgagctatgatcacaccactgtactatagcctgggtgacagagcaagaccctatctcaaaataaaataaattaattaaaaataaaaaataaaagaaaggggcccggcacagtggctcacacctgtaatcccagccctttgggaggccgaggtgggcggatcacaaggtcaggagatcgagaccatcctggctaacacggtgaaaccccgtctctaccaaaaatacaaaaactagccgggtgtggtggtgggctcctgtagtcccagctattggggaggctgaggcaggagaatggcatgaacccaggaggcggagcttgcagtgagccgagatcgtgctactgtactccagcctgggtgacagaacgagactttgtctcaaaaaaaaaaaagaaagggaaagacacatttctcaggagataatctgagtaccacccagagcctaatgatcccagaagtaaggctgattctagagcagcatgtggcctgaggtcagcagccctttgagtccatgtactcactctggcagtgtttgtgctcggagaattgcagctgagcattacagctggagtcacaggtgtgaattaatgtgctccctaattatggagtccaagcacagacccagtacagttggggccaagcgtgttccattagggccatcatgctgcactggaccagccgtgtcctgcccacatgaggccaatctcatgtgtgatagtaagggcaaccacagtaagacctatccgactagttacattggcttattggaacgactgattatctactgtctgtctaccttagtagactgaaagctatgtgaaggaagatagcattccatttggcttaccatcgaggctaccacgtagagctgcacagattgcatactgctcaactccaaagattgtcattgtcttacaatataatgtgaatagcactctctcgagcaacgtaactgctcaacctttatagctaaatgaatccgtgctgaccaccactgtattaccagagtgatgagagtggcaggcacataacaagctctcaataaatatttatagaatcgctggataaaagaatgtgtgatctattttgtccatttgcatacatttctatgctttttcctaataagtttttacgtattttcccccatatatctgaaatagtatgtccaatagggacgatttaatctatttagagctacaggaagtgagaactgaaaggaggattagagtcgttaatcgttttatcttaccggttagaaaaggaaagtccggcaagataaagtgacttagatcacatggcaaggccgtgaccagatccaggtctcttgccatccagtgccttgttctctctgtggcactcacttgcttctttaataactttcttctgttcttcttatgaagcagagaggagtcctcacaagtcgggggtcacttaatcactgatgctactctgtggctgaggagctggctgttgaggcattcttctatttggggaaatatgaaagtgtgtgatctgccaggagctctgacccaaataaggttgttggtagcaagatgttaccagtgaaatttcatacatcaaacagcaattagtgctccactttactgtcttgtgaatttctcagaatgaatcttatcttttacaatcactctttcatcattttcaacattaatcacacacttcttttttccaaatttttatgaatcacaacagcagcatattctcaaccatagaaaatgacatttattatgtgttcagaaagagagacaaaaagatatacaaatcaaatttactctcaggatataacaaaaaattagtggaaagtatatgttttaaattacacttaatatttggggaccaattattgcttgaaataaacaggcttccagttccaacatggccttttgtttttgtattaccaagagtttttaaacagtaatggtatctggtggagaatttatcttgtatctatattgcacaacttttgcctaaattagtaggcattttcttttttctaaaaataaagtgtgaatactcaagcctcctcttccatttctgctaccatttttcattttagatcgatgatccttcaaatatctatcataaaattagttcactaaaataatatttggattttaagtaagcacccacataagtcactgaaatgtcctccctataaatgtggtcccagagaatatctggaaaggccactggatagaaaaataacacattgtgctatttgcaggccacaaataatattaatgtgttgtcaggacctggtcaaactgtatgaagcagtttacaactctatgattcacacactttggtctgacttaaggcttgtgtaaattcaattctgggctgtcagtcagcagcacaggttctgttcagtcccaacatttctaattgcctgtgaaaagatgaagacaactgagggagagactctctcaagaagtttgcagaatgacttgatcctagacaacagttagatgcacaattagttcaactcaagattccattgagaataggtttgtgcacatataggataacaggaagacgaccctgactggaaagagctcacatgagaggctgtgggtgctagcaagacccacatttaactccaacacagaggaatgactgttcaggtggggaggggaactgttcactgcagataagtcctccccttctcagggccatcgagcagaaaagagcattccagacctgtgacagaggtcttcaggacacaaggtactagctcttccctcaggtgtaagggaaaggggaaatgggatcagtgtgttttggagttagagagctaactagaagctgtaaaagggaacagattacagggctgagagaatgcagaggagggatggtggcagggggagggaaggagggatgaattacaataccttataaaaatttaggcaccctgtaatcccagcactttgggaggctgaggtggatggatcatgaggtcaggagatagagaccatactggctaatgcagtgaaaccctgtctctactaaaaatagaaaaaattagccgggtgtggtggtgggcgcctgtagtcccagctactcgggaggctgaggcaggagaatggcatgaacccgggaggcagagcttgcagtgagcggagattgcgccactgcactccagcctgggtgacagagcgagactctgtctcaaaaaaaaaaaaaaaaaaaaagaaaaaaagaaagaaaaattaggcacagttggtttaccatttttctttctgtttctgaaagttgcattctccaccacattttttccccaatgaactataactaatcaagctgtgaaacactacttgcctcctttctccagtttgctaggagaaaggtctatctcaacacaagagtcaacactactatccagtaaaacatcacagtggtattcctcatatggaaggaatgttcccagcttgctaaaaggactcagtaataaagtattttcatagtactgtatactaccccattattttcacatatgttaatcttgttggttttcattataacactgtgaaatgagctgggtaggcatttttgtttcagaaagaaagagagagagagaaagaaagaaagagagggagggagggaagaaagaaagaaagaaggaaagaaagaaagaaagaaaaaaaagaaagagaaagagagaaagaaaaaaagaaagaaaagagagaggaggagagggaagggaagggaagggaaaggaaaggaaaggaagggaagggttcataaagttatcaagtgaattgtctaaggccaaaagtaattgcttatttacatggggccagaccctgtcttctgatttggttgctcaagtattcagtcaaggccagcgcggtggctcgtgcctgtaatgccacagcactttgggaggcagaggcgagaggatcacaggaggacaggagtttgagaccaaactgcccaacatggtgaaatcccgtctctagtaaaaaaaaaatacaaaaattagcagggcatgtggtggtgcatgcctgtaaccccagctactcgggaggctgaggcacgagaatcacttgaacccaggaggcagaagttgcagtgagcccgagatcatgccaatgcactccagcctaggcaacagcgagactttgtctcaaaagaaaaaaaaaagtattcagtcaataaacacgtattgggcagaccttatgtggcaagcaattatgatagttcctaggaaaaaataatgtgcaagacacacactgtacttgaccttagcagaactaaaagaacagaaagacaataaaccaatgtctccaatgaagtgtgactcagactgtgaaagggaaatgcggggtatcatgagatcagggcacccaatcacggcctagagaggatgaaggaaggcttcgctagaaaatggcttctaacttgagatcttagccaatccaagagaggtgggtgcttggcagatattgctgaatggctgaggggtaaagtggcaatgaaaaatggagaaagaagtgctctgtgtaaagagagcagggtgcaggaattcacagagagttcccatgttgtatgtatctcagtcatatgctgcccaactgtcatttctgtataagaatcaattacagatgttcctcaacttaaaacagggttacgtctgggtaaactcactgtcagttgaaaatattgttaagttgaatatattgtaagatcaaagatgcgtttaatacgtttaatacacctaacatactgaacatcatagcttagccttgcctatcttaaacatgctcagaacacttacattagcctacaggtgggcaaaatcatctggcaacacagtccactgtggagtattggttgcttaccttgtgtttgcgtggctgactgggagctgtgcatgcatcaccaaagagtatcatactgcatatcactagcccaatagaagatcgccattccaaattccaagtacagtttctactgaatgtgcattcctttcacaccatcatgaagttgaaaaagcataggtcagagactgtctttactatgtttacagtaaaatgttgccatatacttaggggacaagatataagaggaacccccccaaaatgaggctccttcattggttaccatctttatgaaagttggaagtttctagggaaaaggaggactagagagattgtctaatgattctcaagaagcacagctggcaggagttgaaatacaaacttccttcctgtctttttgtaaagcaattggaaaaaatgggagagtaagaatttgacatgttacagttgtagatcttagtgttgtgaggcatgaatgagataaatgtggaacactggcaggttgcaaaaatgttacgcagatgtacagcgttttaggggggacttccctgcatttctgtcctgcaatgcaagggcagaaccaaaaactgaaacttagcacccagtatccctcacctaccacccctctgcaccctcagatgaatcatagtctgttacagatgcctgtggtgcatattcctgagtgttagtcccagaaaactaaacctatggaaacttttataatttagttgttgaccttcacagcttgttcaaaagagaagggccagtgactcacaattatattacaacttcagaccatgtgaatttcttcaaagatgatggcttaagaagtgtttaattcttggctctttctgataaactcaaaagagtgaagtcctcatcttgtcattcagggactaaccatctaaatttgttttcttgaacatttttaaaacatcattcccattgatctagtgtgcaccctttgttctcattgggctgggttttgggacacacttgctctcagtcatgaagtcatgaaatgaggttatgccaattcatcttcctggaaatctcctctggcaaattcagactgacttttttctgagagccaaaggcattaattacatcctatcttgtattataattctttaaatatttcactcataaatgtggaaattctgcttttctgaacagattataacattaatcagttttataatcatagaatattttgttgaccttcacacctttttcaaaagagaaaaattatagaatatttttcctacaatgtggattcatatgtttaatcactttctctgaagcaacatcctgaatatggcagaaagttgaggcagaagagattagcaattgaataatacttttatatgctataaaacaacattatttctgaaaataattcatcatacatatctaccacatgtggcatattaaaggcaaatttcgcttgtcaaaatacatcagtgactccttaactaaaatgaaaaaaaatcacaactacattgtgaaatatcttcttgaactgaaacatctctgtatttgtggatactgagcagggaattcagtggttcaagattaaaggcaaaagtttctaaggctgcttttatccagttccaagattgatgatgagaaactgtttgttgctcatacctcacttttcatgatgttcatagctggctttgtatttactgtttttgagatagcttacagtattagccacattctacctgtttgggagtgccaagttataaaagtacaaaatgtactcatagcttcctttgaacaaaatcctaaggttattcccatttctggaaatttagctatcaggtcaaacaactgagctatggtgagcatcattcataaaatataaaacataaaataatgataaaaatcaaatagattgcattgctggatgaactggctgattgcaacagaatgacaatgtgatgccttacataagcagtaactaaaaactgtaggtcatctatcatggtgacataatttcccactgtactctcttaatttcacattttatattgtattttgcaaaatttctgagaaaaagaaaaaggaaacaaagcttttgtttaaggatacataaacctctatttaagtatttatgtagtgtgaacttgtagctgttgggacattttcttattatggtgtttctgtactaccaagttttcctgcagtaacaactgaatatttattatagtcatgatagtcttccaggatatactcagggtcctttcaagtaagaagtttggacaattagaatagtatcctacacccaacttaacgaatgctagcaggaaacctatattacactcatagttagaaaaaacagcgttaatctctcattttaacactaatatgctgaaaattcaattcactaaattctagtgtttttattcttataattctctattaagaaagcagctttgccagtttcttttctttgtagtaattccaactttgtacagtaaatctttttgaagatatttggagttttttttttgttttttgttttttttttagagggagtcctgctctgtcacccgtgctggagtgcagtggcgtgatctcggctcacagcaacctctgtctccctagcctaagtaattctcctgcatcagcctcccgagtaactgagattacaggcgcatgccaccatgccccgctaatttttgtatttttagtagaggcggggtttggccatgttggaatgctggtctcgaactgctgacctcaaatgatccactcacctcggcctcccaaagtgctgggattacaggcgtgagccactgcgcccagccgatggaaccattttctttaaaaagttctcatttctcctaggccgggcacggtggctcatgcctgtaatcccagcactttgggtggccgaggtgggcggatcacctcaggtcaggagttcgagaccagcctggccaacatggtgaaaccccatctctactaaaaatacaaaaattagccaggtgtggtggcgggcgcctgtaatcctagtgactccaaaggctgaggcagtagaatcacttgcacctgggaggtggaggctgcagagagctgagatctcaccactgcactccagcctggagtttttttttttgagacagagtctcaaaaaaaaaaaaaattctcctttttgatatgatcacatgtttaatttattttgtttaatgtttttataattgaattaataaagtacccagtaaaatgctataaatcaataagtattatccaaatgaaaataaattgaaattaagtaagactagtttcaaatgcagtctttcttgaaagagtgagtttggccatcctaaattacagttttcaagattgatctactttctttctgaggccaccatacttttggtactagaattaaagtgtctaaatcaaaaacacactacatggcttcgctttgacttaaaaacaaaatgcacaaacaataaattataagtctgattaactgtatgggtattttgttcaattgatttaactgcattttttttccctaggatataaatcatgtgatacagcaaactcaaagatgtgggactcaaatgacacttgtgaaaaactgataccctgtttgcctttaaagttatattaattaccacactttagtaaagtgtttactatttagaactctttcttccttcctagttggccacctgtacactccattcctcagccataaaagtaaatactgtatatctaaaactggtgctggttttgataagccatagtgatgacatcagcctgagttccaactcctggaataaagaactgtgaccatacagcgacttgtgggcagttaggtctcagcataacactccttgtcccctcatgtcactgatttggagccaaggtttgtgctccaatctaccaaaccaggttaaagaaattacatttctattttcaaatgcaagggatttaaaagtatacatggcgcacaaaaaactcaacgtacttaatgcctaatgccactgaactgtacacataataatggttaaaatactgaattgtatgtaatatattttaccataattaggaaagaaaaaaaactgcgttcacgtgtttcaaaggttttccacaactgtataatacatatagttggttatacctttgtaacagtgaccatatcgctctttctgcaacatctattaacccagacaccccagggcctaagtaagcatccattcttcaggaattagtaaacagcacttacacacggacatttctagctaaaagtaacacagacaaaaaaacctcaaaaatatcacgtaagggcaggtgttaggcaaagagcctctgcaaacatcccttgctcctctgcattgctctggtgtgaggagctaggacatggagaaacctctacctcctatctcaggattagcgaaccctgcttgagtgctacaagggtaagtaaatgctggcctgaagaagctgctgagcttccggatcccactgactgtcgttcgggcacttcctagagggtcaagcaccatggcgaaaggctgaggaggcaactcgtatctttcattctcctgcctcatcaagaatgaaccttgaaggcacccataggtcgcgcagtctttcagaagctgcaggagggctgtgactgtatggggttgcagactgaaaatcttattaacgtgaaagaggaatttgaaattaaaaaaaaaaaacccggccgggcgcggtggctcacgcttgtaatcccagcactttgggaggccgaggcgggtggatcacgaggtcaggagatcgagaccacggtgaaaccccgtctctactaaaaataaaaaaaaaaaattagccgggcgtggtggcgggcgcctgtagtcccagctactcggagaggctgaggcaggagaatggcgtgaacccgggaggcggagcttgcagtgagccgaggctgcgccactgtactccagcctgggtgacagagcgagactccgtctcaaaaaaaaaaaaaaaaaaaaaccccacaatatcaggctacagttatcatagcaattctgcttttaatgcactcaggacaaacttctagctctgcatatatgtcatttcaatgacacatcctgtctcctacccgactagaatgtgagcagccctgtgatctctatgtgctcataaacagtgcctaatgcgaatcctggctcttggaaggcgctcagctagtaagtgaggagctcagctctgaagctgtaaccaagaccgcgcgggcaggaggaaaggacacttcagcgctctgcggttgcaaacacacccctgcgggtgctgccacttagcaaagtcttaggttcccgcttactcgcacacgcatcctgacttcccccaaccctggaactacctaccaggagcggagaccagcagaccgacagcacgcacatgatccccataagctgaatggccgtctcggtcgtgatgcggccccactgggcactggactgagatgccgtggccttggcccggcagcgggacaccagggccttaatggtggccaggttgcaggaaaaggtgactgtcagcgccaagagccccaggaaggcaaaggcagaggcgaagaaaaggttgccccagttatgcgaagagctagtcccgttgccccctcgcccggtgctgatgaagcaccacgtcccgggccactggacggtgtactggcccacgcccagcaccggcagcagggcgaaggcgagcacggccagccacacgccgagcagcacagcgcgggtggcacgcgtcttcatgtggctcgcataccagtgcggcgccctgatggccagcgcccgctcgacggccatggcgctggcgatgaacaacgaggagagcccgaaaacagtcatggtcagcccgaaaaaggtgcagagccgccccgacgggtcgatgtgctcccaacgctgcttggacaggtacacgacgatgacgaccggggtggtgagaagctgcccgaccaggtcggtgagcgccagccagccgatgcacagcaggaaggacttcttgcgcttgctctcccggcgccggtagctgcgcgacacgagcagcatggccagtgcgttgcccacgaaaccagtgagcagcatggtgatcgggaaggccacggacaccgatccgcaatcctcgccagaccctggagggcgcgtgaggttgccccgcgcctcggcggaacgctcgggcgcccacatgcctgtgtaggagtggttgaggcgggtgcagaagggggcatcccctccgtagccccgggtctccttcatgttggcttcgaggtgaggaggggatggcgtccagagagccgcagcgggagggggcagacgcggcgcgggcggcggcggaggtcggcgtttaccgcggctggggctgggctgccccccatggtgcggggcgcagccgccgccctactccgctgctgggaccgcggccgcggcggcgccagggctcactggcccgggagggagccacgccttcctctctgggaaacctctggt

SEQ ID NO: 1470 - DNA, 195456 bp, Homo sapiens
aaacatgtatgaatgtaatttttatttttatttttgcagtgctccttgtcatgatgagtgtggaaataattttcccttggcgggagattgtacaaacaaattatgctttattcaaattatggaatactctatagcggttaaaattaacgatttagagctccatgtttcaatgtggataaatctcaagaaacataattttcaataaaaaaatgcaaattttacatatgataatgtatacgcaaatataaattcacaaaacaataggacataagtttaattgatgtatgtagatatagtaaaagtacaaaaacatgtatggaaacaggacataacagcttctggataacagttatatttgggggtgggcttgggggaagaagtaaaagagaatagtttgggaggtgggtgtttctgtgatttttttttcttttacaaaaagagagtcatggagcttccagtgatgtgatcctggcagaaaggcaggttttaatttccccaaaattcctcctggaaaacaaacaaatcaattaggatagccaataataaatgcactgttaatatcttaaataaaaatcaaaggcaataaattctcataaatttcagattatgaacaggaatggtaaatcacttacagcagtataacaagaacaagaacaagaacgaagttgtgtgacagtaatagtgaaaaatgaatagggacaacctatgtatgccacaaactcggggtgtaaaaaatttttctacaaacatctactaaaagaagaagatcctatattccttgggtggaaacatggtaagacatgtgagaatgcccagtgaaactgggaaaagtcctcagaatcttccatttgcagataagattaaaaaactgcttgcagacataaaaacattatggttctaggctaatttcaatttatagttaaatgaccacagagttaagccactagctaatttccatttagtgttaaaagacataataaagaattagagaaatccagaatgggaggcattctatagaacaactaaactaatttctataagtgaatggctgaaggaaaagggagcagaggaagaactattctaaattacgagtgacctaaaaaacaaacatattaaaatgtggaccttgtttagattttaattcaagtaagccagaaaacacatttttgagaaaatccatacatttgattaagaccaggtatgagattatgccaaagaaacattatgagtgataataatattgtggttttgtagtgggccataatttttagagttatactgaattatgaaggggtaaaataataccatctgatatttgctgaaaaatacttcaaataagaaaaagaaaaaacgtgttttaaataggttaagtgatcccaagttacagtaatctaaacggtgtggtactgacataaggacagacatatggatcaatagaatagaatagaggtcccagataaacccttgtgcacgcactcaatcaatctttgacaagagtgccaaaaccatacaatgggcttaaagggtagtcctgtcaataaatggtgttgagaaaactggatatccacatgcaaaagaatgaagtcggatccttactttacacaatatacaaaaataaactcaaaatgaattaaagacctaggcataagaccttaaaatataaaactataagaagaacacaggagaaaaattttataacagtggatttggcaatgttttcttggagatgacaccaaaaccacaggcaataaaagcaaaaatagacaaatgagagtacatcaaacttaaagccttttgcacatgaaaggaagcaatccttagagtgaaaaattaacctacgagatgggagaaaatatttccaaatcatatatctggtaaggagttagattcagaatatataaagaatgcctataatttaacaacaagcaaatagcctagttaaaaaaatgggtaaaatcctcaaagtggtatttctccgaagagttataaatggctaacaagtgacaagatattcaatgtcactaaccattagagaaatgcaaatcagaactataatgagatatcacccattaagatggtgatatggtttggctctgggtccccacccaaatctcatgtcaaaatgtaatctccacatgtcagaggaggggcctggtgggagatgattgctcatggggacagatttcccccttgctgttagtgtgttctcatgagatctgatggtttaaagttgtgtggcacacttcccccttctctcggtctctatcctgctgcaccatggtaaaatgtgcttgcttcccctttgcattctgccataattgtaaatttcctgaggcctccaaaacatgcttctgtacagcctagggaactgtgagtcaaacctcttttcttcaattacccagtctcaggtagttctttatagcagtgtgagaatggactaatacacatggccactgtcataaaaacagaaaatagcaagtggtattggaatgtggagaaattgcaattcttgtgcactgtcaatgggaattgacaatgcagccagtaagaaaaacagtatagagtttcctcaggaaactaaaaatgcgattaccatatgatccagaaatcccactctgggtacatatccagaagaattgaagacagactcttgatgacgtattttcatatccatgttcattacagcattattctcaataccaagaggtgaaagcaacccaaatgtccactgacatataaatggatacagagaatggagtatatacatacagtggaatattacttagcttaaaaagagaaggaaattctgtcatgtgctataacattgatgaaccctgaagacattatggtaagtaaaataagcccagtcgcaaagagaccaacactgtatgattccacctgtataaggcatctaaattggtccaactcatagaaagcagaattgtggatgtcaggggctgtgaggaaggggaaatagagagttgtttttcgatgggtatagagtttcagttttgcaaaatgaaaaacttttagagatctattgcacaacaatgtgactattgttaacactattgaactatacacttagaaatggtcaagatgctaatttttatgttaaacatgttatgttaaaatgtgttttctaccataattttaaaaataaataaataaattagttctgtgaacgcgacaaaatatcgattattgttttatcttggtgattggtatatctagtactactttaattttgtgtctatatcaaaatttttttaatttttagggaaaaagaaatttgaaagaattatgacagagtattaatatctgttcattcagggaagggagcaaatgggtgttttctgtgtgtttggaatatctcatcattgataaaatccaaaagtaatagcagtagccaactggcaacatagaaccttaagtttacccagtttgaatctatgggtcataattctcaattatctggagagacaatcatattaactagtccagtgagaccagtggagattatataatccaaatagagttgtactggggaagtggggtcagttctgagaggagcgatatgggcttttagagtttccagaaaaatgtttgctacagattaaaaggacaaggattttcacggtagattaaaaagtttggtaatatggcctggatgtttcatagcttgatgccactatctagttgtgccactaagacatccagagactcttatgctagttttttcacttctctgaaagagaaaaaaatgcttgtagacttccaaggtgtctatcactatactctgatagctgaagattataaataatatttttatttaggaactgttaacaaagttgtcagttatctttatgacctagccaagataactcattagcttttatacaatgtgattattgaagacataaaaaagctacaaaaaattagctgggtgtggtggcaggggcctgtaatcccagctacttgggaggctgaggcaagagaatcatttgagccgctgaggtggaagttgcagtgagtcgatattgcaccattgcactccagcctgggcagcaaaagtgaaacttcatctcaaaaaaaaaaaaaaaaaaagcagacattgatagtaacatcagcatcaaaacagagttgcatttccccaattcaagtaggtcacaaatgatgatcaaaaacctaactaaagcaaaacaatcaattactgaagaaatttgctctgtaattttataccaactctttattatgggctttttcccatttttttaaggttagaaggtgtttcagaatgtgacttaataagaattttttaaaagcttacattttttactttttattttgaaatagttgtggattcataatttggaaaatggatagttcttgggtacccttcactcactttctcccaatggttacatcttgtattaacaatagtacaatgtcaaaactgggaaactgacattggtacaatgtggtgtatagttctatgccatcttttcatatgtatgcattcctgtaacaaccgctagaagcaagatacagaattcttccaccaccacaaagatttgttggtgttaatattttaccaatttatgtcaaacatagaaaacttgccttcttttaagtctctgtacctatcttcccaacccatttataatatagttctcttaaatgtttttgctacatacatttagattcatattggaaaatattgtacttttagctttgactactaaactaaatgtagaacacacaagaggagaaggaacgtcttttgtagttacttatatttgttgttcttgatgttttaagattccttctctaaggggtttctttagccattgttttaatgtatgtggcttgtgacaaattctcttaattttcattaatctgaaaatgcatttattttcttttcatttctgaaggaaaatgttgccacatacaaaatttgggtttgacagttcttttctttcaggacttgaatttgttgtaccatttccttctgatcattatgatttctgatgagaaatccactgtcattcaaatttttttttcccctgatagttcaggtgtcatttatttcttggtgctttcaagatttttttgttcttagttttctttttattttgatgtggattagcatggatttcttgtgtttggatttcactcttatttatttatttatttatttagagacagagtctcactctgtcgcccaggctggagtgcagtggcatgatctcggctccctgcaagctccgcctcccagcttcacgccattctcctgcctcagcctcccgggtagctgggactacaggcaccgccaccacgcccggctaattttttgtatttttagtagagacggggtttcactgtgttagccaggatggtctcgatttcccgaacttgtgatccacccacctcagcctcccagaggaaaatattttcttaactgcaattttaatataacctaaactatgtattcttggcccttgttcgcaaataattcatgactacagttgcaatagtagtagaaacatactcatcactcacaacacataaattcaggccagtttactgggaataatttctgcttatgtattctcttcgttgctttattaaacaaaattttatatttttactacaatatgcttacagaaaagatagtcataaaatacagtgaatgtctcaagaaccactgatatatttgctcagccgatttggaactctgtgaccctagaaagttcacttaatctctatagttcacatctcaattggtaaaatgggatgatagaggcaatgatctactgagctcagggattaatacaaaacacagattctttttttttttttttttggtacaacatagcttttgcttatttcattgctctttagtatcacctataggaagtacacagaaaaaggaaacaacgttgaaacaaatgcatcacttttaaacttcagttcctaaatgtaccagtaattataattgaggtatgaactgcagtcactttttctaagacaaactttctaaatttctattattctctgaaaacctcgtttctgttggtatagttttcctattattaataaagacatttgattctgagttttagcaaacaacctgacatagtgaaaggggagagtgtcctggagaaagcagggatcatggaattaggaaactgatatttaccactgactctgggccagtttattgaatctcttcaatcctcagatttcttatctttcagaaaattgggaccaacaaaatataccctaaaaagattataatgagaatttgaactacattactggtcagatgaaaatgacataaaacatttttatcaatatgccctggggtccaggacctgtgttctttctctgagtacctgagtaagctcctaccaacatttggtttttcagtagtaaaatagaggtaatatctgtttcaactacctcacagagttattcgttgaacaaaaagcagtaaaattacttttatttattgcaaaatgctatagaaataattagtgttcactaaggttttatggaagtttaaacattattagttttttaatatttgaatagacttgcttaggttgaaacttcaataaggtgttaggtatcagacacacagagttcaatgatccgccttgtgtttttgtccactgctttctcattttgctgctaagggtaagcaccagagttggcctgtgtcagaattgagaatgaggagtgggctgcctttgctgcttctcactgtcccccactttctctgcagtgcccactgtgagatgctcctattctcatgctgaatttcatcctcttgctcattacttccataaattattccttagaaagagcaaagaatgaattaaataattaattttgagcatttgcataacaatacaaaactatcctttttaaagatttgccacatgattttagttttgtgaaaaatgttagagtcatgtatctatttaatcagcattttccatttagtgtctttatggtgcctagtctgtcatattctcattagttttctttttttcaatttgtcaatggcttcacctgtgttccttacaattatttagctctgtgtttatcaacttcatgaagatttgcatatattgcaagatttacaattttagttggcactatatgtagttggcactgtaattttattgtaatattaggtatttacagtatctggcaatcagcaagaaacagataaaaatgctttgacataacgggcgaaaacacaggctagtgattaattcatcagtgaacgtatctgtgttattaagaccttgcattcttacacgactgccaattgcaggaactcgtaagaaatgcagaaggaggctagctatgactctatttaaaaagtactactattattattcccattttacacatgagaaactgagccttatccatgttgaggaagttgacaagaaagatgtttcgtatggcagaatcaggacttaaatctgtatcggtttgactttctgagttcttcagacatcatagaacttactatttggttatgtgtttttgaggaagagcaaagaaagaagtaatgagacaagataataaaactgttaattaagtgtactattatgtgacctagactatgcgtttttcatgaattcagaaagagtatgggaccgtaatattagagtgggtgggggggagtgggcgctggatttgcagatcatttggtaatgtcctcgttatttggatgaggaaactgaagtcaagacaagtaaagtgattgtcccaaactgacaaaaatggctcttaaactagaactcctacttttttctaagataaatttgtaactaattaaaaataatatatattctaatggtcaaattagaactttttagtaatgtacaacaggcactcaaataatattttattcaatgccattttattcaacttcatttcattataacattgatgagaaaaaaatgtgattccccatcggggctactgtctgtgtggagtttgcacattgttctgtccaggatgggtttctgcttggctacctgagctgtcaggaaggactttggccacctgtgaccatgaactgaaataatagggtaaataattatcttacttgtttgtattaatctttcttaaatggatgtatagcttacatttatctcaaggtttaagattagaagggttttgttttttagttagaagtttggtgacatttttgtgagcagaaatacactctaagaatttatctcttttttatattagttagcctatggtaaaattgacttcaatagtcatcatttcacttaaagttgcagttttcaagaacctaccaataatgttatgtgagaccttattgtacatcataaagtttttcaaactggagaagaaaagaccatgaaagagaacagagacttagtactatggtgacacagaagaggcaaagaaaaaagtagaatgattcacccattaaacctgcctttatggaaatttatataaggcactgttgggtcctgtagctaaggaattatggaattattaagtagcttacacagtctgttagggaacagagacaattctacaaagaatactataatggagtaaggacaatttaaaaggaaagtcatagagtggtatggccactaggagtgggaagttattaattcagcctaagggattcccactgatcttgtaaggcttcacagaagtgacaattaagtttactgggcacctgaggggcagggagctattccaaccagaaagaactgcaaagggataacgtattataaagcaaatatgttacaggaatagcaagaaattcaaagaggtcctaaatacttatgcaaaagcctcagagatgcattttgaataatttttggcttgtgaaaattgtagaatcattctgaccagaaaggttttgctcatttctaattttacttaagtcaaaaatccttcagaatacatttctaactttctagtgttagcattagcagcctccacattaacattcaaagtttaataatcagcacaacctgtaaatgttgaccacccatcaacacctgcaacacctgcaacaacctgcaacacctgctgcatcaccttggctatattttgcttttatgcctttgaagaaatttgtagactttgctaggctacttgcttttcagttataaagggaaacattcacattttactccataaatttgcacaatcattgtgtgtcaatcaaacataaataaaacttaaagagaaaagaatccattagaattaactaaaatagcactgactaaatgtgagtggatgcaatgggaatcttcatggttccattagcaaaaaaaaaaacaaaaacttctctgtatggtatctgcagcttgctgtgtgtttctctctcagaatatttatcattcataaaacttacttggtgttttctttttttgtacggaaagcaaactctcatttcttaacatttttatgcttctgtggaactctttggctgttaaagtttatgtaagaacttctatttcataatagcttactgtttggtcccttccctccttggagctcaggatagactaggtcttgaggggagggatgacatcttaaccatctagtatttccagtatctagcacttagtagttgtttaatcaatgaaaagtggatgattgagaataattgaataaaactgttgtgaaagccccattaatctgaggatctatatattggccagggtgggcctggtaagaagtaaaatttagtgtctaagagagattacctgaaatattggaatttcagggaaccaaaattagcacctctttttttcacccactcctgaatttatgaaatgagatacataaaacaaatggagatttaaacatactaagtaaaaaaaaatattaatagtaactggtaagttctttggagatcatgacttacatctgctgtcaaaatagttcacagatacttcatcccagggttaggcagatttatcttcaagtcatcagcttagctggacactgcagggttctcctattatgtgataggcaatagaaatattgtgctgaaaaagtcctgctttcacactgttgaagtgaagtgaatggataatttggatatggtgtaatggtgaactatagggaattaagggaggacaggggagagtctcatggctttgacttagaaagctcaaggaatgaaatatccaagatgtgttttgaaggaaggataagagctgtctaataaagaagggaatgctctagaccagaaaaccaaaccaaagaaaacaaacatgaagtgtttgaggaacaaagctttttgtttttaatgatcagagggtagaagatgaatggcggaagagaagacaaggaggaggaaaagaagaaagaagggagtaagaatgagacaggaaagcttactgaggatggatcaggaagggctttgcaagcaattttatgtagtatccactggaccctctcctaagggaacaaacagcggataactgaatggttcttagcaggaggatggcacaatagatctttcactgtgtgaaacactaagaaagattgcaaaataaacatttaggaggcttgagctccaggcaaggcaggaaagttggagagaggtcaacagatcggagacacttgtaggatgtaaagtcaagaggattggtggtaggttatttaaagaagggggcggccgatgcccaggttctctgtcttagagaaagagatgatgggccataacatgagctacagttgcatctagttgctatggatttatttgctaaaagaggattttttttttctcagtctcagctggaacaaatgctctcccatgttcgtctttgcccaagatgtgatccggaacagttcaatacaattagcaacttcagttcagatcattggcaggattgaaatagcaaagtgtgatatcacctacaaatcaagatgtattactaagcatccttagggtgctttggatctgtatgattagcttccccattgatcatgtgttcaggctgaatttcactgtcctgtcttcagagaatacagatgactaataatccagatgtagctggttagaggattctactgcaagaagaaaattttgactctagtaaagccaaccctcttcaaaatcatagatcatgaaaaaatctttaaagctatttaggacaatgttttcaaccctgggtcaagatccattcatgagttacgaaatcacttatgtggcttacatcttgcttgtttgtcttaaaaactgaactagaatgtaatagactagaatagaaaatatcaaagcacatcacatatatagcaaatggattttttttttttgtgaaacaagcatggataggaacagagaagaaaggcattttggtagcaataacaacctgaacgaaggtagaaaggtaggaaaacataaagaatgtgtggagaatatcaagtagttcatgatggctatggtgagtatatggtagatgatttgtggaagataaaattggataatcactgaaacccatattatattgggacatgaaaaacaactcaggaattagcatgtcattcagtaggcaatagagaatcatggaaggttcttgagcagggaatctacatgatggaaagtttaatatgagagcagtggggacgatcattctttacagaaatcgggtagcagttgtagcaataatccagacacagggaactaaaaatctacatgttaaatttcttcctacctcagagctttacacatgccattccctttgcctgggtcactctccaccacagcttttaccaccttattctagctatttacttctagtttttttttatattagtcaaattttttatctaagagaaattttctgacctccccaagactcctattatatatatcactcttgatcaggtaattaatgtgctgttatttcatgtctgtgtcctctgctagaatgcaatgtccataagcagaaggaatctgtcttgtttacagcagttatctctagcaattagggtgccttgcacactgttgactaataactttttgctgaataaatgaaggagctgtgatagttaccatagaaaaaaattaaacacggaggacattggaaaggaaaatcagcatgactcagggatttactgggtcttacaccaagggaaaggaaaagccagagattcagtcattcctctgtaaacaaacatttgttccacataccctgtgtgtaagacactggtgctgggccctgggaacatggagatgaacaagacatagttccctcaaatcgagatgctcacagttggcaatcatcaaattcttatataatccttactataagcccagtacttttttgtttaaagcactttatatacattaactggacaacaattttatgaggcagatactattatcagtcccattttatagctaagttttgtagaaattaagccaaggagaaattaaataacttgcctaagttcacactggtaagtgtcagagctgggatttggttgctttttcctaactcctaagctatattgcttctttgattttcacaaagtggcataataatagatagttcagaatacctggtccagaagtagcccagaaaagaaagtggccatctatccagaaggcagagtcaaggaaggggacgtgacagtgtcatgtggaaagagtgatagggaaaacattacaggtgatagcatttcaaggcaagaaaatatgaaaaaaaatgatattttgggagatctacaatccgtttagaatttctggtgaattcctgaagggagaggacaacagataaagctactgatgaggtcagcaggagaggtttgtctaccaccctaaggcattgagacctaattccaaaggttgtcaggaacatgggactatcaaaagcagtaggggtgtggtgaagtgggatatgatccaaaatcagacttgctgattgggaataccaccccagcagtagtgaggaaggataggtttagagtgtgagctggaaatagagagacagattaggaagtgactgcaatcagacaggcaagagattatgagggacccctttaaggaattaacagtggacacagaaaggatttaagagcactgcagaacttggagagtcactggatgttgggaatagaaaggaagcaagctaaggatctcttcagggttcttgacttataaaatcaggccacaaaaagataggtgggacaacagagatgaaagatggtaagttatttttggagcatgtttcattagagataggctgacttcctgggtaaaaagtcctgtacttggcaatgtggagtctttacttactaagaagtttgaagctcgcaagtgttagtggaagttgtggatgtgatgaagacatggcgggaaaggacaaatccaagaaccaacggaagggctgagcacagaaccttgaaggatcaatcacagtagaggtgggaagaagaggagcctgaagagaagagcagagatgacatgactagagaggcaggaagacactcatctagagccacatcacagaaacaaaattgccacacctttcctggactgtcatccgggaaattcctactcatttcttcttcaaagttcaactcaagcacttccttctctgggaagctttccttgactgcccccttccatgtaaaagcctgtttccctttgctgccaactgctacttgtgtacaacttgaactttaaagaaagtaccccttcatatctttctgtctgaacgcccgtcttaatgcttcgctgtaagcaccttgggggtcccatatcacattgctcaccagagggcttggcctgtagaagatgcctaatacatatttgctgagtgaagccctgtaggaaacattgagtatcattaagacttcctcagaagagccactgcaaaatctgtgccaactgttgatgcttctagaacacagacttactttcagttttccaaataacccatgttggtctcaatgaaagccttcctattaattaccttctgaagtcctaatcttatttcagaggccaattacatcttccatgggtatattttcactaccaacccagagatcaaaccaccatcaaagcccccgagtcctgagttaatcatccttctatacaaactttcttatgcatatttttttattgcatagaccaatgatatgctcatctctgtgtcttacatcaggatgaccagactatgagcttttcgattgaaagaccaatgtcttgaagatctgtggctccagcagttatcacagcagccaagcatttggtaaaaccttgggaaatggaagaggaattagatggtgccttgatttctggccatcaaacaggccaccatcagagggcactggcggctctatcaggctgagattgcttgaggtgttcccacagcctgaatcataggccatttgtgatggaactgtaactccaatctggacttctgcattttttccaggcagcgggatagggggtgcatgctcttacttctggatcagcttctctgctccgaatgccttactggattttaaactactctctctgtctccatgctaagttacagcctgttctccttaccacatcagaggtgtgtctaagaaacagctctgctcaaagcatgttatacaaggtttttcacaattgcctcaacctgcctttacagttgtatatctgccaccagtcctggtttaccaccacactgtcaatacaaaattctctgctgtttcctgaatagaccacagatgcccccacactagtgctcttagcttaggctgtttcctcttctgcaaattcccttctccacctctaagagttctaacttgtcatgcaaggcttttgtattatctacttgataaagagttctctaatcatccaggtagagtttttctctctgcattatgttgcaggcttttaagaatgtacctttattatggcacttatcacactattcatatttatttgtttgcttattcctcttccatagtttaatattctcactttgagggcaaatattaaaaccttcaaagaaatctacaggctgtttacttgcaattaaaaatgtctgggccagttgcggtggctcacacctgtaatcccagcatgttgggaggccgaggcgggcagatcacttgaggtcaggaattcgagaccagcctggccaacatggtgaagccccatctctactaaaaatacaaaaacaaattagccaggtgtggtggcaggcgcctgtagtcccagctacttgggagggtgaggtgggagaattgcttgaacctgggaggcagaggttgcagtgagccaagatggtgccattgcactccagcctgggtgacagagtaagacttcatctaaaaagaaaaaaaaaagtctggaaagataaaaatcctgacatggtcagtaaatacatccacaaggccaggctagatcttaaggaagctctcctacttggagtcacaagacagaaacttgcaggtacattatttacagattaataaaatccttcagtggctcaagtttatctatgcttagattgcaaacagacagcatttgattcacagtcctgtcttcctcatccacaatagacattactaaataccatgagaggcaggagtctgtaggccctccagattaattttatttgctgttttggcctataagataaaagtcaaactcctaagcaaaacatacagggttattataccttagatataccatgctgttgtatatcccaggcttttgcatacactgtccccactacctccaatctgtgtaccttcacccagtcccgtttttcctatcaaccatttagttcatctagtatactcctatgtcacctttacaattccactcaaacctcacctcctctgtgatgcccaccttcactttcatgagaagacttgggcttttcctctctatgcccatggtgtttctgaatacttctgctacttatagttataaatcacttataattgtctattgccttattgttttccctttgagactgtagttgttgattgtaggttctgtgtcttatctccatagctttagaatatgacacagtgtctgtttattatttacaagctcacactgagttctcctggaggtgggcacaaagtaatgtacaaatagaacatagaaatccaaacagatgtcattagggaagcttgtgtgcaggtagaaagatcacagccactaagattttgctctggataataaagccttatctccagagaggcaggactgtctgagtgaaacgaaactcttcgtaggaaggatctagaaaatcatgaagacttctagaacaagaatgaaaatggaagccaaaataaaaatggaagcccttttctataaaatggaacattagtggaaactcatgcatgagttccaatcatcatcagaagaatgaacctcaaaagttcataaatcttgaattatagctgctctgtaactgtacaagaaagaaaaatacaatgccatagtgggaggttgtgggagccacaggaagtggctcaagagattgggtggtagacaagaatgaatgggcccagctataagaagctgggtgtattaggccgttcatggttcccagaagctggttccccagaagccaagcagatgccagtgccatgttttaaagcctgccgaaccatgagccaattaaacctctttttttaaataaatgagccagtctcacgtattacagcctgcagtacattccagtgccatgcttgtacatgctttactcataacggaaggcaaaacagaaggcacttcatatggcaaaagcaagagcaagagagactgtatgtgtgtcggggcaggggtggtatcacactttacaacaaccaaattttgcaagaactcactcactatcatgagaactgcaccaagtcctggggacctgcctccatgcatgacaaaaacaccttccatcaggccccatctcctacattggggaatacaattcaacatgagatttgggcatggacaaatatccaaactatatcattccacccctcttctccacccctaaatctcacatccttctcatgctgcgaaatacagtcatgacttctcaatagtacccccaaatcttaacttgctctggcattaattcaaaagttccaagtctaaagtctaagtccaaagtttcatctggagataagttccttccacctataagcctgtaaagtcaaaataatttatttacttccaagatacaatgtgagtacaagcattgggtaaacattcccattccaaagggggaaaattggccaaaagaaaaaggctacaggctctatgcaagtttgaaacccagcagggcagtcaataaatcttatagctccaaaatagtctcatttgactccatgccccatatgctggacacagtggtgcaaggtgtgagctcccaaggcctttggcagctctggcctgtagcttcgcagggttcggtccctgtggttgctgtcatgggttggagttgcatgtctgtggctcttctacactgagggtgcaaagtgccagtggttcttccattcttgggtctggaggatggtggccctcttcccacagctgcactaggcaatgccctggtggggattctgtgtggggactcctatgccacatttcctctctgcactacttgaatagaggttctctgtgagggctcactctgataagcagcttggacatccaggcttttctacatgttccctgaaatttaggtggagggtgccaagcctccaccactcttgcactctgtatacctgcaggcttaacaccatgtggaagccaccaacacttatggcttgcaccctctggagctgcttcctgagctactcctgggcccctttgagccatggctagtgctggagcagccaggatgcaaggagcattgtcctgaggttgtgcagggcagcagagccctgggcctggcccacaaaatcattcttccttcctaggtctttgatcctgtgatgggctgtctcaaaagtctctgaaatgctttcaaaattgttttcctattgtctcggctattagcacttggctcccttttatttatgcaaatttctctagcaagtggtttctctgcaggctgcttggattcctctccagaaaaatgctttttctttccctgccacatggctaggctgagaaatcttctaaacatttatgctctgctttccttttaaatataaattcaattttaagtcatttctttgctctggtatctgaacataggctgttagaagaactcagaccacatcttgaacaatttgctgcttagaaatgtcttccttcaatctagataccttaggttgtcactctcaagttcaaacttccacagattcctaaggcatggatacaatacagccaaattctttgctaaggaataacaagggtgacctttgctccaggtcccaataattcctcatttcagtctgaaatctcctcagcctggattttattgtccatatcactatcggcattttggttacaaccatttaatgggtttctaaaaatttgcgaagtttacctcatcttcctgtcgtcttcttctgagatgtcgaaactcttctaacatcttcttgtcacctagttccaaagctgcttccacatttttgggtatctatctttatagcaatgcctcacttctaaatatcaattttctgtattaggccattgttgcattactctaaagaaatacctgagactgggtaatttattttaaaaaaaggttcagttggtccatggttctgcaggtcacacaagcatggttctggcatctgtttggcttttggggaggcctcagggagcttttactcatggtggaagatgaagtgggagaaggcacttcacataacaaaagcaagagcaagagagacagtagggggtgggtaggtgccacacttcgcagcaaccagatctcatgagaacttgctcaccatcatgaggacaccaccaagccatgatggatctgcctggatgaaccaaatacctcacatcaggccccatctccaacactggagattacaattcaacatcagatttgagcagggacaaatatccaaactatataactggagaagcctctgccagagttttgagatagggctgacagcagagactatgtccatgtcggtattcctggtattgagttcataacaaatgctcaagaaatgcttgttgaattgttaagtcatgattttttcaccatgggccccttggtgagagaactgaaaccaatgattagtcccaaatcatttgagaagggtagaggaaagcaaaaatgaggagagcctgaagtcacactaagaattttaatgtgaatgcaaaccttattacctaatgagctagaggcatacattagatgcagaaatatcaaccttcctctatcctgagctggacttgcaatttttttttaatcttagggcttttataacctgaaatgggtacaactactaaatccatatctagggtcattcaattttcaaggtgctattttagcttaccaaaagttaaagtatgctctcccctcccacattccatttgagaagtctatctgtcagattaagatactttcatcaaggtcactagactgcttgtcaaaagtcttttaacgtcagtcactccaagaattataaatagctttggcctcaaacacgattgtgttgagggaagggagggaagaaaaggagaagaagtgtgacagttgactttttaaaagccattgacatattaaagctttgaattgcttttaaaatttttctttcccatgagtttgaggtttattggacacgttgatctgaatgggcacgggcctctgctgagaaagttgtgggagatggtcggtgtttttcttggtttgtatgttcatattgtccttcctgaaatggttaggggcatttctcttgaagaactattaatagtctacatttttaaatcttgtaaacagttgtgcataactgatggtgtttccctctgtaatagttacgtataagctttgtgtcaaaattttgcttgacttcttactagagtgagacatttttcaaactgaataaaaataatgaccattactgaacactgactatgttccaggtactggactaagcactgagcatacagctattgctcgcaacttataataacaaatgaataaaattctacctttggtctccatttacagatgacagaagtaagacttggagaaattaagtaagatgaccaaaagttaagtcagacctcattctatttgacgccaaggtttgtgtagcatatatgacatctagaccacaaactccaatgtatatgaaatagctcattttttataaaattaacaaaaattgttctcatagtctattttgctagagtggtagagaattcagttgaagtcactactgggacttgccacaccatagagttgtgctgaattcctaaagttagttatagggagtgccacatcatctgagatgtagtcattggtcctttgtccactgggtaccattaagaatctctctgttccagactgtgtgatcctttccactaacacataacacctccctggggtggtattttgctactgagaaatgcctgggcccttgactttgaccctctttttggttcaggaggcatagctccctctttccaagcttctgaaagtattctctctatcctgcatcctcaggataatagtagcatagtcttttcaagaagttctaatatgacaaaaaaaaaatctcttttaagtgtcttttggttttccaccctgtaaaaatcctagaggcagagcagttctaaaattccagttgtgaggtaggaaaatataggaagaataaataagctaatattccacaaattattctgctatgtgccttctttctttaggtttaccaggtatagtttggtctgaataggtatggtccattgatggaacataatgagctttgattattgtgtcttttctttgcaaatctattttctagcacccactgccagaaatggttgtatttcttagaaaccatggtttatttttatttcatgggcacggtgagtcatataatagactacatttccctttctgcaggttttttggagacattttgatcagatatgtgtctgtgtactctgacattcttacaacgtattttctagactaaattgtataaaatttagagagatttgttttgtttattttattttaattttcataggttttttgggggaacaggtggtgtttggttacatgagtaagttctttagtggcgatatgtgaggtgctttttttttttttttgagacagagtcttgccctgtcacccaggctggagtgcaatggcactatctcggctcactgcaacctctgcctcccgagttcaagagattctcctgcttcagcctcctgagtagctgggattacaggcacgcaccagcatgcctggctaattttttgtatctttagcagagacagggtttcaccatgttggccaggagggggttttggtgcttttaaaatactatgtattattatatatgtcaggacctgggagggaagatacgtaatgaaagtggtctcttgtttggtctcttcttaaaattttaacctttctgttttgaaaacatctagcttccagatttttatgtttcataaagaaatatagcattattactaataatagtacttgttttagacctgatgttacaaataccaaaaaacaaacatacaaacaaacaaacaaacaaaactttgtgtctctttaagtatttgtttttcttcaatggaatttggggaagaaggttgcaggtcagaccaaggaagtggagctggggccaaactgcagcaagcagagctcagtgcagaactgcatgtactcacacttcctcagcccctaggcagaatggcagacctgagcttccccacccttcaggaccggagagaattgaatttatttctacttaagttccagtaggttgccatgctgtctgtgggcactcaataaatattgactcaattgcgtgttgccatgggttatcttcctttctctcttttccctccccagctcctctggctggttccttgggtttttaaaagttatatacattttttcagtgtttcatttgtttttatgtcattggttttcagtgttaggcctctctgtgttctaaatattacttctttgtgtttgttttctctgtctggttcttgcctcacaacttgtctctgaatctgcccttctttgttttctttctttgagactctgtttctgtatttctcctttctatctctttatgtctctccttctgtctctgtctctctctctgaaacttccccatacccctttctatacttctgtttgttcccttccagaactgtcatcaaatcattgcattttcccaggagaaattgaacacactaacagatttgtataagtgttcagaataattcattttatgttttttttttatttgaaacagcagtttcagtccctaaatataggaacttgggaaaagtagatcagtgtctatgttgaccataatacattctaaatcatacagagtgattgaatcagctctcctttgggttttctatttgccttctgcccagacaggattgcattcctctgcgcattctgacacaaatgcagtgacatttcaccaggcaactattagcctagggggaatattcagcttctcccttcccctagtgttttaaacctcattccaataatttggcctaagatgttggcacagaaatactggttgcaaaaagtccttggagactgatgctgactttctgccttctatgtctcaattttagggacaaaaatgagacatgggtttgcaatggctttccttcagccactttctggttaagatctgaagggtgtgatcaacctccctggggtttgacaggttactgtcctgctgttgacattaaaattaattctctaaacatcatttgtgcctagaaaggtaacaaactaatcagtacttaagcaagtatatggaggattgaacttttaaagtggcatggacagactgtaaaaaaggcctgtgtccttgttttaggagaagaatacaatttcttttttcttctttttattttttaaatttattttaggtttagaggtacatgtgtaggtttgttatacaggtaaattgcacatcacagaggtttggtgtacagattatttcatcatccagataatcaacagagtacctgataaggaatttttcaaatctctccttcctcccaccctccagcctcaagtaggacacagtgcctgatattcctttctttatggtcatgtgtacccagtgtttagctcccacttataagttaggatgtggcatttgggtttctttttctgcattagtttgcttaggattatggcctccagctttatccatattgctgtaaaggacatgatctagttctttttatggctgtgtaatatgttgtatatccatccatgggcatttaggttgattccatgtctttgctactgaatatagtgctgcaatagacatacgcacccatgagtctttatggtagaatgatttatattcctttgggcacatactcaataatgggattgctgggttgattgataattctgttttaagttctttggggaatcactgcagtgctttccacaatggctgaactaatttacattcccgccagcagtgtataaacgtttccttttctccacaaccttgccagcacctgttgttttttgacattttagtaagagccattctgactggtatagatggtatttcattgtggtcttgatttgcctttctctgctggttagtgatgttgaacattttataatatgcttgttggccatgtgtatgtcttcttttggacacagtctgttcatgtccatgcctactttttaatgggttttttttttttttgcttattaatgtgtttaagttccctgtagattctggatattagacctttgttagatgtgtagtttgcaaacattttctcccattctctaggttgtctgtttagtcaattgatagtttcttttgctgtgagaaactatcaattgaataaacagataaactagagaatgggagaaaatatttgtccagttttgtttttgttgcaattgtttttggtgtcttcataaactatctgccagagcctatgtccagaatgatgtttcctaggttatcttccagggttttcatgttgtgggttttacatttaagcctttaatccatcttgagttgatttttgtatatggtataaagaaggggtccacattcaatcatctgcgtatggccagcaagttatcccagcaccatttattgaatagggagtcctttccccattacttgtttttgtcaactttgtcaaaaacaagatgcctgtaggtctgtggctttacttccgggctttctattctgttctattggtctatgtgtctgtttttgtatcagcaccctgcccttttgattactgtagccttgtagtatagtttgaagttgggtaacgtgatgcctccagctttgtactttttgcttagaatggccttggccattcaagctcttttttggctccatatgaattttgaaacaattttttccaattctgtgaagaatttcattggtagtttgatagaaattgcattgaaactgtaaattgctttgggaagtgtggtcattttaacaatattgattctccctatccacaagcatggaatgtttttacatttgtttgtgtcttctctgatttctttgagcagtgttttgtaattctcattatggagatttttcactccctggttagctgtattcctagatattttattctttttgtggtgttgtgaatgggattgcattcttgatttggctctcagcttggacattgttggtgtatagaaatgctactgatttctgtacattgactttgtatcctgaaactttgctgaagttttttatcagatctaagagctcttgggaagagactatgggttttttcaggtatagaatcatatcgtctacaaactgatatagtttgacttcttctcttcctatttggatgccttgtatttctttatcttgcctgactgctctgtctaggacttccagtactatcttaaataggggtggtgagagtagatatctttgtcttgttccggttctcaagggaaatgcttccagcttttgccccttgaatatggtgttggctatgcgtttgtcatagatggcttttattttgaaatatgttcctccaatgccaagtttgttgagggtttttagcatgaagggatgctgacttttattggagagcttttttgtacctattaagatgatcatgttatttttggttttagctctgtttatgtggtaaatcacgttttaatttgtgtatgtttaactaaccttgcatcccagggataaagcctactacatcatagtggattaggttttgttgtgctgctggatttggtttgctagtatttcattgaagattttttatctatgttcatcaaggacactggcctgaagttttctttttttgttgtgtgtctgccaggttttggtattaggatcatgttggcctcatagaatgagttagggaggagtccctccccctcagttttttggaatagttcaatagaattggtaccagttcttcattacaaacctatggatgtcataggtttgtaagtctggtagaattcggctgtgaatccgtctggttctgggcttcttctggttggtaggctttttattactgattcaatttccaaacatgttattggtctgttcagggattcagtttcttcctagttcaatcttgggaggttatatatttccaggaattcatccatttcttctagattttctagtttgtatgcatagaggtgttcatcataatctttgaggtgtttttgtgtttccgtgggatcagtggtaaagtacccctggtcatttctgattgtgtttatttgaatcttctttccttttttctttattagtctagctcatggtctgtcttaataattttttcaaaagaccaactcctggagtcattgatcttttgtgtattttattttgcatctcaatttcctttcattttgctctaattttggttatttcttgtcctttgctggctttggggttggtttgctcttgtttctctagtttctctaattgtgatggtagttattaatatgagttctttctaacatttttatatgagcgtttaatgccataaacttcccccttaacacttccttagctatgtcccagagattctggtatattgtatcttttttcttattactttaaaagaatttcttcatctctgccttcctttcattatttacacaaaagtcattcagaagcaggttgtttaatttccatacaattgtattgttttgagtgattttcttagtattgatttatatttttattgtgctgtagtccgtgaatgtagttggtatgatttctgtttgttttttggtttgctgagaattgctttatgtcctattgagtggttgattttagagtatgtgctatgtgcagataggaaaaatgtatattctgttttggggtatagtgttctgtagatgtctgttcagtccatttggtcaaatgttgtgtccacatcttgaatatctttgttagtatttttgcctcaatgatatggttaatatggtcatggagtgttaaaatctcctagtattgttgtgtggttatctaaatctcttcataggtctgtaagtatttgctttatgaatttgggtgcacctgtgttgggtggatatatatgtaggatagtaaggtcttcttgttggattgaactctttgtaattatgtaatgcccttctgtccttctttttgttttttgtttgttttgttttgagacagagtctcactctgtcacccaggctggagtgcagtggcatggtctcagctcactgcaacctctgcctcccaggttcaagctattcttgtgcctcagcttcctgagtagctgggattacaagtgtgagccacagcatctggctaatttttgtatttttagtagagatggagttttcccatgttggccaggctgatggtcgaactcccaaactctaatgatcatcccaccttggcctcctaaagtgctgggattataggggtgagccacaacgtctagcctccctctttcttttttgatcattattggtttagtgtctattttgtctgaaattaaaatagttacccctgctattttctgttttccatttgcttggtaaatttttctctgttcctttactttgaatctatgggtgtcattgtctgtgagatggatctcttgaagacagcatacagttggatcttgctttcttcttcaccttgtcactctgtgccttttaattgaggtatttattctgtttgcatttaaggttgatattgatatgtgtggccaggtgcagtagctcacacttgcaatcccagcactttgggaggccgagtgggtggatcatgaggtcaagagattgagaccatcctggccaacatggtggaaccttgtctctactaaaaatataaaaattagctgggcgtggtggtgcgtacctgcagtcccagctacttgggaggctgaggcaggagaatacttgaacctgggaggcagaagttgaagtgagccaagattgtaccactgcacttcagcctggtgacagtgagattccctctcaaaaaaaaaaaattgatatgtgtaggttttatcctgtaatcatattgttagctggttattatgcagacttgattgtgtggttgctttatagtgtcaacgacctatatgctcaagtgtgcttttgtggtggctggtaacagtctttcctttccatatttagcactcccttaatgactgtgcaaggcagtaacaaattcccttagcatttgcttgtctgaaaatgatattatttctcctttgcttatgaaactagtttggctggatatgaaattcttggttggaatttcttttttcttttttttttttttaagaatgctgaggctgggcgaggcagctcaggcctgtaaccctagcactttaggaggccgaggtgggtgaatcacctgaggtcaggagttcgagaccagcctggccaacatggtgaaaccccatctctactaaaaataaaaaaattagccaggcatgatggcgggcacctgtaatcccagctattcaggaggctgatgcaggagaatcttttgaacccaggaggcggaggttgcagtgagctgagattgtgccacttcactccagcctgagtgaaagagcaagactctgtcaaaaaaaaaagaaaaaaaaaaaaaagaatggtgaatataggcccctaagtctcttctggcttgtagagtttctgctgaaagttccactgttagcttgatagggttccctttgtaggtgaccttccccttctctctagctgcctttaacattttttcctgcatttcaacgttggagaatctgacgactatgtgtcttggggatggttgtcttatatagtgtcttgtaggggttctctgcatttcctggatttaaatgttggcctctctagtgagattgggaaaatttttatggatcataacctcaaatatgttttccaagttgcttgctttctctccctttccttgggatgccaatgaattatagatttggtctcttggtctctttacataatcccatatttctcagaggttttatccattctttattgtttttgctttatttttgtctgacggagttatttcagagaagcaatctctcaagctctgagattctttcctcagcttggttgatggagctgttaatactggttgtattatgaaattcttaaagtgagtttttcacctctgttagttcagtttgattctttcttaaaatggccattttatctttcatctcctgtattgttttattacattctttagattccatggattaggattcaactttatcctgaatatcaatgatcttcatttctatccgtattctgaatgctagttctgacattttggtcattgcagccaggttaacaacctttgctggggaactagtgtggtcatttggaggtaagaagacatttttgccttttttgttgttgttgttgttgccagagttcctgcactgtttttgtctcatcaatgtgggctcatgtttcttcagcctttgaagttgcagtcctttggatgggctttttgcttttatcttttttggtgcccttgagggtttgattgtgattctcagtgggattagacaactggcttcaattatagtctgctcctgggtcttggaggagacccctccaattactgtctccatgactgtgtttcttttgttgggtgttctggtccacaggacttccttaggcagaggttgcagttagcagacaagccatttccttgctgggttggccctaatatgttgtttgagtgcttctcagggaaacataaggttgcacctgtctacagagtttaggcaaaagcagaaccactgagctggaagctctagcagatgtggcccatcttgctatgagaggcaggggtaggtggaattgcccaccctgccatctgggtgtttccagggcaacaggaagctgcacctccaacaaatttagacagaggtggaacctgtgaattggaaactctggcaagcattacccacttggcttccagtggtaggggttggtagggtcacccttcttgccatctcagtgtttctcaggaaaaaggcaggctttgcctgctagctgagttcaggcagaagagggttttctgggcttgaagatctagcaggcattgtcccccttggctaccattggcatgggtgtgtggtgtcacccaccctaccatctgggtatttctcaggacaacagaatgctgcactcttggctgagtttatgtagaagtgggactgttcggctggaagctctaacaggcattgtccacctggttatcagtggtggggatgggtgagatcacttgttctgccatctgggtgcttcctgggacagcaggaggctatggctgctggccaagttcaggcagaagcagcaccactgggctggaagctggtagtgagccctgtccaatgaaatgaggatagatcaatcttatttctcccagacactgcaaatgtggcctctattggagctatggtgacagtgctggtctgctttggggccaaaggcttgcagaggccctcttggactcaaaagttgcctccacaaaatgaccaggtggctctctacctcagtttattatcacagatgggagcgtggggggccagagggatttttccattcccagtcttgcataggtccctgtggagagtgcgaatcttctagggggctctcactcgctcaccctttaccatgtgggagaggttctcctggtttcacactaagccaagataggctggtgtccagctttgcttctctctgctctgtgtcccctgctgccttgatggatcccaatgtggtttctcagatgtttggcctgcagggtcagtgttcactagcccttttgtttcctttctgagagcagcacacgtgagctgcttctagtctatcatcttggaccctctaatctctttttctttgagctgacattattgagggccttacatgttccaacaactttatgcaaaatatctcaatccttacagcaaccctaaaagttaatatgatgatacccattttgtaggtgaggaaactgaagctaagagaagttaagtaacttgacagaggtcatacaaaatagcacagttgaaacttgttgaacatgagtatttttatgttcctgagggcagtttttatgcctagaaaaaaacctatttaacgtaattttggtacaaaattagtattcaatttatttaaactcttgttcttcttaagcttttaggttagtttataaatcttattaacacattcataaacatagcaaattttataattactttgaaggaagatttcacaacttaattaaattccttaaatatttaagcacatttattaatgtaacatatttctgttttcttttgaagtataccaattaggtgacttaagaaacttcccaagaacttaagtcactcttataagcctaataaattaaatttataggtatgatgaacctgaagttctcttaaatgttacaagtaagattttaatctgaaattacaagcctaaagcaattactcacccattttagcttggaattacaatgttgacctgttattataaaacgtccaattttcttaaataattctagtaactaaaattctaataggcacatatttctaaataaaaacattttagagttgcgactttgacattttcatgctctataatactaaatgttgctatcattaaacgatcagaacatggccaggcacgttggctcatgcctgtaatcccagctctttgggaggccaaggtgggtgggttacttgaggtcaggtgttcaagaccagcctggcaaacatggtgaaacctcatctctactaaaaatgcaaaaattagccaggcttgtggcgcatgcctgcaattccagctacttgggaggctgaggcaggagaatcacttgaacccaggaggcgaagattgcagtgagtggaggaggtgaaggttgcagtgagcggaaatcactccactgcactccagtctgggtgagagagcaagactccatctcaaaacaaacaaacaaacaaaaaaggatcagaacacaattatatcatcctcagtaattttaccatcctaagtaattctgagacacttatgtgtaatgctgttgtgtgggacaccctgattcttatttatctgtctcagtgccctctgaattagacaaaattctgatagcctccaagatatccaccccctggtatacacatgctgtataatcatctccccttgagtgtgagcagaagctgggaatatcatgggtaataactcccatgattatgttacattatattgccaaaggtattttccagatgcaattaagtttcctagtcaactgattttgagttaattgaaaaggaaaagttcctgggtgggtttgatttaatctggcaaaaccttaaaagagataagcaggagcaagagcagcagcagcatcaccactttcctgctgaccttagaagatgatctcaagcctcaaatgagaccacagcctaggctgacactttgatttcagcctagtgagaccctgagctgaagaccaagctaatgcatacccagattcatgcacagaaattgtgagatagtaaaactgtgttgctttaaatcactaaatttatggtgatttgttaggaagcaatagaaaattaatacactctctaactggggtggtcttatcatgtgtgtcccttaaattcagtgtatacatgtgtaattctgttcacttacagagattggaaaccctatacagtctgctatagaattttgcatcattttctggctgagatatttaggtgtctttctatgtaaaggaactccatcacgttcctagattattgtaaataggaacatgaggggaatcctctatatttgttgtatgcttcctttatttgggacacaactcttctagatgttaaaatcacatcccactgaattctgtaaatttttggcactttgtctaactattccaagatcattttcctgaaaatgcaagagccaaaatttgtctgtttctaaagaattagactctttttacttcttttagtgaccaggaataagtttttgagttttgaaataatattgagatgtttattgttccacttcattctgagagcattctaaagcttctctgagttggacttctgaggttctctgtggttgctctgaagcaatagtagttatattctaacatcattactcactccatccataaaaaatgtgttatactccatcaaatggtttttaagtccatctgtgcatttattcattaagcttttcttttaacagtacaatgataattaacccatgtatgtacataacactctaagaaagatacaaagaatataatataccatttctgttccataagactttatgatctagttggaaacaagatatagatgcaaaaaattttgcatacaaaacaatatgggttaagtggtacatatattatgtaatatgactgatacaaaatataagtggagatagagatgagaataagtttaaaaacttcatggaacaagaagtatttaagctcattcattcattcagcaaggatgaatttagaaactttaatgtgtcaggcactgtgctaggctctgagggcccaagaataaggtgcagtcactcccttcaccaagctcacagtctagctgaggaaacaaaaaaaagggaaaataaaagaataaagatatacaatatgataaatgctattacagttgtgtacaacatgcaatgcaaaccaaatggagagaggaataatgccggcaatgaggatgggaggaagcatatggcaaaggagctttcaaaggggatattcttgctgaacctgatagaaaaaataatactgtccttttgtgaccatttcttatgcttcaggaatgaccctaagtacttttatactaataaacctcatatgatcctcacaacaacttcatgtgatcagagattgctaaagactgcatatttgtctcccccatacctacccaccaaattcatatgttgaaaccctaatccccagtgtgctgacatttggagatagagctttgggagataactgggtcatgaaggtgagacccacataatgggattaatgcccttttaagaagagacaagagagagcttgcttcccttctctgttttctccaccatttgaggatacaatgagaagactgacatgtgcaaaccaaaaagagggcactcaccagacaccgaatctgctggcaccctgatcctgaacttgccggcctccagaactgtgagaaacaaatttctgttgtttaagccacctagtctgtggtatcttgttatagcttcccaaactgaccaaaacagggatacaataccaatggagagtagttcctaaagaagagactgaaatcatcagaccacaaactcatcatccctctgcctgggacactatctcccagataccacaaggctcactttctcattcattcaggtttccatctaaatgtcatcttatcagaaaagccttccttgatcaatctgtcgaaagcacaaccactttcctctctctcttctcttcactcccacatcactctctgcatctttactctgctttagttttcatcatggcaattattagacattttctgtctcccctaactagaataagcgtctcatgaggacaggaatttttgtactgttctttatctccagggctaagcacagatcctggcacacactggatgctcaataaatatggttgaattcatgaatgaatgaatgaagtgacttgccaaggtcatacttttggtatatggcagagctggtccttggatcaaggtttgtttgaccccattgacccagttcttaaatacttctcctcactgcttagaaggaagaataagttaacactagagacagaataagttgcaacataggggatgtgagaaggagggtcctgaagatgaaaccagggaaatagtttgggatcaataatgaaacatctagaagtcttggaagagaagtctataatttttcctttgggcatgaagaaaaagcttactgagtggggttacgagcccctcaaagtactaatggtgagggcttgagaacagctgagaggggaaaggacatttatatggactctaataacactttggatcttgttgcatttccattgaaattctacagaatactgctatctcaaggggactaagtggataatttagtaaatacattccttcctggcacttttcatgcatgacttggtatagtctgttaaaggctttagctttaggttatggtctgctttgatctccaagctcttctgctgattttctgcatgttgctggttatgcttattacagttctttctcttctttcaacccaaatgtgtgtaatttgtcctgttggtaacattcctgcctcccccatttttggtggaatgaggaaggctcaggtttctaaatctatagtttttgatattttttttatggcatgggaaataactgaaatctgcttccttttagtgcaattctaggttctaatatgatagatttgtttattgctcctatatatacttatttttcaacaaagtctctaaataatttttctctgtatataaatttcaaattcttgctattttctctgtggtgcattagagaatataaagcagattttaaaaatctgttttgcttgtgagctggctgatttatattagctattatgttctagctgggtggttatgctgtttcataatattccaaaactcatattaagacccaaactgcagaccactatgtaaacaagagcaaagagtagaaacatattttctttcttccattatgtttggatataagattctatttagatctttctgagtaactcaaaataggtatgggtaaaggcagcttcatatgtgtttgttcctgaccagaaagcaatgaagcaataacactgtttctgtctttcattttggtgttaaagcatgcaaagctgtgggagttgactatttgaaaatcagcataagagtaccatgtacactagcaagctttctcctggcttttctccaagctgagtttccaggagcagagaacagactcaaaaagccctcttagcagacgtagcagtcatggttgtgttgcaataggcacctcacaatcgtgaaggggcatcaaagtgatggccttttatgaattcgggcagatccaaagactctgaaaaaccaccatttaaaaggataaataataggcttctggagacaattaaagagagggttagggaagttcaggaacatcaaaatgtatctatgtagatcctatttttttcagcctcccaggtattttaaaaattgcatatatttaagttatacaacatgatgttttgatacacatttgcatagtaaaataattactacattcaagcaaattaatgtatctatcatttcacatagttacctttgtgtgtgtgtgtttgttaagagcccataaaatctgtcttagcaaatttccagtacacaatatcattaaccatagtccccatgctataatttagatctctagacttatttatcctacataacagcaactatgtttcctttaacctgctttctccctgttctgcctcccatctcaggcttttaaattcatccgagatgtgaaaaaaagcacaatctgtgctaagaaactaggctttggtttgtgaatttggggattttttttttctgatggaaaagactgtggggcataagatgtagttgtgctgttgtttagccatagatttgtgcaaattagaaaaagatgcctgtttctttgggattcgccttccctctcctctgcctggcaccctcgtggtatgaataatgtgcataacaatttgcagcagccctgagatagggtgggccatagtgcacagcaggagtgtagtaggttttttagaaaagaaagcacgtaagaacagctgaatttatgtggtgttaaatatttcctcccttttcatgccccattggcttagatttacctactatgcctagatatatgctaacttgctctttagcgacaggcaaattaacccctcaaatctaaatcagcaccagtacctcaatcggatttccacttaagattgtgctctgttgggaggccgaggtgggtggatcacgagttcaggagatcaagaccatcctggctaacacggtgaaaccccgtctctactaaaaatacaaaaaattagccaggcgtggtggcgggtgcctgtagtcccagctactcgggaggctgaggcaggagaatggcatgaacccaggaggcagagcttgcagtgagccgagatcacgccactgcactccagcctgggcgacagagcgagactccatctcaaaaaaaaaaaaaaaaaaaaagattgttctctgtttttgttggcttatgttttatttattttatgttaatgataaatataattttgatttctctgttggacaaatttagtataaaatgcaaaggcaacctaaaattacatataaatattaccatggctcacattcagagaaaattaaatgaccaaaagaaaaataaaataagaatcatgatgacaattggacaatacatcaatgttcagattaggtttctacactaggctagtgtttaattcttttcatatggcttatgatctatagttttcttcttgcagtggtcaatatgttagataattgctgatatgacatctaggtaaaaccttgagctgaggagaaccatcagatcactgacttctcttgaaagccccacatgtctgtgaggacttgttcttaggcttcttcccttgggacagtttactttttttttttttgctgttaggagccacttccgatcttgcttaattaatatcattgctcttttcctgtccttcatctccaaatgttactcttgaccctttctgagtgacttatttaactgaagtacattaaacatgcataaacacttcatgtctttcagaaacttcatttggcatttccatgttgtaccacttcaattcagctcaattcaatgattacggcttagtcttttatacacagaccactagacaaggtcctgcagaaacacagagtgaaggaagcatagaccctccactcagtgagcattcaacagacagcaacaaaagtaataataacaactgccatttatttaacaacacttattttgtttcaggactctatatcattttctcttttaacccttatttctgacacccctgtaccataagtattcttatcattttaccactgaaaacactgaggcttatagaattaagtgatcctcttaagatcagaaagccaataagtgatgtgaaatttgaaatgacccccaaatctatcttctaacctctgtaaactggtggaggatgatagaaaaaaaagtggacatcaaaacaactataatacaaaatactggtccattaacttatgctacaatctactttaagtatcaccccttccaaattctttcttgtgtatgttatcttggtaaacggcacaatcatccactcagctgcatggttcgtctaaccttatcctaaccagttactttgtcttatcagttttagcacttaaatatttatctccacagacaccatgttttcttactgtaacagcctgttctcacacacagccctccctgacctatccttcatggtgctataagggaaattggtttttatcatgtttatattaaaaatcttttaatcactcttcttaggacaaagtccaaactcctaaggctggcataaaaagtccttcaagatatggctatggtttttccctctggttttatctctagagttacctgcaggagaacccagttatatatttataggaatttttgtttgttttgttccttaagtaccttaaacataataagccctcttactttcttcatacctattgacatgctgtcctctctggaacctgattcttgagtgcagttgcttttactcaacgtgcaaaactcagcttcagcttctccaggctgggttttcctaaatcactcactacctggctgtattaagtggcactcctttggatttcaactataaccttcaattccactgtcataaaactcaccccattctgtgtcaaccagcagtgcctttgttgtctctggccttagaccatgagcttccagcagcagggactatcagtcatcacacaggcactcaattaaggattgtttaatgaaaaaataaagacacaataatttccaagttatttctatttgattttggaatgcatttcctgaattcccatttggtgtaaacacacccactcacaaactacagatgccatcctcagacctacagttggatattaatgaagcagctagaaacatttcaatgaactttaaaggctcaacactcctagcactgctctgtttctcagttcttgctattctattcttcccctctttcactataattggtaaaagtctatcttaagaaaaaaaaaaagaaaaatttgtccatttttaaaataggaggacatcaaatgatctttactgctgccccaagggtatggaaatggtcagtgtcatataatacacccatttgtggttttagatcagataccctccagggcaggagctgtgttcttgatacagtctgcttgttttagagcttgcaggcttgcatagcattcttcttctctaacaacaattataaaaatagcatggactttcttgtaatcttagtcataagctaaggaaggaaggattacaaaattctgccaatttaagatcattgatggagaccttaaaaggtcctaataaatgctttatataatatggaaaaccatgtatgagagacatgtgccatgagtcttaggaaaagacctttgaaattgcacttagaggtagtaatgttatacggaaacaaaatctttactatgaaatctcactcagctgaaaggggaaatccacaacagggctgagttaatgttgaaagggcttcctagaccagctacttacctctttataattatctaggaataaatactttggagcacctactatgtaacctcttgtgaaaaatacacagaggtgaggttgtaaaatatggagtttcagggggaaagaaagctttggaggaagacagacctgcatttcaaacccaattctatcacttatgagctgttgctttggggcatattcattaacctctctgagcttgagtttccgcatgtaaaatgttgacgataaccctacctcacatgttccttctaaggtttaaacaagataaggtgttcaaagtgctcagcacagtgcttggcacagaatgaatagtaaatggtgactgccatctgttgacatgtatttaacacagctggcaccaggtatgactagtgtcaaatgagaagcatatacagaaaaactgttaggaatgaaagtgtgcttatagtgttcatagatagattgtactagctattcaaggagtaacatatcctcatcccctgtcttcttcctctacatattgtaacctccttaggaggtggctcacacctgtaatcccagcactttgggaggctgaggtgggtggatcatttgaggtcaggagtttgagaccagcctggccaacatggtgaaaccccgtctctactaaaaatacaaaaattagctgggtgtggtgggccatgcctgtagtcccagctactcaggaggctgaggcaggagaattgcttgaacccaggaggcagaagttgcagtgagccaagattgtgccactgcactccagcctgggtgacagagcaagactcctcaaaaaaaaaaaaaaaaaagaaagaaaaaaaagagtaggaacatttcttacttcaccttcatatcttcctagcacgtaaaataatactgcatctacagcagatcctgtaatacatattaaataatatctgatctatgtgctttctgtgagtaggtgattgcctcttggaaagcagaaacaatgtccaactaaaaaaaaaacgtttccttactattgagtacaaactagaactaaacaaggaacaaatggaatctagtttaccagcttttctcagatcctcattctcctcatgcaatatgccataactgtgtggtttgaggttagaagctgataatttacccattatgtgccaggcaccttgtaccatctagcctaattttctaataatccatgtggggtagatactggtatctccatggtacagatgagaagctgatgcttaaagagtctgagacacttgcctaaagtcatgcagctaagtgccaatgcttagatttaattctagaacagcctgctgcctcctcccacaggacaccgcctcttgtttcagctataggactgtggcgtggagaaagacatcaggacaaggccaatgtcctgggaatggtagtagggtcttttttctgcatgtctttccttgtgattcctgaggagctgaggaggctacatcaccaggactttccccagcatctgccttatccaactaggtgacaagagcacagacaaaccattgtttaagttaaattctagcttttaagttcatatgtcagtgttcatgcagaaatgtgaaatgccttttacatgagtaagaactcttccctgaatagtcaggacttttctgcgaatttataggattttattacacaaagtgttaaaataagtcaggaaaaaattcctttgaaaactactgccaagatgaacgtatgcaaatgttccaaagtctattgctgctaggaataagagcaacagagaaaattcatttgtttgttgcttccttgatattttaattacatcttctatatcctccataccccattcaacattttcttaaatccaacaatatttattaaaaataaaataaaaaatttaatctacacataacagccttattacaaaataattattaaatgttaagaaccacaatttggttttggtcagaatgaaaaataatcttttaaagtgcctgataggtgggacatggtggctcacgccagtaatcccagctctttgggaggccaaggtgggtggatcacctaaattcaggatttctagaccagcctggccaacgtggtgaaactacatctctactaaaaatacaaaaaattagccgggcgtggtggtgggcacctgtaatcccagctacttgggaggctgaggcaggagaatcacttgaacctggtgggcggaggttgcagtgagccgagatcatgccattgcactccagtctgggaaacaagaacaaaactccatctcaaaaaaaaaaaaaaaaaaaaaaaagagtgcctgataaatttgttttcttatgaagttttgtgacaatcatcattttaactctgtttaccaaatagcattttgagcctgcaagtctgccagaaaactacattgaatgcctagttttctacatgaccttggatagtttattatatttcagaacactttggttgtctggtatgaagcgtatttggttttcttctactcttgctggaggcaaactcattttttttcccaaaaagtatgttacataattattgaactcctggaagaaaattagaatatttttaatgaagtgctattatggataacaattcctgtggaatttgatcaagcctcacctttaggcaaaagtatatttagtttactgtttgcttcttgaaagtcctctccccactcatcccaccctatctccagtagaggtatgtgaatccttataacagtcttaaggagtagacgttaattccattgtataggagataaaactaatacccagggagtttaagtattgtgcctgaaatcacacaaagctgaatggcaaagttggggggttaaaccacctatatctgacaccaaaatccaatctcttcacctacagcatgactttcttagcattcccttagttttctctcaaaggttttctcttgacatctcactgagtggtgggctgtttgatgattcaaatataatggagttctaaggatatcaatccctgctgtcaccaaatgactctcaattgattattgatttcaattgattattgacatctcaatactgagttccccccagcaccaggagcaagagcatagcatttaacaaaagaaatgacaaataggagaaattacaaataatatttaagccacaatttttactcattcttttcttattttctcaaaatatttgacaagtgatagtccacactctttgtgtatcaggatctctggacatttataaggcaaagtcagttgctggtcatgaatagcaactcaaacaatccaagcttcatgtggttagtattctgccagcttgaggaaacttgtctttggctacaaataaaagaaaagtagtcccaaaatttaagtggctgcctatgattactcattgcctttgaatagtggttacttttcatggtatacaactacaaaatcatttacataaaatccagtgtaagagctgattaaatcagcatcactttgtaaaccaagtgaacagacacagagctgaaattcagactccagatgctgcaaaaaataaaaataaataaagatgctttagaatgcctggctcagtccctgatgtgagatttcacaaaaacaagtttctgtttcacagaaacaacccatagcatacttgctgaagaaatttcagagaacaggaaaggaatttggtctgacataattttaggtacagaagtgtgatgttaaggtaacagcataagctcttgttttgattgtgtctgttatcacatgtaagaactatagtttcaaagctcaggctaaggtggttgcaaaagaggtttaagcagtggacaaacagttgtactagaccaggagaaccaaataaaactttttcacagatccctagtggttggtggcaatgtctctgacaacctggagtaagattaggaagaagagtgctgcagtgcatatgtgcatgttgtctggtgtaagattccagctactctttctgggaaagactgccctttgcagtgaaatgataacattcctaaaattttaggagttaaaatctcttttcttcaaaatgatgaagatagtaggatgcatgtattttctctttttttcaaatgtccttacttaattaaattactagttggctactgttaagagttaacttgtgtccccacaacagatattgaagtcctaatccgtagtatctatgaatgtggccttatttggaaatagtggttttgcaaatgatcaagtttcgaggaggacattagggtgggccttaattcaagactggtgtccttatcaaaggggggaaatttggacacagagacagatgtatacaaagaggaagatgatgtgaacacacagggataatgccatctacaggtcaagaaatgcctaggaatgccagaaaactaccagaagctaagagaagcattggaacagattatccctcccagtcctcagtagagaccagccatgctgactccttgatctcaaacttacagcctctggagctgtgagacagtaaatttccattcagcctcccagcttgtggtaaattgttacagcagccctaggaagctaatacagccttcttaggtcaaattcttatttttgtttttatttgttttgctttttgaaattctactagttcttaaaatcacagagtctgaaaacccttatcaggggtggctgcaaggtcccatccaaccctaagattttatgatattttacactgcaacagctcttttctaattttttgactaggcgttagtgttcctccaggactggagcttttcagactctccttgacatagcagagtacaaacaagcacaacatttaggtgtttcagacccaaacctcagaaaatatcccacaatatggcttgatactctaaatgcggacgctggatttctttccctgtagtttgagtaggagtaaaactctaggcactccttgtataggatgtaaaagtaagttagatgtgcctccacccatggatccgatgaggaacggtgtttctcagaagcttagggataagtgcctgaggtctgtggaatgcctcttcctttttatatttgtattatcaaacagcccaccactcagcgatcttgagaccccgttcccctttcctttgtcctcccaggcaagctacataagaggaggttagggacagtgaggtatgttttatctgattatgctagaatgcactggtgtcacatttccattgcttgaaggggttgaagtgttctttagcttgaagaaaatctaaccggcaatccattcactcatttattcatttgtgaattcattcaatgaatagtaaaaaagaggagttctaaggatatcaatccctgctgtcaccaaatgactctgtaactacaataaccactaagtgatgagaacctctaccctcgttgaatagaggagaacacatgggatcaaataattgaaccacagctgatggtcctgtagctgatgaatgtcagcaacttgacctcagttctttatgactcccacgtgtctgctgtttccattctatcaagctgcctgccggtacaacccaccaaactggcatatatcatagtatcataagacatgtctccccttcaggagctcatttcttccagtcctctttgcctccagccaaggtccatcacttcacaaaaacctggttaaaagctcacctgctccaggaatgtttcctggtttccacctttactcagtcaacccttcagcacctagaacttaaattgtgaaataagtttgtttgtttgttttgcatttattgagatgctgtgctgttattgacttcaacatgtttttgtttgatttgtatctccctaaaatatcatcagttcttcaaagaaaaaggctgcatttccttgtttctagtcccaacctttctgccaaggagctatactacttaatctatttgaacatatcacttaatgtatttgaacatgtggtcctcactgatttaaaaaaaaaagtgagggttggggagtgggtaattggaaagaaggtctctatggatattttttaccttaatagtgtgtatttagtgtctcctatgcatcccagtcctttgctggctctgggaattgtccatttgagccttgttgcccagcatcctcatgtgaggggaactgtggtcttatcaagaaggacttctcctacatccctgctgggcaacccaggccaattctactgagtatgaacttgagcaacacacactgatgtccatcttggtcttcctgtttttctcctttccccttttctttggtattcagccataactacaactccagatcaaggtggtagattcttctccacagcctgctcatctctacagacatcactccttcttcctaaaatgctcatatactccctgccctttggttaattcctgctcctctaagacttcattattcctcatctcctctcgaatgccttccttgaccaccagtcttccatcagtgctgctgctacaacttgttaaaatatttacccctctgcactgtaactgcatcatgcagaaagaacatagtgtagtggtcatgagcacagtctcttggtttcagactgctcaggctgataatcatcactgggccacttactagctatgtaccttggaaaagttagttctttctctgttcctcagttttctcctctgtgaaatgagggtaataatagtatttatattctggagttttttgaggcttaagtaagttaatgcataaaagcatataaaatagtgaacatattacctagttaataatatacagtgatataatctcatgttcctttttccctctaaaatctcaaaaaaggagatacaattttcttataacatcaaagttgtaatgtcttaagatctctgttttatgttcctctttcttaactattgcctctttcatcactcacctcccatctgagcatcctctctttccttcaattgcctggtgtaataatactcacctaccttagcctgatgcttgaagaatgctccaagaaatggactattctcatataaaaggaaaggattggatttgttgctgaaagattaaaaggcataatatatgccaaaatgctccaggtagaatctgtctcaggaacagcttgtgaattcattagaggaatgtttattaaacatctgttctgttcctagcattatgttactgggtgctggagattcagtccatgatttcctactgtttactgtctagtggggaatagagacaattacacatacagttgtgatacaatgtaaggagtagtgttggagggagaaaaaaacactatggtaacttgtggtgcatatatataattcactccaggaaaaggagaaggcttcccaaaggaaatggcacccagactgagtctcaaagcatgaatgaaaattgatcagccttagaagaggagaagagtatcccaggctaacaggaaatctcatgagagaagacatagaagcatgaatcactaatgtgttttgaagcaattgcaaggagttctgagagagtgaggggttagaggaaatcggcatgagccagattatatggtgcttttatgcttctgcttggattttactctgcaggattttactcttaaggagcttttcaagagttttagggagggaacaaactatatttgggttttatgctagtagttgtgtgaagggtaagttgcaggggactagagtagaaacagaaatcagtttgtaagtttgttacaataacccccataaaaatcctaagtactggaactaagggagataagcaaataaaaagcctggtgaagagattaggagagaaaatagataaaagttcacaccaattgtcatagggtgtaattgtactatatccttcaatgactcagtattagactcttcaatacttcactagactttctggatgcaatgactgtaatggtaggaattttgaatatgtcagaagcaacctgtgagttataaggattctgaaaacacctcagccacacttcagtgacactagcctttcccacagaggtgcaagcttgaactaaaaaacctaaagctaccaattttcttccttattttcttcagcatgttgttgttgttgttttgatacaaagcttgtttcagattgcctttacttttatctttatttttgtcttattttactaaatgatttaactttaatttattatcttaaagacgactgcccctatttctttgctgggtgactgcaaagcccccagctcctatcatgaccgtgtttcctactctgtcagtggtcaggttgttggagttggggggaaggggtgttcttactatgtatacaatagggctggaccttgaaggacagctgctttgtattctcattctgagtgtcagcctcttttacatgcaggaacaaatgattgagtgcttctggctctgagtgatgggaaatgtagattgaactcctagagactatttcagtatgcttttatatctcttttgttggcaattttatatcatagttatattaatatacaaatgatgaatttagagcggaaagaggttgtaaacacagtgtgttgagcatttctttaaagatcctatttctttcttgtccaaggtgagatacaaaatgtaatgtatgcagcttggcacgtcattaagacaggtatggcctttcagctctatatttcattttgaaggcagaagaggaatgagagaggaaagcacagccttctgtagagcacccccattatacagaacttagtgtactctatgaagaatgtcacacatgccctgggaggtgatcataatgcatgaaccaatttatcttggataaacctctccaagcccaagttacaaagcagtgagggtcgggacttgattgtcctgctatttgattatttattgcaagtatgtatgatggaccagtaggaggaaacagataggagtgtcttagacatactgcaagggtatggcccagaaattattgtttagtgaggttcaaatggacttctcctgggagaaaccatgccgtatgtggtaagactgatgtccaagcccataggaaaaacaggaagagaaaaccccttagtctcctggctgatccccagagatctcattctgagtttagaggtttaagtggtaggcctgaaacttgggacactgttgtatgtggactaaagttaactgcttttggagtggggcaggcttctgtcttgttccgcaaatgctcacaaatctaagctgtccctaaattcgcagagtgggactaaaggagctgtaagacaacatgtcatcatcagctgttatgtggaggttggatatgaagaacaggaattgtgaaatatgttggtttcaaccaagagtttatttgggcttccctggatattgtgttggtaaaaagagagattatgtccattaacatactaccacgaaattaagttgtattatagtagaaataagaaatcagaggaatccattgtcaattgatgttgtgccaactcccagaatagttatttgtattaactgatttatccacctttttggaataccaattatgtgccagatgctgcactggcaccatgattattgtgaagagcaaaggcagtacctaccttcaaagaatttacagtttaaggaatatgtgagtataactatttaatctaggagattctgagacaggtgttcgcttcaaaaggaaaagcttttgaaaaatcatgaaggcaactgtgtacctaccacatacagcattggtaatgtttagaaaatgagacaaaattcaatcttctgtttactttatcccaaacatagttttggattttaaacataagatggagtaaggatttcactacaaaaaggatacgggaaagtaaagagaaaaaccagtttattaaacttcaaaaatatcagcctaaatcaaagctcagggcagagatttgaggagagaatagagactcaaacagcttctctgtaccttcgcctacctcaaccaagagttaagcaaagtaagatgatatccgaaatatcagttattactgacagtgaaggtatagactctccacccgaaaaaaatatattttcacagaagaaaaccttccttaaaaaaggaagaaaagatacctataagtcaatttttaaaaataacaataattactgccaccacaataataataataaagaaatgtccaaatagggagaataagacaaagttatcagtagaatttacaccactgaaaaggcaataagactctacagcttttatttcagctgcctccacagggtagtagaccaggtaaacctgagggaggaggttgtcaggtgccatgcagttctacacggttccatgaggttcaccaacctctgctgaaaaggtaccacatgtctggcaactggccataggcagtaggtggtataaagatgaatgagtcactatctgtatcttgaagacatgagaaaaacaacactcagtttcatggagaagcagacaggtgctcagctacaacagtaaaggtcacactgtgataagtgctggaatcaagacagaaagcccaaaaatctaacagatttggagagaaaagagagagcagtctttcttaatgattagaaatacttcacagaagagggtggaaaacagtgttgagttccagaaagagaggaaaggcatcaaaggaattgcacagggtaggaaagtacaacggatattcagaaaacaccagaaagttctgtgtagttggttagggcaggaggcagagctgacttatgtactggacaacttatttaccaaatcaaagatttggaactgaaatccactagcaagtggcagttagtgaatcagagagggggatattgagcctaagaaaagagaaacactcataatacctgtagcgggttgaatgctggccccccaaaagatatgcctcatgtcctaattcccagaacctgtaaaagttagcttatttggaaaaagaaactttgcatatataatagttaagatcttgagatgaaaagatcatctaggattattcagctgggtccaaaatccagtaacaagtgccctcataaagaaagcagcaggagatttgagacagacacagaggggaaggtgttgggaagacgaaggcagagattgaagtaatgtgactacaagccaaggaacaccaaggaatgccaacagccaacagaagctggaagaggcaaggaatgaattctcttctagagccttcagaagggatgtgacccccactgtcaccttaattttaggcttctggtctccagaactggaagaaaatagttttgggtagttttaagtcatcaaagttatggtaatttattacaacagccctggaaaagcaacataacacctcaaaactaatcattataagtgagatagtaatgactaacatagatataatgcctttcgatttacaaatctttgtacagataattttattttattctcatgacaaaacaataggtagctattatggtttctttttccatttattgttgaggaaactgggcttcaaagaaataaaatcaccttcttaagttaattcaaacttctatctctatctccctgttttcactacgaacccatgcttctttggtaatgaatcagtcctcagagctaccacttttcccactcatacatggttgacagctttaaatggcatccaagagtcttttgcaggcccagactggggaataaaccagaggaggagggaaaaagagagagggaaccaaaagggatcacaattacggtattctaaataaggataaaaacagcccttttccaattatcctgggtttcagctacttactcttgtaatactgggtaagatttcaaactccttgaatctcagttttctcttctgtaaaatgagcataaaaattcttccctcggttggtttaaagattagatgagtgatgtggttttgctgtgttcccagccaaaactcatcttgaattgtaactcccacaattcccatgtgttgtggaaagaacccagtgggaggtgattgaattatgagggtggatctttccttcattgttcctgtgatagtgaatgagtctcatgagatctgatggttttaaaactggagtttccctgaacacatgctctctttgcctgcccgccatcaatgtaagatgtgacttgctcctccttgccttctgccatgattctgaggcctccccagccacatggaactgtgagaccaattaaatctctttattttgtaaatttcccagtctctatgtctttatcagcagtatgtctttatcagtagtgtgaaaacagactaatacagtaattggtaccagtagagttgctgaaaagatacctgaaaatgtggaagtgactttgcaactgggtaacaggtggagaggttggaacagtttggagggctctgaagaagacagaaaatgtggaatagtgtggaacttcctagagacttgttaaatggctttgagaaaaacactgatagtgatatgaacgataaagtccaggctgaggtggtctcagatggagatgaggaactttttgggaactggagcaaatgtgactcttgttatgttttagcaaagagactggctacatttttcccctgccctagagatttgtggaactttgaacttgaggaggatgatttagggtatctggtggaagaaatttctaagcagcaaagcattcaagatgtgacttgggtgctgttaaaggcattcagttttgtaagggaagcagagcataaaagttcagaaaagttgcagcctgacaatacagtagaaaagaaaatcccattttctgaggagaaattcaagttggctgcagaaatttgtataagtagtgaggagtgaatgttaatccccaacatgatggggaaaatgtctccaaagcatctcagaggtcttcacagcagcccctctcatcacaggcctggaggcctaggaggaaaacatggtttcctgggttgggcctaaggtccctgtgctgtgtgcaacctagggacttggtgccctgtgtctcagctgctccagttgtggcttaaaagggctaacatggagctcaggctgtggtttcagagggtacaagctccaagccttagcagcttccacatggtgttgagtctgggagtgcacagaggtcaagaattggggtttgtgaacctctgcctagatttcagaagatgtatggaaacacctggatgcccaggcagaagtttgctgcaggggtggggcattcatggacaaccttctgcagtgcagaagggaaacgtggggtcagagcacccacacagtgtccctactgggacactgcctagtggagctgtaagaagatgaccaccatcctccacaccccagaaaaataactccactgacagcctgcaccatgcacctggaaaagcctcagacactcaacaccagcccatgaaagcagctgggagggaggctgtaccctgcagatccacaggggcaaagctgcccaagtctatgggaacccaccccttgcatcacagagacctgaatgtgagacatggagtcaaaggatatcactttggagctttaagatttgactgccctgctggatttcggacttgtatggggcctgtaacctctttgtttggccaatttgtttcattgggagtggctgtatctacccaacgcctgtaccctcattgtatctaggaagcaactaacttgcttttgattttacagcctcataggatcattatctcattgtctcagatgagacattggactgtggacttttcagttaatgctgaaatgagttaagactttgggggactgttgggaaggcatgattggttttgaaatgtgagaacaagagatttgggaggggccaggagtggaatgacatgatttgactgtgtccccactcaaatctcatcttgaactgtaactctcacaattgccacatgtcatgggaagaacctggtgggaggtgattgaattatgggggtggctctttcctgtgctgttctcatgatagtggatgaatctcataggatctgatgggtttaaaaatagaagttccctgtacaagctctctctttgcctgccaccatcgatgtaagatgtcacttgctcctccttgccttccaccatgattctgaggcctccgcagccatgtggaactgtgagttccattaagcctctttcttttgtaaatttcccagtctcagttaggtgtttatcagcagcgtgaaagcagactaatacaatgagctatgtattttttcaaaactttgaaaactgtaaggacaatgcaaaatgtgaattataattatgagagtaaagggaaatggtgcagaagagtggtacagatgtaacagtatattagtatcacctggggaacttgaaaaagtcatggatgcctacattctaccacagaattattaaatcagaatctctaggagtaggcctcaagcatcattatttttaaaaagcatcccaaatcagtcatataactgcagccagtttttgagaactcctgcaggagtggaaaaaatgagctctggcatcaattgatctaggcataaattccatatagtaattttataatttgtatgttgtaaattgtgtgatcttgggcaaattactttaaaataggaataataatacttgactcataatgctgttgtaaggattgaattaaatatgtataaaagtgggatagtaagttcaagttagtttggttttccccattctgttcatatctagaagccattggaaagacaaaaggaaagaagggagagggagagagttagcatttgacatatacatgcatttccacaaattggctccaaattgcattttcttaatttgaggtaagttcatatacaaatgtagcttttgcattatgaatgcagatgttaacaaatgcaatcatcatataaagctatcttctcataaaattaataggttcccaggggttgcataattcagattaactgtaaaaccaagtgtttcctcattaatcagtgcctcagggaagtgccaagtgtttcctgtcttagcaagttgtattagattagagtcacaagacatcagttcactaaatgtgaggtgcctataatgaccaaatgtcactcaccaaatggtagaaaagttcaaatattggtaacaatatggtaacagcttttgctgttgtttctgttttagctatggaaaatcacctctacattgcaaggcatttcagggtccaaactagcattttcatcttcattccttagtctgaaatgggttgggttacaggatgaagggcatacactagcttatgcaatatcttcagaatattagagattaggggataatgagaattacaaggacagtggcatcagctggtagctgttagtgtcataggtaacagagaaaaagaatggacaagctctactatcaatcaggacatgatgcgaaagccagaagccttcaaagaaccatttgccattcaaaaagcagcttttggtatgctactggactagtggaaattgagcctgctcatggcacatcaagtaattgtgtgactgggttgctcatcatgagctctttactgtcagatcttccaagtcagtagtttgggcaggcacatcagtaacacatcatgaaatgaatggtacttttgcgatcaggcatgagcatgtccgggggagcaactaaattacacaaattggcagctaagtcccacatattacttaacttgttaaaccaatgtgtctccctcagttcacacctgagacctcacagagagttcccataaccagctgtcaggggattaaaaacccaggtctgtttcagagatgggtggctcaatatttcatgtgagctgaaagcggactgcttgggcaacacagctccacccagggtggccaggaaagagagtagtgaggggaaattctcactactgcgggcagagcttcaagaagtacatccatcaggccatcagcttgtgtagacagtgtgagtggagcaggttcactgttgattctctgaccatattgtctctcccttcagttcatgcaagacaggcttccaatagtcggcacttgcattcctttcatcctctgattaattatacccactttgtctgcttgtgcaataggccgaaagtgttggaaatgagtacctcccagggtgtggaatacatagaggcaaggtgtccccgaggagacaattattttataacaaagattgtagagaattcccagcgtatcatgacaataagcatctgaatgattttttggtcaatttttctgctcttttaaaatcatctacacaatcccattattgccagaacctgaggcagagatttcccagtgctctaatctggatgccactgctcttaggagcagctctcagccaatgactgacccaccaggacaggaggcggtgtactgatacctcagctccttctcccctggagcaggataactctgatgcttgcatctgtactggctcccagagtttcctcagtaggattgagctccaagtacactaagtgataactgactcaataatgcacccattattggctattttcccttcctgtttcactttcccattcccctgttggactttcctccaccatctaaataacctatttgtattcagatccttgtctcaagatctgcttcaatgtgaacccaattaagccaggggtctataagaatagtaaatgcacatgtcttttgccccaagatttccacttccaggaatttatcctgaagtcatactcacaaatgcccccaaaggcatgatctttgtaacaatagtagtaaaacatcattaagtccttactatatactaggcattaaagctctttttcatgtcatatctcccttaatactcagaaagccctatgcaattacaattacatatccatttttacataagagaaaagtgaggcatacagaggttgaccagcttaagagtataggagctagtagtgcagagctaggattcaaaacctggaaatctgctttcaaggcccatccactcactctctgtataagcatgcaaatgaggatgcttatttctgcattgtttattacagctggaaacaatccaaatgtcaataggaggatggttacataaattatgggatgtcatataataaaatatttagagctactataaataaagcttatgtactaatatagaaagaagtccaagatattaagtgaaaaatgcaaggtgcaaaacaccaaattacacaggcttccaatcttgcaaagcccagagagctatgtgtacgtgtttatttctgtgcgtgttaaccatcacaggtaatagttgttcccttaagagaagcctgtgctttaagcatgagagggagacatactttacactgaaagccattttttattgtgttaatgtaagtatatattactctttcaaaaagccatatgaaaaatattgtgtaatcaagctatatatgaatttacatggaaggagtaattcattcttcctggaagagtctcagaaggccccataaaaggacatactgtgtgagtaaatgcagaagatctctcccagcagcagtatttttgaagctcctcaagtgttagagttcacaagatgttgggtaactgtacagtttgttgtgtggagtgggcaggaaatgaggctaggaaggttgagataagataatttgtagatacagtgtctcccaactgaagtgaaatacccaggcctgtcaatagttacttgaaaaaatatttttctgcagagtctttataatatctttgaaggccacgtgtgccacatgggatattacaagaaaggaaaagaaaaatgtttcaagaaggcttcctataaagagtattagctttcttcactctcgctcacctcagagggttaagaatcagaaagaactgatttgaaatgcttacttaatcacttacccactatgggttcaatgtattcatctgtaaaacacataagaatacaaccttcataaaattaatgtaaggatcaattgagataattcatgcaaagcagttactataatacattgcttgggattagcaggcactcagtaatcattgcatgttactattgctaataagtgctgacaaatagcaactgcaacatgatcacaaccttaatgatatcataaggaactgaaaacagtgaacggaaagtacttctctaggaaaatgaaggtctacagttttactccaaaagaaaaccccacactcaaaatgatctcattggctttctctgaagcaaaaccccaagtgacacccagtttctgcctaaagccacaaggctgcctgacagtggtggaatctgtcaacctcaacatatgtgccataatctctggtccaccaattacacccaggttggtgaaccatggctgatggtgtttgtgactttattttttattttattttatttttctagaaatggagtctcactctgtcagtcatccagactggagtgcagtggcatgatgatggctcactgcagcctcaaatatctggtctcaagtgattctctcacctcagtctcccaagtgactgggattacaggtatgagccactgactgtagctttgaatgaataccttaaaaaattcagaatattaattttgcctagggaaacacaatgatctaaaaactgttcaacctaactttatgttaaaaaattatctcaaccatcctttctgctgaagacgcttgcaaagaggcaacatttacaaaacagaagaaacaaattaagcgagcattggttagaaaaaatgtcaatgagccacgttctggttgtaaaattctaattaaccggccggggccatggctcacgcctgtaatcccagcactttgggaggccgaggcaggcggatcacgaggtcaggaatttgagaccagcctgaccaacatggtgaaaccccatctctactaaaaaatacaaaaattatccaggcatggtggtgtgcctgtaatcccagctactcaggaggctgagggaggagaatcgcttgaacccgggaggcagaggttgcagtaagctgagattgcgccactgcactccagcctgggcgacagagcgagactccatttaaaaaaaaaaaaaaaattctaattaaccataacaaataccacacatacacatgaatgatgttatgggtgtcaaatttatcattctagattgagaaccaaaagtgcttaatctgaacaaagtatcacactggtagacccgcagagagacaagcaaacatactagattggagacccttttcttcatacctcactgtcagacttttttttgtactcagtcatactaatgcatgaaatgtctccccccacagttacagtgacatttttgttttccaatccaaaaactggagcacatgttttgataagatcaaatattcttacgggaacaacagaacacattttcttaaagaaatgttttctccccaagttttagaaatctggtagtacccaggtgacagttatagataggttttttgtctgttcatactgatcttgtccctctaaaaatggcaagtattaacctttaaattaaaagtactcagaaagtgtgagttctctgaagacagggaaaaaagtgggagaagacaaaaaatgtaggatggcagaaagtgacgacatttttttaagaggaggggaactaggaagataggaacttataaaatgaaggtttttagccaattctattaaaagcttagacaaggttagatttcatgagactgaaaaactcagaggaaatcgtgttacaacgtaactcgaaataaaaattttatttgtttgttttgaactccacaatgaacaaaatgccccagatgataaatgtttataatcatttttcactttcagcacattgccttcatcttttattaaaaatttcagggagaaaaagagatccacattttgttgcagacctgtaaaattttttgtactttcgtgatcccaaatattcaccattatgatcaaagaaaaaaatcactccccagaaaatagctgataatgacatcaaaaattactctcatgtttcattgagatctaagcattttgtgctgactcatagaaatattggtggacctgcatggccatggatcaaagaactcgaagttatggtaactcggtgttcttaagtagataacatcattacaaaatgttacaaaattatgtgaaattttcccatcttctcaaagtctacacagctttgaactctgattgcaggatctaggataccattcattttctcctcaatctaaagcctaactcttcccatcttacatatgaaaagcaaaatagagaatgtttctggtctatgatctttgaaaaaaactgtaacataatcaacagctcatttattgaactggttcaagtgaaatttcatatatgtttatatttgttatggctcagttcagtgggatgataacagaagtgatgtgttcaatgtccagtttatgttaaattaaagagtttgtttttcattgcttttctttctttcctactgactatcatatacacataacagaaggggttggaaccactattttaaatctcaaaatgaaaggtacatgtacagaatttcagagctgcaagattgaaaaaggccacgtcctcaacatcatggaaccaacatataagccctgtactacttacactcagtctgaaacatgcaaaaacccttctattttgtcatgtttttgtttttattttctagcctttatagatttatgttccagcatctttgttaaagagatgatctttcaccattgaattgctttggcacttttattgaaaatcagttgaccatataaatgtgagactatttcttaattcctattcagtttcattgatctatatgtctatctttatatcagtattacaatgctttttatttaactttagctttataataaattttggagtcaagtagtataagtccttcaatttggcctctttttcgaaaaattatcttggctactctagctttttgacattttcttatgaattttataatcagcttatagaaaatgcctgctgggattttgttttaaattgccttgaattatagataagttttgagaggatttccatcttagcaatatttaatttttcattttgtgaacacagtatatgtctccacttatttaggcctcctttaaatgtttctcagcaatgttttgtagctttcagtgtaccatttttttgtgaatcttttacgaaatttattcctattaatatttcatatttttgatgctattataaatggtattgtcctctaaatctaaatttttagtagttcattgctagtatacagaaatgaaattgacttgtaaattttaaccatgtattctacagccttgctacgttgactggttagttctagcaggtttttaaaaattcttgaggactttttacatagatgatgaagttgtctgtgaatagaaagttcgtttttaaatgcctgatctgtattccttttatttcttattcttgcctcattatcctgactggaatctccagtaaatgcagactgaaggagacagctttgcctcattctcagtcttgagaagaacacattcagctttttaccattgtgtatgatattaagccacagaatattattcaagccttttattaggaaaaagaagttccctttaattcccagtttgccgagagattttatcaggaataaatatagattttttttcgatgttttttcttcatgtattcaaaaattatgtggtttttcttcttgagtctgttaatatgatgaagtaccttgatttttgaatgttaaacaaccttatttttctgggataactccactcagtcatgatttgttatgctttatatatattattggatttggttaactaatttaacaaaaatgtttgtgtctatcttcatgaaagataatgttatgtagtttgcactcttgtaacgtcttttttgagttttggtatcagagtaatgccagctttatagaagccagctttatagaatgagttggaaagtattctatggtcttcaatattttgtttacttgactgccagtttggcctttcttatagcatatataagtatatatagtatacatatatagtacatataatatacataatatctgtattctaatattatgtgtgtgtgagggaaatggatgaatgtggctataaggaaacaagaacagtacatctgtttggggatgaatcatgtgaaggatgagttgtgtttgttgaatattcggagttaatggaagccattgtgcctctgttacctataaactgcagttgatatctagtcatgaaattgctaggatttgattgagataacatgtgtaaatcatttggcacattgctggaacagagttggatctcagtaaatggttgtcatattttcttataattatcaacctcattcctgctatcaatgacatcatcataactattttcataatttcaaccatttaataataaaaatataagcatttcaaaaacaaatttatagctgtttgtcattaaaaaattcacatctcagaccccttactcttctcataaaacttgtcacaggactcccaaggctgggattctacaaaagagcaatatgtgattatatctctgataggatttgatgggcctcctgatccaaattatctactcaactgaggtgcaatacctagagaatcaatcatcctctgcttcagctgagactgtttttaagtttgttaatatattgaataatagcttcccaatcattagttaactgggatgatttatatcaagtagatgggacttgaagaaaatgagagaggtggctctgaggagtaaagtaaggtaatgatcacagggggcacagaaaatggatgcaattgaataaatactggaatcaagattaggagacctgtgtttaaggcctagtttagacatttattagctgtgttcagtcattcagtcaaaaatttattaagtgccaagtatatgccgggaacctatgctaggtacaagtcacaagtggtaaacaggacacatacagttcctgggacttactgaccttgctttaacctctttgggacttctttttattctatcatctcataagcttggcatgaggagcatttacataaaagtacattgtaatctgctttattagaaaaaaatcaagaactgcatagattattgccattggtatgtgagcttcaaacttagatttttttaaattgtcattttctgttacaatcaatgtccccctcactaggctatgaattctgaggagagttgtcttatatatctctttcatggaatgtgttaaattatctatgcctattgaataaatgaatgaatgaacacattaatgcatggagagtttggaaaggaaagatactggctaagaatcacaaagaccttaaaaaagatcatgaaaatgaaaatgatgatgatgaaacaactgagaaagaagagacgaggttgcaaacagagcatactggttaaggtcactgaatttgaagtcagattgttgtctgtttagatagtttggagagcctgactgtcttctgccaattggataacaatcttaaagtcacaataaactttacttgactgttgaggaattcccaaatgtgttagcagtcattaagtgtctcaaatataattgtccatttggccaatttcaaccaaaatttaaagctatctcaaaaccattttctgaatagggtgtcctttccccactgcttgtttttcttgtcagagattagatgattgtagatgtgcagctttttttctgagttttctgtttcattggtctatgtgtctgtttctcagaattggccttggcaaaaaatttttggctaaatccccagaagcaattgcaacgaaaacaaaaactgacaagtgagacctaattaaactaaagtttctatgcagcaaaacaaactatcaactgagtaaacagacaactagaaaatgggagaaaatatttgcaaactgtacatctaactaaggtctaatattcagaatctataaggaacttaactcaacaagcaaaaaacagataacccaatttaaaaaaatgagtaaagaccatgaacagaacttctcaaaagaagacatacaagcaacgaacaaacatatgaaaaaatgcttaccaccactaatcatcagataaatgcaaatcaaaaccacaatgagatacaatctcacaccagtcagaatggctattaaaaagtcaaaaaacaacagttgctcctgagactgcagagaaaaggggaacaattatacactgtgagtgggaatgtaagttagttcaaccaccatggaaatcagttgggagatttctcaaagaactttaaacagctacaattcgacccagcaatcccattactgggtacatactcaaaggaaaataaatcattctaccaaaaagacatatgcactcatatgttcatccccatgctattcacaacagcaaagacatagaatcaacctaggtgcccatcagtggtggactggattaagaaaatgtgatacatatataccataagatacgacacagccataaaaaagaacaaaaatcatttcctttgcagcaactgtttgcagcttgaggtcacaatcctaagagaattaacacaggaacagaaaaccaaatactatatgttctcacttgtaagtggggcattgagtacacacggacataaatgtgggaacaatagatactgcagacaactgggcgtgggggaggaggagaatgtgggttggaaaactacctattgggcactatgcttactacctggttgcaatatacccatataaaaaatctgcatatataatctaaagtaaaagttgaaaattttttttaaaaagctaacttaatttgtttggatattaatatgacttttaaattcacaattgacacgtaattgtatatatttatgggatacaatatgatgtttcaacacatgtatacatgatataacggtcaaattgtggtaattaccttacccatcactataaacatttatcatttctttgtgacaacatttaaaatcttctctcttctagttatcttgaaatatacactacattgttatttgctagagtcactctactgtgtaatagaacaccaaaacttattcttcctgtctaattgtaactttgtacacattgaccaatctttcctggtccccctgcaacccccgctttccccctctctcctcagtctctggttactagtatttcagattctgctttcagagtcagcttttttagattccacatacaagagatcatgtgctgtttgtctttttgtgcctgtttaatttcacttaatataatgtccttcaggttcatctgtgttgcttcaaatgacaggatttcattctgttttatggctaaatagtattttattttgtgtgtgtgtgtgtgtgtgtgtgtgtgtgtgtgtgtgtatacaatcaattccatagaatggcatttatgctgattccatatcttggctattgtgaatagcactgcaataaacatgagtgtacatgtctctctgacatactgatttcactttctttggatatatacccagtaaagagattgctggattatatgatagatctatttttattttttttgaggaacccccaaattgttttccataatggctgtactaatttacatttccaccaaccacgtataagagttcttttttctctgccagcatttgttattttttgcctttttgataatagccattctaactggagtgtggtgacatctcattgtagtttaatttgcaatttcctgataattagtaaagttgaatatttttacatacatctgtcagccatttggattttcttccaataactatctacttcgttcttttgccaattttaaaaatggaattatttgagttcttttgctattgagttatttgagttccttatataatctggatattaatgccttgtcaggtgtatagtttgcaagtcaggtgtatagtttgcaaatgcttctcccatagtaactaaacagcttggtactggcataaaaccacacatagaccaatggaacagaatagagaatcccaaaataaatccatgcatttacagccaactgattttcaacaaaggtaccaacaacacaagacatactggggaaaggatagtctgttcaataaattgttccggaaaaactgaatatccacatgtggaacaatgaaactagacctctatctctccaccatatacaaaaatcaattctagatagattaaatacttaaatgtaaaatctgaagatatgaaactactagaagaaaacaggagaaatgcttcatgaaattgggcagggcaataatttttttgaataagatctaaaaaagcacaggcgagcaacaaaataaaaaatacacaaatgagattacatcaaaccaaaaagcttcttcacagtcaaggaaacaatcaataaagtggagactacctacaaagtcaatctaatttggaagctgttcacttttttcccaaacaagaatctaccttttctctagagcatcttaatcaaggcaatgatcattccggacttgagtcacagaaaatagggttcagaattctcacatccagacctggttatccttctaacttgctgtatgatcttgagcaagcctcttcacaatctgggccttactctcctcaccaaaacccagaaaacattagaataggtgatcctctagctcctgacagcaccaatgtgttgattctacagttgaattttgaacatgaacaaatagctttccaatttgtgatgtacttctattgaagttcttgaagcaaatgatgattgctaatatataggtagctctccctatatactagatacatggtatataaatacctaagaaaaatgaagcagagaattaggacaatttgctattacattaagcctgcaatatccatttcaatgaaatagttatagtttcttggacacgtattcagagatacaaatagaggttccagtttgtagtaagaagtagagccatgaatgacagagcctgggactcctgcctgggcttatttgaaatgacactacattctgttcaagtaggccatttgtaaagcatgggctctatatttcttttatccctctgcccctgccaggcccattgcaatttatttctctaaaaatgtaaaccaccacccaactttgtccagcaatttagtctgttgggatctaacccaatccaaatagaccctgagttttgaaatgatgaaaaagtaataattttgccagttctttcctttcttaaaaggaaatttctctctgtatatttagatggaggtgttttggattatgccacaaagagtctgttccctgatattttctagttctcagaacccatcatgaaatatctttcctttccagtgagctgagaggagctgagaaatctgggaacacagctggtcagaaaatacagaatagaaagcatatcttacaaagcatatttacctaaagaaaactccatttagattttaatcaccaatctaatacatctacttgtatgtatttaaatgtattgaatgttatttcaattcaggtagcaaacattgtgatgataacccacagtgactaaaattcagtctgttaagtgggcatttgtaatctctgcttctcccgaagaaaaatctctttttcactttgagttttactacaactgggggataaaagaggattaatataagatatggccattgcttactgaatctgtatttaatggaattactattctatactctgtgtagtagagaggaaaatcattagaagccagaatagtttcagggagagttccatttgtattgccctaggctttcataagaaaaataattacagagaattgaggtgagcacccagttattacagttgtaaagaaatcattaaacatcttaccaaaagtattgagttccgctagcctaaggtaagatatcttgccaattataaatgagctctgggttttactggggcaagcctggctcacagtcattttcttgtcttttgcaaatactctgttgattctgatatttcatggggctgagtttgaggcccaattaatgctgacagttgtctcaatttgtctgatatatgtagaaactgtcacaaacttttcagaagaatatgggtgacaaggtgaaatgaagaatatgagtgacaaggtgaaatgaatgttcaagaaacaaattaagtgtctctaaagaaacttgaggttggagattcattctctactccagactaagctcatctttcatgcccttccagacttgtggttactttcttgttaaaatggcaccctttcaataggctggagaaatgaagaactggagagatttctagcccttgtgtaactcagctgttcaggacttcacttcaaggtcctactgcgattgagcagggttccaatataattttgacaaggtttcacttttttagggttctgcttactaaaagaaatctcagaaaccaatttgaataaagttattaatgattaattaaggtttttactttgtttcctctctagattatgtttgcatgttgacacatggtatcagtgtctatagcccaaagtataggtaatatgggaactttagatatagctacaaagctggagattgagattatttgattaagaaagccatttcaacaacactagtcaagatgggcagacacttgtgaaagagcatagcatgtcctaagaacaaggtaaatgtttctgttttcccttctgaaacaggatcctgaatttgacatcagttgttcatattttattagtgactgtgaaatgtggttaaatgaagaagggcaagaagcactaaagaggaaatcaagaatcctgacaatttttgtatgttgttgtatgttgttgtctctatgcatattctatacaagactaactcttactcttacaaataaactaattacagacaagactgctcaagaagctggtaatgtttagatacatgcagtgctatcactgttaaaatccttcatgtcctttatacttgttcacacatatcatcatttacattataaataagcataataggtgctcaatatgattttcgaaaaatgagtaaaaaagagcaactttgctaagaatctattatgttgtacatactattctgagtaccagcaattaaaaaaattaggaaagtcttccccctcaaggagcttacaatctagtagcagaggtagatatgtactcagagaaacacaagtgtatatcacttaatgtaaaaggagaaaaccgacaagtggccgcccgaacttttcagtgtcactgcaaagggtgggtcttcctggcctccctgagtgcctcgctttccccatcttgcctcaggcaatgcttttctttctctctctctgcaaacctgtcgaatgaatggtaaaaatcactgtttatcttctctgtaaagttttaattaatggaaaaaaggatttgtgaggctagtcataggctgtagcaaatctgctgtgctttgtgggtctttctgtattgttctgtcataataaggcatacctcagaacagaacatgggcttaggacacccctaaacctgcttttcaagatggcccagcaaactggtcagttataaactttgctgcaggtccctaaaaaaaaataaataaataaaaataaaaataactggatgaagtttccctcttgtctcttgtatgtccttgggagcttgaccttgtaaccaggtggcagtactttctcttggtctctgccatcacaatggcagcccggattcaaggtttaattcctggcttggaaaattggtcctttatcttctgtctatgtatttatatgtattatttgtgtgatatttatatatgaaagagctttgattgattggcttaaaaataagttctaaatcaaatattttgtcagaaaagtaaaatgtgtaatgccttttagttcatgtgacttaagtaatctttgggaaataaagacagttttaaaataaggacaattttgttggtaaaattaaaatgttttcaaaaatgtaaacattaggtctaaattatacaggtcagatattaagtttgctaaatgctttaaggtcataaactgcttctttggcttttaaaaactgttcattttaatcttccttggagatatcagattctagataatgcctggggacatgtgaaataagcatagcttctagctatgcaaagaaggttataaagaaagagattttatataagaaacgatcttctatggtaaattcttgtcctaaagcaaaatgactggttgtttaacaagaggaaggtttatgacaagtcagaaagtccaagcatgttgtagatggtctgtgtgagtcatgaaaaaatttatgaaaacgaatttatgcaagaaacattgtacaatttaaaggtgatgggcctcctaaatgcttcataaaatgccactatggctcttactatacaatttccttgctttacagctaggtaaggcctgggacatgtggagttagccatgcccactagctgtgctggaaaaagccagcccttatctgcacttctgtctgggtcctaggctccacactagtacataattaaaaaatcccttacttaccaaggctttcaccaaaaaaaaaagttgctaagagttaacaccataacatgtatctgagactactaaaaaaaaaccagttctatacacaagggatgtaaagaaagtaaaatgtgttttttgtaaaaaaattataagaagtcttgggaatatgaatttttctgcctagattaaagggttaaaagattgttttaagttagaataaagctgaagtgttatgcaagttgtggaaggtttgtgaaaaattaattgtaaaagaaattctgtgtgtgaacacactggctaaagttaaaggggtattattccattttttctgtaaattgagcattagaataaaagcataacaagattttcttagagcaaaaacctgcttatgatctgacctgtaagaaaaattgtaaaggcttataaaaggtttattaaaatcttacctatggtcaaactgattaagattgaatatatttgtctataaggttttattgaatatatttgtctattgggtgtaacatcaataatgcactaacacaacagtgacatttggcttacttggtataaaaatcatacaagaagcattgccaaatacaaaatggtgcttggtttttttttttggctctatttgtataaatgtgttattggtatatgttccaaaattatgggaaactcctctaattctgatatggcttaatgtatgttattaatagttataattgttatgtgaaattgctatatgccacagaagtgaccaaatttccatatcaattgtggccttaatagtggctgtcctaagactttttatcatccacagacaatttttgtcctgttttaatcctctttggaagatgattttatagtcaactgtacaattctaacaggtgttcttaaatggaggtttctgataactttggagattattacgttagaatagagaaaaatctttgagaacactcttggaaagctgaaatgttcatgaatattaaacagaagttaactgcatggactaaactaatagaagtctaaagtaatcttttaaatttttcttaaaacattactgatcctttgttttgtttttcagagttaggaaaacttttcctttaagctatttgtagcttgtagcaatagagtaaagtatactcctatgaacaaaatttggagcatatttgtttctctctaccagttttatccagaatttggaaactatctgtgaatattcttaatttatggcaacatagttatttgcatgactgcaataagaatctgttttcttttgcaacgggacacaattggagaaactggttattttaccaaggcttttacctgaatggcatgcttttctttaagaaatcaaatttgacttgtagagccaataaaagtcccttggggaactggcctcacaccttgactacaccatccctgtatgagcttcctgacctgtggtaagtaaagaacatcacaggcccaggagccccaagttatcttgggacctcaaaaagagaggaatttacccaacttgtaggtatctgagtgtggatacacatggtagggcttggcttaaaaaaaaagtcttatttatctaagattttttctatggaacagagttccattgaagccattttttaaaaagcttatggcaaatatttattcttgctatactttatacaaataatcaggccaaatataataaagcaaatcaatcttaccatgatttgtctttagtaaaaatgggagactggaaagagaaattatgttccaagaactatggtatacttgttattaaattttagtctcatcagttgtttttaaatgtgtttctgtaatttaggctaaccctgcttattcttgtgagccaaccagtgatctctgactgctggtcagaacaaccaagagggatgggtaatgtaaaaatctgtatgagtattctaattgtgggcacattagaatcagctaacagtcccatattagcttagttccaacagttgccccattcatggaaagccttctaattttgtttacttgagaaaattctacttcttttgctttattcttgtggaatatattgctattgtactctttttgtaggaattcaggagaaacttactaaacattctcttaaattaaactgctctaaattaaatggctgctctgtctatggagtagccattctttttttcctttactttcctaataaacttgctttcactttaatccatgaactcaccctgaattatttcttgcgtgagatccaagaaccctctcttggggtctgaatcctgtcctctttcctgtaacaatatggctagccaaagatgaactgagacaaatctggtataattcctagttcagttatctgtctgttttaacctaaccttattgtgatggttaatattgagtgttaacatgattggattgaaggatgcaaagtattgtttctgtcacccagtctggagtgcagtggcatgatttccactcactgcaacctccacctcttagattcaagcgattctccttcctcagcctcccgagtaactgggattacatgtgactgccaccatgcttggctaatttttgtatttttagtagagatggagtttcgccattctggccagtctggtcttgaactcctgacctcagttgatccacctgcctcagcctaccaaggtgctggaattaaaggcatgagccaccatgctcagctacgcactcactcttaatataactttaatacattttaaaataagctatgtatatgtgtcactactaatatcttatactttgaacatttgtctatcctgtaatacaataaatgcactgctggatatattcttgaaaatcatacaagtgtaacaagatgatatacaatattatccattgtagcattgtacataatagctaaacttataaagaagctaatgtccatcaaaaagagagtagacaaatcatttttgatgtagtcacttaatggaataaaatttaattctgcaaaaaaattaatgaaccacagcttcatgcaaaaataagagtaaatcttcaaatgttcaagaacaaactaaacaacataatatttataaataaatacatatgttgtaaatacatgaaaaataaggaaagtataacaaatgaaatttatcttaagtggggttttgttagtggaagcaagaggaagagagaggtaaaagtgaaggtagatgaaacagttctggcaatgttctaggatgtaagtcggtagtggcttcataggcattcatttcattattgaactttataaaatatatgttacattctttagtgaatattaaatattgcactaaaaaagagtgaatgtaagtagaaatctcaatattgcatttttgaaccacaatgtatcccctggggctacacagagactaccaaattaggcaaaggatgtcactgatacttttctagtagtgaaataaaatgctcatatttctgttttaaaaagaaaatattgttatcaacattgtagaggagagacaatccatgtgagagatgttgagcttctgacccaacatagtggttgtagggacaaattatatgaggtggagtatttaagaactatttaagagtagttttttccaattctgtgaagcaagtcattggtagcttgatggggatgccattgaatctataaattaccttgggcagtatggccattttcacgatattgattcttgctacccatgagcatggaatgttctttcatttgtttgtatcctcttttatttcattgagcagtggtttatagttctccttgaagaggtccttcacgtcccttgtaagttggattcctaagtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgaggcaatggggttttctagatatacaatgatgtcgtctgcaaacagggacaatttgacttcctcttttcctaattgaatacgctttatttccttctcctgactaattgtcctggccagaacttccaacactatgttgaataggagtggtgagagagggcatccctgtcttgtgccagttttcaaagggaatgcttccagcttttgcccattcagtatgatattggctgtgggtttgtcatagatagctcttattattttgagatgcatcccattaatacctaatttattgagagtttttaacatgaagcgttgttgaattttgtcaaaggccttttctgcatctattgagataaccatgtggtttttgtctttggttctgtttatatgctggattacatttattgatttgtgtatattgaaccatccttgcatctcagggatgaagcccacttgatcgtggtggataagctttttgatgtgcttctggattcagtttgccagtattttattggggatttttgcatcaatgttcatcaaggatattggtctaaaattctcttttttggttttgtctctgcccagctttggtatcaggatgatgctggcctcataaaatgagttaaggaggattccctctttttctattgattggaatagttttagaaggaatggtaccagttcttccttgtacctctggtagaattcggctgtgaatccatctggtcctggactctttttggttggaacctacagatagaacctacaggagttgatgatatgtaagagaagtgacaattgtttaagatgacttttaattttctagcttgaacaaccaatgccattatccaagatagagaagacagtaaaaaagaaagcatagctatggaataccgtgatagagaggatagcattatatattggagagtttgaagcaactacataacataaaaatgagcttgttcagccacatttagaaatatttcctggatctcaggagaatggcaggctctggaaatatagatctaaatatcatcaacacatcagtaactaaggccacagaagtagatgacatcattcaaaaaagagcatatcaagtaaaaaaggagaagagagctatgctggattcccagaggtcatttaccataaaggagactctggagaaactctcagggggatagaagagaacaggaaaatatgaaacagccaagtggccaatgatgttatctgtctccagatacatcaagtaaaatagaaattgtaactgacacacagaggggctatgcaaaacccaaacctctaaaccaagtgccttagcttcttgtatttaccctatacactgatctaatgatttttaagttgtgccttggagtgtgctagagctaattctaatggttagatggatatcatttttcattccacaaatactgagcaacgtttatctactaggtactatgtaaataaagtactgtttaaagattatggctttaaaaataaattatgaaacatttctgttaacaatgaagaaatccattcatcatatatatatatttatatatatatatttatagacatatatatttttatagacatatatatttatagacatatatttatatatatgtctacataaatgtgtgtaagagatatcagtagggctgaaaactactgccttgtatagaaattccaaattataaatcatgttaatgaggttaaaatacctttgattacaaaaaaaaaaagtgggttagggggaagaaatgaagaggaagctgggcaaagtggctcatgcttacaatcccaactctttgggagccaagggggaaagatcacttcagcccaggagtttgagaccagcatgggcaatatagtgagacccccatctatacaaaaaataaaaaattagccaggcatggtggcatgtgcttatagtcacagctactcaggggactaaggttggaggatcacttgagcctgagagattgaggctgcattgagccatgacagtgccactacactttagcctgggtgacagaatgaaaccccgtctgaaaacaaaacaaaacaaaaaacgaaggatatgcgcaagagactttctattcttgggaaaaggaattggaaaccggagaaacttaaatatttttcttcaaatgctctgtattgtttgacttgctacaattagcattcattactgataattataatttaaaaacaagtacacaatagaaaatttcagaaattcacattgcttcattagcctgtttttccaccctaggaatttacagatacacacacacacacacacacacacacactatatatatacacacatacatatatataaacacatatattcacaacccaggaactagggaacccaaatctaacacttgacttaaacaaaatttctgcttgttattttgaactaagtcctccagatcagagatttttcagaactccgtttctcaggacagctgcaaactagagttttgtaaattgaccttgtgtgtattattatcttctgtcatagaaaacatatgacttctgtggcatttttaaatgactaatccaaagttatgaaataaaatagctctaaagacgaataaatacagctgtgttttgattccgcacttttcctatgacattaaccttcaaaagggttttccccatttaccttcaaactgtaaaaactgtggagttcttgtctatcattcagcagtaacatcttggttactgggctaatcttaaaatcttgtggctagcttttgcagttgatttcataatttaaatacattcatgtaaaacatcagatgtgtagatggagagaatagaaaaataaagtacttaaaaattaaatgggtaatgactgaaacacttagtaaaatattgactaaataattaactttgttactggtcaacctggttaatcaaatactttgtaatacacagcactctgtgtacaaaataacattgcttttaccctaaaacaggtctctctgagcagtgtttatattcatgaactggaaaacaggtgaaaagataatcccctaccaaattcccagaagttcccaaggaatagctcttatctctgttaccctttaagttactgacgaacgatggagaaataaacaatagttttaacttgcaaatttatctccaatgttttatttattcccaaagcctccagtggagaaaaagtatttgtagggaaacctctgcagtgagagagataaatgagttaaacggaaatgaaatatggacaaatattctgtttcaagaaaaaaggaaattaactattctgagtaactcaaggtagaagaaaccattctgaactatattactcaaaaaatataagatctcttatcagcttagaaatgcttcctcttatattgctctgttttatgtctcttgattttcagacctaaattacatttatatcaaaagatgaagctaacaggcaaattacattcatatcaaaaggtgaagcttacttagttccaaactaagtaaagtgttatttcatgttcccaaagtatttcaaacaataacaatagattttggcttcatggctcctaaaattgaggtcatatatttgcaacacagctgtgtgggactgggaacaagaggtgactgaagttggggcatgggtaaagcagactccgtcctactgacccagactccccagtggcagggctgtcaccctgtggctaaccacaaccacctcaaaaattccctgctgttttgtacaaagcctcttattatcttgtccttacctgagttttagtttcttctccctcatatctaaatcataattgacattataattcccactcccaggtctcactctccatctccttacactgtactcatacactcacattctttccagtttcctgagaaaatttgttttcctcttgtattagtccacttatgtgctgctgataaagacatacctgagtctgggaagaaaaagaggtttaattggacttacagtttcacatggctaggggggcctcagaatcacaatgggaggcaaaaggcacttcttacatggcagtggcaagagaaaatgaggaaggtacaaaagcagaaaccactgataaacccatcagatctcatgatacttattcactaccatgagaacagcatgagggaaaccgccccatggttcaaattttctcacctggtccctcccacagaacacgggaattatgggagtacaattaaagatgagatttgggtggggacagagccaaaccatatcattcctcccctggcccctccaaatctcatgttctcacatttcaaaaccaatcatgccttcccaacagttcccctaagtcttaacccatttcagcattaacccaaaagtccacagtccaaagtctcatctaagacaaggcaagcaccttcagcctacaagcctgtaaaatcaaaggcaagctagttacttcctagatacaatggggatataggtattgggtaaatacagccattccaaatgggagaaattagcaaaaacaaaggggtttcagggcccatgcaagtctgaaatcagcagggcagtcaaattttaaagctccaaaatgatctcctttgactctatgtctcgcatccaggtcaccctgatgcaagaggtgggttcccatggtcttgggcagctctgcccctgtggctttgcagggtacagccccccttctggctgctgtcacaggctggcattgaatgtctgcagcttttccaggtgcacagtccaagctgtcagtggctttaccattctggggtctggaggacgtctgccctcttctcacaactccactcggcagtgccccagtagggactctgtgtgggggctcagactccacatttcacttctgcactgccctaacaaaggctctccatgagggtcctgcccctgcagcaaactttctcctgggcatccaggcatttctatgtatcctctgaaatctaggtggaggttctcaaacctcaattcctgacttctgtgcacctgcaggctcagcaccacgtggaagctgccaaggtttggggcttgcaccaactgaaaccatgggccaagctgtatgttggccccttttagcaatggctggaacagcttggatgcagagcaccaagttcctgggctgcccacagcatgggaaccctgaccctggtccacaaaactgttttttcctcctaggcttcctggtctgtgatgggaggggctgccacaaagacctatgacatgccctgggtacattttccccattgtcttggggattaacattcagctccttgctacttatacaaatttctgcagccagcttgagtttctcctcaaaaactgggtttttcttttctactgcattgtcaggctacaacttttctgaacttttatgctctgtttcccttttaaaacagaatgctttaaacagcacccaagtcatgtcttgaatgctttgctgcttagaaatttcttccaccagatacctttaatcatctctctcaagttcaaagttccacaaatctctagggcaggggaaaaatcccaccagtttctttgctaaaacataacaaggatcacctttactgcggttcccaacaagttcctcatctccatctgagaccacatcagccaggaccttatcattcatatcactatcagcatttttgtcaaagccattcatcaagtctctaggtggttccaaactttcccacattttcctgtcttctgagccccccaaactgttccaacctttgcctgttacccagttccaaagtcgcttccacatttttgggtatcttttcagcaataccacactctactggtaccaatttactgtattagtccattttcatgctgctgataaagacatatctgagactgggaagaaaaagaggcttaattggatttacagtgctacatggctgaggaggcctcagaatcatgacaggaggtgaaatgtgcttcttacatggtggcggcaagagaaaatgaggaagatgagaaagcaaaaacccctgataaaaccatcagatcttatgagacttattcactgccaggagagcagtatgggggaaattgcacccatgatttatattatctcccacctggtccctcccacaacacgtgggaattatgggagtacaagtcaagatgagatttgggtggggacacagagccaaactatatcacctccctctttcaactatgcccccaattctcagggaagcttgctgaattctacccttcctcaagacttagttcaaatgtctcctctggaaagactttctaaatttcccttctgtacacatatacacatagagatacaaaaacatacacacgaacacacacatacacacaactgtagactgaaggcagagtcaggggttctctcagtaactatactaaattatatcagtatcatatgttatattttaatattatatctattgtgttataattatttaattatatacctgtctcttctataactagaccatgagctcctaaaggacaaagctgtgtcttctctgtatcttacttatttgtgtaaagtaatacctggtatttagtaatggcttaataattgcttgattgaagagtgaatgatgttactattctttaagacttatagcagtttcccttgcctctctgaagtcttgcagattcatctaagacaggaataaactctgtcctctctgagttctcataacactttatttcttgcttgtgactgactgctatcactgagtttcctagatttaattccatttcctccaccctatcataaaaagatcataaaaaagatcataccttcttttattatcttttccctcaaagtcactgtgctttgtaaaaagtaagttctccttaatatttgccgatatcatttaatatatttcccaaatattttccccaaataaacatcattaaacaatgcaaagtttttatgcagcacagagatgatctcagattcatttttatttgcctaggctcagcgcataggaggtaccaaataaacagttgctgggaacatgaagggagaaagtgactacttcagaagcagaagacccttttctttgttcatctgttggcaacaatttgtcctctggcaaacactgggagtgaaagcggttataatcacctagttttaatagctagagtcactctatactttttcttccaatgcctagctatccttagaaataatgactttggaaggggtaatggaagttttttttaactcagaaattggagaaacattaactttttaatttactaccctgtcccccaaatggtgacagtactgccaggcattggaaataggtgaggcagactctttcatggaaattaattgaaaagttgaagtatgctctaagtgctgaagtaagtatgcacatggaagaataggatggctcctgtccctgagaataaaatcttcaaatatctcatttttctcacaattataataacagctccatttactggcaatgtatatatgccagccttgtgctaatctcttcacaatatattcttatttaattatcttgacaatattgtaaaccaaaaattagaaaactaaactcgtaattacctggaaaagggaacaaattagagcacacactaaactacccacaaagcaaaataatctcaaccaacaactccaaccaagactttgacaagtcacccaacaacattaggctaccgcatattgttccttttttttcttcacagtcatgtgtctctgagtatacacaggagtaatatgcatcatcacgaagatgcctcagcgtaaataaaacacatgtctcaaagtgactggctccctttcaggaattcagctacttctgctaaggaaatttagtttggcaacactagcttattttaatcttctatatcctctgactctgtagtttctcattaactctgtgcttgggaaactcagtttctcactgcatagtttccatatcagtgaaagtggcctgtccatcactaacatagatttaaaaatactaaactataaatatgctcatggatcaactgtggggaaaattaggatgtctccattgatacataaatacaggccacacacacaacattactttccagagatttgcctacctcaatgtgaagatataagtgagtgtgatagttacataagatgatttatcatttcaattatgaaaagcatgctttctaaaacactgtccagatcaccttccctgacagaagcagccataacaacagaaacaataaaatttccacaaaaaacagttggccaagtttattacaagacataatgtcagccgtcgaaatgattgcttcctcaaattgaccttgtttaacctagcagttctaaactttcccttttggcccttcaaggtaaatgttgatcaccagctctaaacagatccatcttgtacaaagcattgttgaagttacatgtggtttatattctggagatagaaaaagagaaataagtccatagtgagcccaccaagatgcctcgatcctaaagtcaagtgcaagaaagtatctacaggatttgaggcaaagaatcaaatctgtgtttgggaagaagcacattaaattcagaaataattcataagaggtcataggagctattttcagaaagttctcattgtcaatgacatcagcaatgcttttttcctacacatttataatatacaagaatctaaatattctttaacctcctctaattatcatctagtcagtattatttagactaagcagaggtatttcttccttccttctgcctactctttcttctcagtttttatttatatacataaatagcaataaatatatcaatatactatctggcatgttttagccatgaatagaagctgaggttgtgccttattgggagagtctacctaaattgctctgattttcaatattctgcatgacaactcagtatgtaagttcacattcctttttgcaatattttggtttgcttttattgtttatttttgcttttacttaacaaatattttacaaataattgggatactttgaaaatacttctattgagacattgtgttggtactaaggatacaaatataaatatatatatatatatatatatgttctgctttctgccttttaagcattcagaatgtgcatgcaaagatattctcagtggtcttgacaagtacagagatccatgggatcaaagatattgggatgggtggagatttccaagaaatttgaaggagtcttggtaaaagagaggacagtagaactaggtcttagattttaccaagatgaaacgaatgggaagtaagctgggaaaagggaatagcaggaaattacaaaaatgcatggtcttttcacagggagttaaaaagttcagcatggttaggactaacgctgtgagagcaccaagtttttggagaatgcaccaatacgtaacaagtttctagaagtatgaaaaacatctagtatgagaaaaggacatcacaaaaattcatgtgaaataatacaaagtggatctcagaactctagataatatgagctctaaactgtgttttcaaagtgtggtccttggatcagcatcattaacatctgttgggaacttgcttgagtgcaaacccttgggctctgggctaggatgagaccaagcactgtgtgctttgccaagccctctaggtgattttagtgcacactacagccatagctgcagaggtagaaagtgcactttccaggtatgagtaatagcacacacaaaagtgtagaggctggtgtgagagtagtagtggcatgcagagagcaggcacagcaatgttttattcattaattatttcagttattaattcatcatttaatgaaacaattttactaacaagtatagaatggggattttaatcctgtagtacaattccaaaaagtgtaaagtctggatactttacatagtgaagaaaaaaaatgactgtaaagggaagatcagactgaggatctgacagacattttaaattgcaatggcctacaaaatggaagaggctttgtatgttcttcaattggacagcaacataaataaaataggattttaggaagtttgtggtaagactatgtaacacaagagaacaaaggtggcttagacaaattttaggtgttcttcactgtaaattcatacttctctgtagtggaatctgtattatttggaaggtatcaggaaagacctcactccccaagtatatctactttatccttagcataatgcttaaaatttcattattgcagagtcattcttttgagtttttttcatcagtttcctaggaaagtaaatactgtatcaattaaaatccagtaaagaaggaaattgacaactggctgaaagcaatatttcagtaggaggggaagagaatgaagggacaagagcagaaaaacacagcatctaaaaggggaagaagttcctgcccaaaatatatttttcccaacttgtacacttgaatagggctcctttggcccaaaacaaggttggcgccatttaaagacacgaggaaattaggatcagatctagaaatttgtctcagagtaagatagaggggaatgttatgattataagcatagtgaattttgggtgagggagggataacaggtggaaattacttatggcagttgaaaatttgggatgaaaattgctgtaagctgatgtggtttttattttgtgttgccaaacatgtttataatccagtgtttttgtaaagcatttaacattcccaataaaccatttaatggacatcatttatttggcgggcactaggtgtggggttaaattgaatatgatgtccagccagctgttggatgtgcaggtgggaggtctgaacaggacagagacttgggaatcatcagcatatggacataaatttaagccacataatccataaagtacactatgcaaagtggaccaagatgaatccctgagaaaatcaaaaggaatagttaggtgaagaagatcctgagaatttggaatttggatgtacttgaaactgccttttaggtatcattagtcccaaggaaacttgtgagttagtcatttgaagtggtcactctcacatagaaaatctatttacatagtgctgtgactctctatatcccttttaaaaacatactgtttctttatcatcttacaaccatttatttaatggttaattaaatataaaacatgaaaatagaatacccttttaaagaaataaaagttaatcattgtttattatgtttatgcatcatctgaagcaattgtctcattttgcttttaagcatatttcacttttattaaaaaaaaatagaaaggtggttttatagtttgattcccaccaaatgggtaagagttagttcttatttagagtattggcctttattttgagatgaaatatgacattttggagtcaaactcaaattgtataactgaaagactttacagtccaaattaaaagatgtctattttgaaatactgtttacactctcctctttaaagaacagagtgtgtgttttggtggggggtgggaggtgtcaatgtcaattttagcaaaagtcttattttaaaagcttcatgctatagaaataaaaatagaaaatcagaacttagaagagcatcagaagctaatacatcaaattcagtgcccaagggtcaataccaaaacatcatacttgagcctgagtaccagactagacagggaaagtcaaatcaccatggagttgttcagtacaatgaactcaaatataatttgtaagttacctttactaaaattacaatgatttataaaatgtactataatggttctcactgaaaaagaatttaaatattttggaaaatactcaatgataatgctgtgtcttaaaaaaaaacattttccattttcatttcctgaattcattaatattatctaagaaatttcaaatattttcaaacatctggtctattagtctgttttcaggctgccgataaagacatacctgagactgggaagaaaaggtggtctaattggactacggtggcacatggctggggaggcttcagaatcatggcaggaggtgaaaggcacttcttacatggtggcggcaagagaaaaatgaggaagaaacaaaagtggaaacccctgataaacccatcagatctcatgagatttattcactgtcaccagaatagctcaggaaagaccagcccccatgattcaattatctcacattaggctccttccacaacaggtgggaattctgggagatacaagtctagatttgggtagggacatggccaaaccatatggaaaattccacgccggcccctccaaatctcatgtcctcacgtttcaaaaccagtcatgccttcccaactgtcccccaaagtcttaactcatttcagcattaacccaaaagtccacaattgaaagtctcatctgagacaagacaaatcccttccccctgtgagcctgtaaaaccaaaggcaactagttacttcctagatacaataggggtacaagtattagataaatacagccattccaaatgggagacattggccaaaacaaaggagtttcgggaaccgtgcaagtccaaaatccagtggggcagtcacatttaaaagctccaaaatgatctcctttgtctccatgtcccacatccaggtcaggctgacgcaagaggtaagttcccatggtcttgggcagctccacttctgtggctttacagggtacagcctccctcccagctgctttcatgagctagtgttgagtgtctgcagcttttccaggaccatggtgcaagctgtcagtggatctacagttctggggtctggaggaaggtggccctcttcttacagctccactaggcagtgccccagtagggcccctgtgtgggggctctgaccccacatttcccttctgcacttccctagtagaggttctccatcagggctccgcccctgcagcaaacttttgcctgggcatccgggatttctgtacatcctctgaaatctaggtggaggttcccaaacctcaattcttgccttctgtgcacccacaggctcaacaccacatggaagctgccaaggcttagggcttccaccctctgaagccacagactgagctgtacattggccccttttatccatagctggagtggctgggacacaggacaccaagtccctaggctgcacacaacacagggactgtgggcccagctgatgaaatcagtttcctcctgggcctctgggcctgtgataggaggggctgccatgaagatctctcacatagcctggagacattttctccattgtctcggggattaacattcggctccttgctacttatgcaaatttctctagctggcttgaatttctatccagaagatggatttttcttttctatcacatagtcaggctgcaaattttccaaacttttaagctctgcttctcttatataactgaatggcttttaacagtatccaagtcacctcttgaatgctttgatgcttagaaatttcttctgccagataccctaagtcaactttctcaagttcaaagtttcacaaatccctagggcaggggcaaaatgccaccagtttctttgctaaaacataacaagagtcacctttactccatttcccaacaacttcctcacctccacctgagaccacctcagcctcgaccttattttccatattgctatcagcatttggggcaaagccatccaacaagtctctaggaagttccaaactttcccacatttttctgacttcttctgagtcctccaaactgttccaatctccgcctattacctagttccaaagttgcttccacattttcaagtatcttttcataaatgccccactctactggtaccactttactgtattagtctgtttttatgctgctgataaagacatacccgagactgggaagaaaaagaggtttaatttgacttacagttccacatggctggggaggccttggaatcatggcaggaggtggaagacacttcttacatggtggcaggaagagaaaaatgaggaagaagcaaaagcagaagccactgataaacccatcagatcttgtgagacttttttaccatcatgagaatagcatgggaaaaacttgccccatgattcaattacctccccctgggcccctcccacaacacgtgggaattctgggagatacaattcaagttgatatttgagtggggacacagacaaaccatatcacctgggtattccttagttgtttgtcattttcttaacagtcatgttataggatcttgcatttgggtcttagattcatgtttctaactcatggtcacatgatcatctttaatttagtagtaactatcttgagcctatcctacaaaatgagcaggttaacaaaaatgtaaagataaatgattcagcatttccagaagggagcgagttatttgccagcaagatagttggaagaataaaattggttgcttcttgttttttcaatatacttgatagatacttgcaacagcatagggttattaattaaatgtctacttcaatgacagtgcatatctaatgcaatactcatatataaagagttgtcaagtctaaaaactcctctaacttgtaatgattttctgttttatgaatatctttctatagaatttgaaactctgaattttaaggggaaatttttgtgttttttaccattgaatacttataaaatggctaaaccactgctttcataatttggtagtatctaaactcttctgttttgcctaagaccttttttgtttgggcataaaatgaaaattggaaatcaccattcttatgtcattatataaatctatgattactatagttgacctcatctccatgtgattccaattacattttgtcactattataataaccatgaaatgtattttttcagcccctgaaaatatgtcttatgtgtatgacttactggcacctctgctttgatattccacagatatctcaaacctcagtatgtttttaactgagcctttcccaagccctctcctcctcatttaatgttaccaaaatctcatcattcatccaagccaggaattaagagttactagaattttcctcttcttcccctctcaaaagaaatcagtcaggagtcatgatgagtctatttctaaaatatcactggaatctgttttgtcttctccactcctactagcactgccttaattcagaatcacttgccagaattactgaaatagcttcctcaatattatatctgtgcttctgacattgcctcacaaattctttctttataatgctactagcattacattttaaaattaaaatttaatcacgaccgtcctccttaaaaatcctcaaatttataagaacccaaactccttactatgacttacaagactgtgatgacgacagctcctatgtacaaaatgcctgtcttttcataataatagaattacagctgggaaggggttatccagccaacccccttatgttacaatccccataacccagcaaccaggagaggtcatgtgaatagttctcagcaatggcaggacagcaggagtgaagtgtgccacttactggttcagaccttaaagtgaaagtcttgagcacagccacccaggcatgatcacacagatgagagccttgagatgaatggagtctgatccaggaatcactttgtggaagagagttgctggtggacctgtagcaccaaccctgaactattccttgaaggagaaataaacttgtgttgtgtttgtgctattatatcttgaggcattttttaaccataatttagcccatctcagtacaaaaccttttataattcaatccttaattacctttccaacttcatgttttaccaattttcaattcctcatttgcatcctaagctccagcattaccagactatttaaaattccatagataagcaatgctcactcttgcatttatacctttgttcctgctgttctatccacagggttataccctcttctttaagactgggtcaagcaacactactctcgaaaatttctcttgttttgggtggattgtgcacagcgccctcaccccaccatttgtgtgttgaaggcctaactctcagtgtcatagaatgtgactgtacttgcagacagggcctttaaataagtaattaggttaaattaggtcttcagggtgggccttaatccaatttgactggtatccttataagaaaaggaaagttgaacatgcagagagagacaagggatgtgcaggcacaggacacaaagagaaggtgttcacctgcaagccaaaaagaaaagccacaaacaaaactaaacctgccaacatgttgattttagacttttcacctccaagactgtgggaatatacatttcgattaagtcacccagtctgtgggtattttgttacggcagccctagtaaactaatataccccttgaagcaggatattttcttctctgaaatgtcatagcatcctgagcataccccatttatcaaatatctttgctatttttcaatcagtgatttacttgtctgtctcctcaactagtctgtcagtctttcagggaaagtgactctgtctacaaatctgctgccttaactcctgacaatatgtttggaaattcataagaaatggataaatgttcattagaatggattaatttcttctccacaacttgcaacttaccagcaagcaaataatcaagtagtttgagtttttatttgttgtctactttctttacatatatggccagggtgacaatcatgtagcctgattttgatacacgatttcatcattggagattgacttgccatttttcatattgttttgtggacatttttaaaggtatagtttctatacctttgcagatttactaaagtccagaagataaagatgaattttatagcaggaacaagatcttctgtcagtaaagttggttgtgatgttgcagtggactgctgttgctattttgtcaacattacaatagccttctttttccaagaattaccctcaaaccaagcagttggtttaacccagtctctatgtcatacttggttggacaagagtggtcactagatacaagtttaactaataatatttttttccacaaattttgaattgagagtgagggaaactagttttgatctcttctgagtggctgaaactgagaattgttgggtaatcatgcgcattgagatggagagatatttgaatgaagacaaagacatatcctaaatacagatgtgaaaagggagagagagggagagagagagagagagagagagagagagagcagtaataccagttaattttcattttctcatttcggttccttatgaggcctatggcactccttgctcttgggttccatgacatttttatatcaaatttcatttggtttaatctggaatgaatttctgtcatttgcaataaaaaagagtacttacttaaatcaattagatagtatagttgacatatgtaatttttaaattagtatagttgacatatgtaatttttaatcactcaagtcattcttccttgatgctagtaataattattcaatcatcttttttggagccactttcctctattctagtctataaagctcattagggtcaagcctagtacaaggtaattagctcaagaagggacatagagatatatgacctaaactaggtcaataactctatcagcaatatttgctagaacttctgagaaattgtgagaagtcaaagcaatttttttaccactgaaatttctcaaatagtaaagacaacagcttgaagctcctggttgccctgttaccaccatgaaaagagtacctttgagaatgaaaccagtatagaagaagtcagggcaaaagacagaaaaacccagattcttcacacatcatttgagcaccaaggtccatgcatttctgaggtcctagacttttcagttatttcatcaataaatgtcattttttaaatctgaattttggtgttgtttgaaacaaaaaagtccagataaacatggatagcatatctttatatgtctttgagctggtgaagttttattatgtatacctaacaccaaattgaatgcctaaccctgtatctgaaataagtggatgctcaagaactttctgctgagactgaatgaagatgaaaaatgctacctattgtgccatttgtggatatgtctttttatagccttacctcttcatcagaagtactaaatctgtgctctataatcagtggattttcatcagagaaattaggtaaaaagggttttgggtccttgtcaccagagccaatcagaatatttgcctcccaaaggccaaatcataagtagattttccctcttcattgtagtatctccattctaaagagaacttctcatccgtaccagtgcagtagcctcctgagaggtctccaagtctccagattgtttctactgtaatctgttggggagcttaaataacttgattaaagtcctatagttagctagtggctgaggaactattcgaacccacaggggcttgattgacttcaaaatctttgcttaatttccctactgttatacatattgcatcacttcatgatataattcttatattttctgggttgaaaaacaaactaaacatggcctcttcaaacttggagagactagtaacagtgagacaaaagctgatccaagaaaatgcaacaaaacacacccgtgttgttcttacagctttgcagttttgtgaaaaggaacacaggagattttgctctcatttagaactgtcattcatggcttttgcttgaaaatacctgctttcaaattcacactgtgtctctgtctaccaagcgtatgtctatgcatatgaagtccagagaaagtaactctgctagactgaactgggatgcattccaaggactcggagtcatgggataacagatcttatacaacctaataggacttgatttggcacaggtaaagttttttttatgaaaatttactttctcatatattggtgagactgaacagatctagctatatattgcttaaatttgcttcatgtcaagttaagaagaaaacactcataaaacagccattccttcttaacagagaaaagctgtttttatcttttgaaatactagtttaaggaagtgcatcaataaaacctttaactttttaaaaaatctcattttatgatgtaaattgaaagcatatttcttattttggagaaggcattactgatgtgcataaactcaatagggttcttcatactctaacctaaaatttttgcctagggctcatttttgtgatttcctcagaaaccagagaatgcaaaatagtattgaagtaagatggaggtggatttggtattgcaaagttaaatattttaagtgcacagctaacattggaaagggccttatgcaaaggagattctgaaattacttttagtaatttcatgacttccatcgaaacggtagccaatataggatgagagagaaaataagaggactcttgggattgtgttgatatctgctttccctagtcccctcagaggtgaagtccctgaggtccctcacttgcagagtcagatatctctggatttaagtcccagccccaccacatatcacttttatgaatttacccaagttacttagttttctcctttatttatcatacacttgcctagcaatttcctgagccaggccccatttgaagcctttatactcttggaaagctgaaaacttgagcactatctcactcccagtttacaaatgaagtgggtcacagacagagttaagcaaatttccccaaatagatgataacagaattggtaagaaccagaagacagacccaggaaacttggttctacagtgcgtgctctttaccactacttaacctgccatgttaaactatggcaagtaataaaacaatcttgcttcttcctgctgtggtgaggtttcattgagataatctgcataaaacatcttacacaatttaacaggcaggcatatagtaagccagtctgcagagtctggaattagttagtccgttgctgtaaagctggtgtatctggtaggtcctgggtgttcatggacccaccacaccaaaatgatctccaatagtccactcaactggcacagtttgcctaccggaacttctgctataggttttctatttgacacttctatttccaattggactgtggcccagaactaaccttcagttcatttggctggggtcctgaccatttgcattccaggaatcagatatgcatgctcacaggtcttatgttcccggttctgctatactttattttcactggttgatttgcccctgcttgtccttgagcagacttatataattccaggtgcagtaactccataagtaggttttcagtgacctgggatagcacggtacattagaaaaggaataaactcaagagttccaggactaggtttgtatctcagcctcagcactgtgttcttggggaagtcaatgatctgctctatgccttagttttcctcatcagtaaaaatagggataaaaattcttactctcagggtcattgttaaaattaaacatggtaacttctgtggatatatctaacaccatgcttaagctaaagtaggtgatacagtttggctgtgtccccacccaaatttcaacttgaattgtatctcccagaattcccacatgttgtgggagggacccagtgggaggtaaatgaatcatgggggccggtctttcccatgctagtctcatgatagtgaataagcctcacaagataagatgggtttatcaggggtttctgcttttgcttcctcctcatcttctcttgctaccaccatgtaagaagtgcctttcagctcccaccataattctgacatctcctcagccatgtggaactgtaagtccaattaaacctctttttcttctcagtcttgattgggtatgtctttttcagcagtgtaaaaatggactaatacagtaggtgtgcaacaactttttctttctttctttttctgaaagtaaaggagaactccatatgtctggaaaaataattcgaattaaccttcacatcggacaatgcacaaacccaggctttcccactactgtagatttgggttgctgagtttcaggttacattgctgagacattaatgctgttggggtctgaatttcttgaatcattgttgagtactggtgactaaaataaacaatgtgatatggtttagaaactttgttacgttctatacacttgtttatctacgtgtacatgttctaaaaatgtttacatatatgtgctatggtttgttctgttttgataggatgaatgggtgtttgtggctgggaattctaagaagcaaaatgtaaaaaaataaattatttgtagtaatcaaaacataattaagtgctagagagcacagtcatggatttcatcatggcttttagcatagtgagtgtgatgaaatggtagaggtttcctgtaatgccttagaaaaagcctgtatcacacttcactgcatagggacagtaactgctatcatataaaaccaatgctctgcaaaactagacatgagcctttgagatttatacgttgccactgatatgctttggctgtatccccacccaaatctctgcttgaattatacatggtagggacccagtgggaggtaattgaatcatgggggtggttacctccatgctggtcttgtgatagtgagtgaggtctcatgagatctgatggttttataacggacttttccccaccctgctttgctctacaattctccttcctgctgccatgtgaataaggatgtgtttgcttccccttccaccattaactgtaagtttcctgaggtttccccagctctgtggaactgtgagtcaattaaacctctttcctttataatttacccagtctcaagaagacctttacagcaggctgtgaactaactaatacagtcgctaatttgaaaatggctgcataccaatttgcagtcataatggaaggggagaggcataatctaatcactgagacttgagtctcacgtgcataataactccatatgccattagtttagcaagtgtgtttgatttcatgtacttcgttacttgtacaagattttttttaattatacagaaacagataagcatgtttcactgaagcagattttgcaataactgaaaagaaaaatgacaagagtcatttcatctgaattgtgaaatgctgccttacaggaaggaccacagcctatctgcagaagcctatctgcattgcttctgccaaccctactctctctgtggatgagtctcttccacaaatgttccctttagacagatgtcataaagaaaaagaaaggacgaattagagcacgcttctcaaaagttctggctagtattaaaattttttctttgagttaaatattggactggattcaaatagagtttgcattttattcacagagctcctccattctctcctccattgtctcttcaggcgtggggtaaaggagtgttgggaaaagtttatgcggcggaagggagttacatacacaaacacacatctacggataaatatacgaaagatttgtttcttataaaacaataggaacaatctaagtttctgaggttaatggctcctcccttaagaagtttagtatttcataattttctgtgtacaaaatgcagtttcacattgcctgtgccctaaattgctttctgatgttgaatgatagaaatcatcaagcgacattaaattaattccacatctctaagttgtccaaagggattaagctcctcctcttaaagtgtcccatagcaccagagaatacttgagacactgaacaggaaaggaagaatattccagacagaaggagtagcaagtttagccttggagtcaaggaatgtaaaatagttcaaaagagtacagttcaagggaaagagaaataatgaagttagacaaatggtaaaggtcatgatggattttgtaagccttgtgaaagagtttggaaagcaatgaaatgcatcattaactacaaagaaaaaaacatcaaggacatttttactgagacttaacttgccaaatgattttatggacacttgagacattctagttttctagatactgacgctggcacaggtaggtgaaggtctagatattctagggtagcactgttcaatacaactttctatcctgtccaatatgattaccagtagttacatgtggctaccaagaacttgaaatgtagctagcataatggtaatttaatgtaaggcagtggatagtggaggaaaatagagagaggcttgctggggattagacactgggaatatgggcagaactccaaaaccacctctgcaaatccagatcaacattaagaatatggcaaagttcagttaatgtgggacataacaaatctaaaagagtaaatgtgtcaaagtccagaggcaaattcccagcacgtactggcaggagttaaggagtgaaggaagacacgaagaagggtcaggaaaattttaacttgatttgttagagttatttcagaaggtacagagtgtgagctccatggattaactttcagtggtcttaaatgagaaacagattgaagtaaacaacctattgcatatggagggattaaccaaccaagaggaaaacaaagttaaggacatcctgagtgccttacttcttgcacatctagaacaatcagctgtctaatagttaatattttctacctcaaactcaaagccatttataaataaatttttgccagaactatgaaagattcctttaaaataaacagactctaaaataattcaggcaactgattacaaagaatggaggcattccagtaggactaattccttcacctcactgggtcacaagttcctcataagtaaatgacagggtgggtttgctcacctttcacgggaaaaaggagcaagcgtattggcaatccactactttcaaacaaaatcagactaaaaacatataagaaagtcaaatatgcaagagataatgtattttagagtggggattctgttctacagagagctaaaactgatttaaatttcataaatatgcctctccttttagatataatacccaataaattccagcatttcatgctattcttcttcttcttctttttattttattttttttagatgaagtcttgctctgtcgcccaggacgatcttggctcactgcaacctccaccttccaggttcaagcgattctctcacctcagcctcctgagtagctgggactacaggagcctaccaccacgcctggctaattttcattttttttgttgttgtttttattttgtagagatggggtttcaccatgttgaccaggctggcctaaaacccctgatctcaagtaatctgcctgcctcggcctccaaagtgctggaattacaggcgtaagccactgtgccaggcccatttcatgctattctttaaatttgcttcctttgtaaatgaagacactattaatcagtttaattttaatgtgtccaatagaaactaaatgctaactatcgattgcatgcttaattacttttacctttgtcttaactctactgttccttacctaactttttataactactttctgcatttttgcatcttcattttccacccatttttgaataataaaagaaaataacaataaagcattaaaattatttttaacaccattgttcaagaaaacttagagatactgtataacctatagaaagaaatcataagaaacaaacacttgtttgctgattacaaacctctaaatttggtgtaggaaaggtcatgtaagagtttcagtgcataattcacaaaaacacagatgtattaaaagagcaatgtatcaaagtcaggagcaatttcttctgttccctgtatttcaatatctttgccttttactttggatttgtaggatatttgcatatgatggggaaacatgctagtataccttcagcagggaaatatacggagtagaagaaggagattgattgggcagcactggtaaagaaaaggaaaagaataacaatattaactgagcactacccaggtacctaaagatgcacttaattaactcacatattcctcacagcaattccttcactctttacactaatatttccttagcacctccaatgtgccaggcactgtgcttggtagattcaaggacagacaagacaaagcctgtctctgcccttgggaaactcatattctaatatagaaaacaaaaaggtagacagacaaacagaaacaaattactaaataggacaggcaccatgaaggaaacaaatgagctgagatagtaaataatagagaaacctactgtagataggaatatcaagaaaaaatgcttcgagaaagtacttaagctgttaaccaaaggaagaaacagagctgtagcatgcaggaggtagggaaaaaagtgggatagcatgtgcaaagaacctggggcaggaaagatccttatgtctgctgagtaatgagtgggctggtgggggcaagtggagaagtattaggagcaggtgtggtggtctagctgagaaattagttttgcctgaattaggagttttagagatggagagaaatgaatagtagaagatatattttgaaggtagagtcaacagtacttgccacatttacttattaatattctcacataacagatgagaaatggcctgaaagattcagaattaaagttcttgtagtaagtaacttcgtgatggggttatgaaccctgccttccttaaagccccttctactacatcacacttcctagttttgttaattcaaggttaatgtaggttttatagagtcctaaaagtggaagttttttgccagtctaatgatgttgaattagaatgtgttttaataacctgaacaaataacagattttccattcacaaacccataaccttatgtcactgaagagggcatcaaattctacaaacaccctttacatatttcttctggaccaaatgttaaaatactcttgcatttcttccagagatgcactgcattaccagcatgcatatgaaaaaatttctgttgactaaagcagcagtcttggcaattctgaaccatgtgctattcttactataagtctaaattgggtagttcgagtgaccaaccagtttgttcagctttgctaaaaatatgcccatgtttgcccaaatgacctggcttgctggtaatctcccacctttccgagtcaatcaacacatggaaagtgctcaaaataagcagggattagagtcacaaactcagctggaggagcttgcttttttaaaacacagcactcctgtagttattttcttcatgttattctgtctttactgttgagattctggtgtacacattaatgctgctcacgagtacctccatttcttctctgttcagcacacgataggtttgtacttgcccacaatgtgcagttgccctctgtatctgagagttctgcaaactgcagattaactaaccacagatcaaaatattgagaaaagaaaataataaaaaataacaatatgaaaataaaaataatacaaataaaaaggtgatacagtataatcactatttatacaacatttacattgtattaggcattataaataatccagagattatttaaaatgttcaggaggatgtgcataggttatatgcaaatactactctaatttatataagggatttgagcatcctgggattttggtagggggaaggtggtcatgtaactaatccccagtggataccgaggaacaaccatacttctttaggttggcatcacatacttggtctggcagtatttaagagctgccatacagttcttcccttctgtgtgcagtggagtctagtgatgcttgaagcctccaatagcctgagtctctgatgaggacaatgtgctgccaagtccccacagctgatccccaacagacatgttatatgggggcaaagaccttttgtcatttttaaatgctaagacttggggatttgttgttgttgttgctgctgctactatatatcctaatctttgtgactgggataggttccttcacattcttgataggaaggaaaacacgaactttcaatttaaggaaatatgacaaacagtacagttggcagaaagtgaagaggtttggattcaaatgcaactagttttaatactatctttgcaacttacttgctctctgagtcttctttttctcatctgaaaaagagtaataacagtataagcttgctataatttaatatgcaaagttcctagaaggatgctaaaccacagatgatgttcaatgaaaatagctatttctgtgaggggtaatggtaaatagactaaaagtatagcaaaagataaacaacatgggcatggctgaatctgaagagactacagaaatggggaacactgtcattcatcccctcggttctgcctaccaagcatctcctagtcataggcatgcttttctgtctcttctgtgttcaactcatgctttccctgtcccgtccccactcctctgtcacacgctgctcccaggaaagtatatagaaatcactcactaagatagctgcattttaacaggaattaagttaaagggctaaagctccaacttagtattttaggccttaggtggaaaagggcagtggatatctctcacctgaacccaggctggccaagaggatccatctagcttaattatgtccactttttgggtccactaacctaggaaggtctattggaccagtctttataaaagacttttatgaggcttcattttgtgaagctgtccagatctgctggaaagactaccattatagtttggcaggatcttctgtggggtcaggagtggggactggcagtactagtgctgtatgtcgacattactcttaaaaatgttcagacagtcttaacatagtctcctcatattaatcctcacagcaatcctgcaaatgggcattaagatctttgtcatagatgatggaactgaagcttaaagcttttaaatcatttacccaaattcacgtatatgataggtggaagagtctatattccaaaaccagtacctctgatttcaagtttaatatccttttttcccctttcactattacagttttctctgtgtgagaaagtaaattcaatagggtctcttgatggcattttgctatcatgtaatacaaatatttcttttttgttgttacatagttgggaatttgaaattctgttttctacattcaacactaaaaggaagaaaaaacacatgaccgttaaaaaaaagaaactacaaatatactactgaaaatgaaattaaagtaaggtattctatattgtcatgttttctggctaaaataatacccacagtttcagagaattttaatctctacctatatgaaaaaagagagaagcgaatagggaaggaagctaagattttagtctcatcatttctttaagaaactataattattttcttatggctaacataatttctaacatcaatctatttgcagtcagttgtaaacattgaaaatgttttgaaacttacagtggaaatacagaatttgtagccagacaaacttgagtttgaattctaataacaccacataaatctataggccttgaggaagtaagttaattaagccataaattagagatgagcctcaagcttcttatctctgaaatgaaagtttataataataatctcatagaaaggtggtggctatcacatgacatagtagatataaagcacttatagattataaacttttttaaagtttacttcccttttctctttgcatcagatagattctcatcattctagaaataacctgattcttattcccaagtagtgcacaatcaagtggattttattcacttagtaagtattcaaagagagaaagcgagaaacagagaagaaagatggaggaaaggaagaagggaaggaagataaggaggaagggagagaggggaaaagtcctactaagaaaaacaatactaaaatcagatggagacatgttccttctctgcatgatctaatattgttctgttagtagagattggaagtacttggagttatccatcctgcccttgtcctctttccccagtagaaatacaggaaataaaaaaagttttataacacttctgataatatcactagaaattggtcattagttctcaaagcagaacttcttgcttgatatatatttggccctatttgattttatcattcattcaagggtggaattgttacagaaatatattctagggtcactaatcccatcactatgcacaattatacatttattttttggacaactgtccagattccaaatgtaaacctgaaagacctaaagaaatttttcaacacccagtctaggattgatcttaactggactttggctgtctatggcatctcaagtagctatttccaacttcactgtagaggacagccattacaggtttgggcagctatctccaccatgagaaagagttaattttttgtataattttgaagtctgagtgaagttgaagtgtgaattcattacaggatatcgtgaatgttgttaagtggatcatacgaatgcagttccctctatatttcctataatgatttgtatatactctaagtaattacaggcatttatatttataattagccttttgggggaaccattttaagaaaatgatttgtccagctgtgtaccagattagtatcagccaggtgtttgtcaaataccaccgtaactgggaaaacacagcaagaagtgttgatacaaaaagaactttggaaatatgcttaaagtttcattttttttttttccaaaaatagttgcatcacttcttagaacacaagtacatgtctttcaaacatgacttttttctttaaaaagtggggcatgagtacacaaatacagtgatgaaatgaaaaaatataatcaatggaattttactggcacaacgtaaaggtcaggataagactaacaatacaagcattagaaacaacactgagcaatgttctgaatgatcatgaactgcctttagaggcttctaaagcaccaagatgaattggtgccaacaactggactatggagtcaagataccagcagaggcagttgacccaaactcaagatgaaacttttataaataaatataggctgtgtggtggctcacagctgtaatcctgacactttgggaagcggaagtgggcagatcacttgaggccaggggttcgagaacagcctggccaacatggtgaaaccccatctcgacaaaaattagccaggtgaggtggcccatgcctgtaatcccagctacttgggaggttgaggcaggagaatcgcttgagccagggagtcggaggttcctgtgaggcgagattttgtcactgcactccagcctaggtgacagaacaagactctgtcttaataatagtaacaatagaagtaaagctgtttgttatattcttgtgaagatttgtctgtgtacaggacagaatcgtaaattaaaatccccaaataagaaagtctgagtcaagaaggcaacagtgagacaactattaacctctgttttcggtaataacatcatacatctattcgaatgtccccttgtccaaagaattatgtaaaccttaatcatcttttaaatgggcatcatctgatttcctttcaaacttcaacccctaaatgagtatattgttctgatttggaaactaccagggagaaatctgactattcaaagcagtgaagtcaacctgagttgataacgtaactgcaggcattcctacaacatttcatcctctccaatataaatagagcaatttgaccttcatttaacttgatcatttaaaatccattatgaacaacataaatatctttcccaccatgtgctttaaaaactttgtactatttatttttttgcagggaaaacttccagataatacagggtcagaaatctgaccacttttgaattttcttcctttttaaaatttatttttaaatttataattgacacaataatattacatatttctggggtacaatgtgatgttttgaggcacatgtacatagtgtaatgatcaaattggagtagttatcatatccatcattttagacatttctttgtggtgacaaccttcaaaatcttctcttctagctatcttgaatatgtagtacaatgttatttttctatagtcactgtattgtgtaatacaacaccaaaacttattcttcctgtataatttaacgttgcagcaattgaccaaccttttgttgtccccccttccagcctttggtagccactattttactctctatttctatgaaatcaatgtttttagatttcacatgagtgagattatgcagtttgtctttctgtgtctagcttatttcacataatataatgtcctccaggttcatctacgttgcttcaactgacatgatttcattctgtgttatggttaaatggtattctattgtgtgtctgcatgtgtgtgtgtttgtgtgtataacaatttttaatccattcatctgtagatggtcatctaggttcattccatatcttgactactgtgaatagcactataataaacatgggtgtgcagatgtatcatcaacataccgatttcattttctttgatatatgcccagtaatgagcttgctagatcaaatggtagtctatttctagtttttaaaggaaactttatactgttttccataatggctgtattaccttatatttccaccaatcgtgtgtaagagttccctttcctttgccagcatgtttgtctttttgaaaaaagctgttttaactgcagtgaggtgataccattgtggttttgatgagcattcctcaggtgattagtgaagttttgcatttttaatctatctgttggttatttgtatgtactcttgtgaaaaaatgtctattcaggtcttttgccattttttatctgattttttgggttttggccattgagttgttgagttttttatataatcagggtattaacttattatcagatgcatagtttgcaaatatttctctcattctgtagattttcttttcacttcattgatcatttcctttgctgtacagaagctttttagttttatgtaatctcatttgtctattttagcttttgttgccagggcttttgaagttttattcaaaaaaccttttcccagttcaatttcatgaagcatttcctctatcttttgctgtagtagtttcatagtttggatcttatgtttgagtctttaatccagttagagttgatttttgtatactgtgagagatgggggtctagtttcatgcttctgcatgtggctatccatttttttcagcaccatttattgaagagattgtcctttctccaatgtgtgttcttggcatcttcgtcaaaaatcagttggctgtaaatgcatgaatttatttcttggttctctattccattgatctatgtgtctatttttatgccagtattattctgtgttggttactagagctttgtagtatatttcgaagtcagatagtgtgatgcatctagctttgtcttttttgctcagaattgctgtggctatctgggtcttccgtggttccacataaattttaaaattgttttttctatttctgtgaggaatgtcactagtattttgataagaattgcattgaatctgtagattgcattgaatctgtagattggggtaatatggaaattttaatgattgttttctccaatccatgaacataggatatctttcaatttatttgtgtcctcttcaattttttttttttttttgagatggagtctcactctgttgcccaggctgctggagtgcagtggcaagatctcagctcactgcaacctccacctccctgctcaaatgattctatgattctcctgcctcagctttccgagtagctaggattacaggcaactgccaccatgcttgactaatttttgtacttttagtagatatggggtttcaccatattggcgaggctggttttgaactcctgacctcgaatgatccgtctgccacagcttcccaaactgctgagattacaggcatgagccactgtgcccggcccctcttcaatttttttcatctatgttttatagatttcttaattgtagccagggctgacgtgtcattgagatttttattcaattttttaaacactttaagtcccacagacaacatcatgtcaggtctttatgattttggagtttagatttggtttcctccctctatgaaccctccttgttataaattgattttgtcaccccctttcaaattcatatattgaagtcctaattcctggtacctaatgcgaccttatttgaaaataaggtcattgtagatagaattagttaagatgaggtaggatgggcccctaaatcaatataactggtgttctttaaaaagtgggaacacacacattcagggagaacactatgtgaacctaaaggcatagattggtatgcatctacaaaccaagaaactccaaagcttgctggcagaagctataagaaaggggtggagcaggtttttccctcacagctcatggaagaaaccaacagtgccaacaacttgatcctggacttccagcctccagaactgtgaggtaataaatttctgttgcttaaaccactcagcatgtggtatttcatgatgtcaaccctaagaaactaacactaatacactttcttcacagttgtgccagaaaattgtctcattagctgattagtgactcccttattatttctgcttttgtacattgagtgggaatatttgcatatcattgatgccagaatctatccttcaaaatgatggccattttaaaaatggataatatctttaagcattgccttgcccttccaaaaggtgaaaaaaaagtgaggcttggtaaggaggacaagatctgctaaaacttgccattaaaaaatattatagcagatctctggatacgttccagtattaaaacacatttgacagaaatatgagaaatgagagaccatactaccaatgtcattctatcaatgtctttaagatgagagcaaagaagcaagaggatcaaggaggaaaataataaagaatccttgctatcaagcagaaaggggattggccttgatcagtgggaaagttaaaaagggccacaaaattaaactgctccttaaaaaatagaaaaggagataatgaagtcaagggaaaagcaacattagtatctggatttaattcatgaccttcttagtcctaggagaatttgggccaggagaatttcctaatcagcagctgcactccccacttctagttctctgggccacatttgacaaatgtagatctgaaactttaatatggatgagaatcaccagaggtcttctaaaacagattgctgtctctcttcccactgcaccccatagttgccatttcataggtctggagtggggtcccaataacttgcatttttaatgagttcccaggtaatgctgatgctgctgatctgggggcaatactttaagaaccactggactgtaacaatgtcaaacctgcctgatgagaagaatcacctggaaggtttaaaaaaatgcaaaatcctcggccccatgccagactttctgactcaacctccagggaagagcctaaaattttctatttcaacaatcctgcctgattaatatgattaggtgagtttggaaaatgctacaccaaatctctataaattcccttttttagcatctgttgtttttccacttggtttcagtgaattttgcaatatggcagtagctatgtgatgagctaagagtagcacaagtactaggttctgtaccttgaatttcctgatcccattggctgaccacagtaccctgctttttctttttatgaacatgtgccttgggagagagtcttccttaatcccaactggccctggtatcatgatgtcatccagaggccactctgaaaccaactcagatgatgtagccttcactggtaattctctgcttatctttcactctttcttatcatacaacatgcatattttgctctgaatattaatggtggctctagcctcaggctgtttcctcttaactttgaaagtatttacgtgtgagttatgctctacaagttttatttcaaaagcactttctctttatttggcaggaatattcttgctggcacttgcagaggaaatcccattggttcagcagatggctaatgataattgaagttaactctttagagaacaattagagatttccaaaaggattgtagtaaaattgcttagggccctatcatgcccatctgctgcttttgagaacatataattcctatctcttagatccaaattccagccacaaactcaaagttgaggcaccctgtaaatggctttctttggaccttctttgccttttggggatttgtaatgattctaaatatagtgacctgatatagtttagctctaatttttgcagcagcactgcaagtagatgttactctattttacaaataagaaaactgaggctaaacaagatcagatatagagtcttgaagattatacaactgcctagtatcagtcaggattcaaacccacagctatccaacttacaagcctaagctgctcctctaagacgactctattctacttttgaagaaatgtggggtcaggtttgagagcaacattttaatttgttatttttcctggagtttccaagattgtgtttaaattctaccaagtgagaaaaggttacaacaatcatccttagttttgtttgctatctcaacaggactctgcgtgctttgattctaaatgtaaaattagctctgtctgttacaggaaagccatcaactgggcagtgtattagtctgttccctcactgccaacaaagacatacctgagactgggcaatctataaaaaaaaaagacgttcaattgactcacagttccatatgtctggggaagcctcacacttcatggtggaaggtgaatgaggagcaaagtcatgtcttacatggcggcaggccaagagagtgtgtgcaagggaactcgtctttataaaaccatcagatcccatgagacttattcaccatgatgagaacagaacaggaaagacctgaccccatgattcaattacctcccctcaggtccctcccacaacatgtgggaattctgggagctacacttcaagatgagatttgggtggggacacagccagatcatatcattccactcttgacccctcccaaatctatgtcctcacatttcaaaaccaatcatgccttcccaacactcccccaaagtcttaactcatttcagcattaactcaaaagtctgcagtccaaagtctcatctgagacaaggcaagtcccttgcctgtaaaatcaaaaccaagttagttactgcctagatacaatgggggtacaggcatttggtaaatacagctattccacatggtagcaattggccaaaatgaaggggatgcaggccccacccaattatgaatttcagtgaggcagtcaaagcttaaagctccaaaatgatctcctttgactccatgtctcacatccaggtcacgccaatgcaaaaggtgggttctcataatctgagacagctctgtccctctggctttgcagggtacatcccctctcctgactgatttcatgggctggcattgagtatctaaggcttttccaggcacaccgcacaagcctttgggagatccacattctggggtctgcaggatgggagccctcctctgatggctctactaggcagtgtctcagtggggactctgcatgggggttccaacctcacatctcccctccgtactgccctagcagaggctctccatgagggccctgaccctgtagccaatctctggatatccaggcatctgcacacatcctctgaaatccaggaagaggggcccaaacttcaattcctggcctttgtgtacctgcaggcccaacaccgtgtggaagctgccaaggcccagggcctgcgccctccgaagccactgcctgaacggtaccttggctccctctagccatggctggagcagctgcagggtgccaagcccctggcctgcacacagcagggggacccaggaatccactttttctctcctaagcctccaagcctgcgatggaggggctaccaggaaggtctccaacatgccctggagacattttttccattttcttggtgattcacattgggctcctggttacttatgcaaatttctgatgcaggcttgaatttctccccagaaaatgggtttttcttttctattgcatggtcaggctgcaaattttccaaactttaatgtttcacttcctcttgaacattttgctacctagaaatttcttccaccagatatcccaaagcatctctctcaagttcaaagttccacatatatctagggcagaggctaaaagccgtcagtctctttgctaaagcacagcaaaagtcacctttgttccagttcccaacaagttccttatctccatctgagaccatgtcagcctggatttcattgtccacatcactatcagcattttgctccaagccattcaacaagtctctaggaagttccatactttcccgcatctttctgtcctctgagccctccaattctctaggaagttccaaactttcccacattttcctatcttctgagccctgcacactatttcaacctctacctatcacccagttccaaacttgtttccacattctcaggtgccctttatagcaacactcaatttactgtatcagtctgtttccatgctgccaacaaaaacatagctaaaacgggcaatctataaaggaaagaggttcaattgactcacagctccacatagctgaggaggcctcacaatcatggcaggaggtgaatgaggagcaaagtcatgtcttacatggcagcaggaaagacagcatgtgcaggggaactcccctttataaaaccatcatctcttgtgagatgtattcactatcatgagaacagacaggaaagacccgccccatgattcaattacttcccagtgggtccctcccatgacaggtgggaattatgggagctacaattcaagatgagatttgggcagggacagagccaaaccatatcaagcggttattcagaaaatgtgactaactattggttttaagtaacaaaaggatggtttcagtcttgaattatcttgaattattatgtttgctcaaactttcatagttgattgttgcatatcttctttccgttctttctttctccagcaagaatttgtttgtaccagctctatgccatacaccgtgatagacacaccagacgtggaagtgagaaatatggttcccatcttggatagcaaagaagatggacaaataaaccaacaaattaaacacagaaaaacgttttctaaaggaaggaggtttcttgaaggaagtggtacttctgttgaaatatgaaagatgagtgagggttagtcacatacagaaagggagaagggagtatccaatgtagatagaacagcatatgaaaagcacagagatgtgagagagcaggtaggcattgctgtaaatccaggtggatgtaaaaaaaatcagagccttgcaggaactaggttgtagaaagctctgtggactaagtttagttggtttaactttatcctaaaagtcacaggaaaatattaaagatgtttaaaaaagaaaaaaaagcagattttcattttattaacaaaacataactctggcagcaggtgtggaaaatggatggaggggccaggaccagaagaaagacacctgttactgaagcaatgcagatgggaaatgatggagacctagatgtagaccatgccagcaaagacggaggggcagaattgagtaatacttgtagaactaatgtaacttacaggatgattagatacatagaaaggagactaactcaatcctttatttttcttcctttttcaaaagtttttttaagactatattactatcttttccccattccctccatacttaatatgacagttagctaattttacttgaatacctatgtcttattctttaccaacaccatcaagcagcagcatctccctaccaccaccacaacaagcagcaagtgtttatggagcacctcttaataaattatcctttgtcttgttttgtgacaaatttacattcctctctgctttacttttgctttatcctgtatttttcattgttctgtggtttagcgtgtattttcttctgctcttccaggaccataggatttcagagcttgttacttaagttctcaggtttttgatatgtacttggaattttattttttactactttctcaaagtaatgctccacaaatatttcttatgtaattccaatgcatctaaagagatttagcatttgagttttatgttaaaccaataaactgattaaagccataattagcaatcaccaacttttatctggaaataaactgaaaactattattcacttactaaggctctggtgtacttatttctgtaaagagaacactatactttgctcaaagaagtaatacaatttatattttctcctgttctcatgtgtgcaaattatgttcattttattgtacaggctatatatcttctgcaataccttcatctgcctgtaggtgtaaagttaaaattcagctcttctgtcaaggtaagaaattagatagctggctaaaacaagttatttcagtgtatactgctcaggtgatgggttcaccaaaatctcacaaatcaccactaaagaacttactcatgtaaccaaataacacttgttcccccaaaacctatagaaataaaaaattttaaaaaatgaatataaaaaaagaagttatttaatatgcaggcttatatttatctagtttttcattgtttacattttttctttattctaaaaaaaacaggatgcatgcacaaaacgtgcaggtttgttacataagtgtacatgtgctatggtggtttgctgcacctattgacccatcctctaagttccctcccctcacccccgaccccccaacaggccctggtgtgtgttgtttccttctctgtgtccatgtgttctcaatgttcagctcccacttatgaatgagaacatgtggtgtttggttttctgttcctgtgttagtttgctgaggatggtggcttccagcttcattcatgtccctgcaaaggacatgatctcattcccttttatgactgcatagtattccatggtgtatatgaaccacattttctttatccagtctatcactgatgggcatttgtgttggttccatgtctttgctattttaaatagtgctgcaataaacatacatgttcatgtgtctttatagtagaatgatttctattttgggggtatatacccagtaataggattactgggtcaaatggtatttctggttctagatccttgaggaatctctatactgtcttccacaatgattgaactaatttacattttttcttaacagcagtcatgtcatgccatgttaaaaaaaatacagatgttttcttcaagaagtctaaggaaagacttccttgtactacttaaataagactgccaaaatggcataatatcaaaaaagaaatgtaaatagagaatcaactgccaactaaatgccaccattactcacagtgtgatatcacctacttgtcttaggcatcattcatttatattatagtctggtccaccgagactattcatcacatttttattgagcaatttctatgtgcttagtactgactctgctaggctctataggttctctgtaggtgctttaagtcctgcccacaatagcttacaatgtggttgagatttaaataaaaatacagaagtttttaaaaatatatcttgtacaaattaccttaaagtaaaaaaaattcagataatgaaaataaagctgtcgaaaatctaggatgagcctagaaatattttgtattaataaaatagtcagtaaaagcctggattaatgaaaaatatgaggacagatatttttagtatggcaattaaacacttctgtagtcataactaaaaatataatgataagcgtatattttatacagatccttaagatacctgcataatgacaattatcttaagaacagttttctttgaaatgtgcttccaattacaaaggatgttgaaaaactttttctcttagtttatctgatttccttatagcttttatttcattatttatttaatttttgaaaattgttcttttagatactaaaaacacagacccaagtcaactctgtctgaattttcatatattctgtggatatattttattatgtaaaagataatgactctacttttctcttccctccttgggagaacttagataaatataccttctgacggaagccaaagcttctaaacacaatattctctgttctcttacgtatccctggctaacagatctcggcatggcttggcatgcttgttcacattaccctggtccaacctctcttgggaacagcacagctgagttttttgtttatttgtttgtttattttcttttacattgggttgcactgatgctgaatgaaagcactaatgctgcaatacaatgggggctggagtaggcagcagttcatttcttccaatgcaaaagctgtaagtttaaaagtacgtggaatatattatatgtatagtcaggactcatgtccatacagcccacttaaagcatattaatgttatatgtttgtttcacatatgtatcccacagaactttacagtagttactataattaaaataaaactgtagatcaaacatcagttcttcacaagtaacttttttttggcaaagttcttaaggatcttactttattttgagggttagttctatctttattataaccttgttgcataatgacaagaatttgtgtttattgaaaataacaaaaatgaagatgaagctacttgttaaaaaccagtgttttgctgaattacaacccagagtatttgagtacacatataacataatataacattattttcaatgaatttgtacacaatggatacatttgtctagattgtaaacaaaaatgttctctgtacctgctcaatttttctgtgaaactaaaactactctaaaaactaaagtagttttttaagtatcatatatatatatactgatatgtatatatagatatacagtttctctacatcagattttaaactaattggacaaagatatttctcattgtatgagaagtatctttgccaaatagtcattatttttctaacttttctaattattttgttacttattactttaacaaaaaaacctttaataaacatgctatgtaaaacttcatgtgggctgagcatggtggctcacacctgtaatcccagcactttggggggttgaggcgagtggatcacttaaggttaggagttcaagaccagcctggccaacatggtgaaactccgtctctactaaaagtacaaaaattagctgggagtggtggtgggtgcctgtaatcccagctactcaggacgctgaagcaggagaattgcttgaactggggaggccaaagttgcagtgacccgagatcgcaccattgcactccagcctgggcaacagagtgagactctgtcttaaaaacaaacaaataaacaaacaaaaagcacttcttgtgattattctccctggatgtagacatttttaaacaaggaaagtttaacgtgaaatgacaacaaccactaacatgaacaacaacataaaaacaaaaagctatcatgttcacttatgttaatcttgtacataaatgttaccttcgctgataatttacttaattagtaacatctttctaggtgtcaaacactacactagtgccaagagacctgtggaaaaaaattaagaaacgagtcctctccaccatgaattacagttttgtcacatgggaagagacatatacaatgaaaatattcaaggaatagtacaatacaatagtcaaaatgagtactatgtaacttcaaagttgcagacagaggtaaggaaaaaacaaaaatacttaaagtattcaaggcctaaggacaaggtgagatctgaacatgtgggaggtgggtaggttttgcatggacaaaaattatcgtgaggtcttaaaaacaagaatagcatccaaaggatggttggggttgattccgttcatgacatttaaacccacagagtcaagaagccggtttatagttgaaattgagattcacattaaataggtagaaataagtctgggtaaagaatcaatcatagtaaatactttctgaggatctatcgtgtaacactcattttatgtacgttattacaattaccctacaggtaagtactattatcttcaatttatagattaatttattgagatgcaattaactttctcagagtcacagagcttgtgagtggcacagccagatttaaatccaagtttgattccaaactcatgcttctgttaccacatcactttgtcttgtaaacagaatatcactgcagcaaatctttcatcccattgtgctgtaagaaggaacagtacacctggaattttaaaaacttgaacctgaatttgaattcttacttatgttaggtatgaaaaatcggttaagccctttataaactgtaccatcttttgtaaaaataaaatagtgaatagatgacagctagtcacacaggtgaatgaggaacagatagaagtaacagaagaatggacattcttctgatgttggcaaatactatgtactcaataaaattcactgaatttaaacctaagtaaagggattgtgtacagcatcagctttgtgctagttaagaccattttaaatatagatttggaagaaaatagttatagtttatagctaattcacaactgcttctgctatttaagaaggactctactattgagtcattatagttggcagaaacgatatgtagtcacagcatatgatcctacagcaaaacttctgataccatattttcatcgcttcccaagatgtcctataggtgacagcatggcctttagcatggtacctaaagaggagacactcagtaaatatgtggtgaattaagcaaatgaggggacagaagaaagggaggaagagaaaaaaaaggacaagaagaagaaaagctgattgaatttaaaagcaggtaacggcatatccgttgaaaactattagatgactcaagtatatcttttagaagtccacaaagttttttattttaatacagacaaaatagattcttttattttataaaaacgtaataaagtttgttattcaacaactgttatttattaattttgcctttgtatatgctgccagaaaagaaatattaagaaatcctgacttggtcatggtgaatcagaaggcctacctggatttttttatcactctaactgcgcagctaatcattcaacctcaaatttgttttttatgacactccaaggatgcccttagctgcatcactcctttgtcatcaaaagcttagaaataacaattaagcagattcctgagttactaaatgacacataactagaattgagacttaggaacttttagttccatgctaagcccacagggacacaacatctctaaaacattaatcataattgggcacaaatattttttgtcacgattccctcctgccctcatttgcttttatatgtcgttaagttcatatcctattaattgaattatcactctcaatatgttgacttttcaccatcataagcttatactgatttttcaaactcatattgcaaaagcaagctatcatgaaatgtaaagatgtccactttggttaagattcacgtaaaggtttgaagttggagaaaactcctggaacacaggtctttcttttcatcacttttcctccaatcatcatctgtgaaattcttcccaacttcttaaatgcatattcaaaatcccatccaagaaaccaatctaatattcagaggcatggattataataataaagttgatctccatgggtattactgacaaaacaatcattaaaataaaaagataaaaatgaagaaataatccaaattaaaatatataattatccttctcaggtgggaagaaatatgcaaattcagggaagcaggaattgcaataaaatgtccaactccgttctttcattatctgttagaatagagagagaaagatgcaataagcatggatggggattattttttttaaattttgtgtatggtgtgaggagtaaaatataagtaataaatttgtttgctttaaacgtttaaaacattctcttttgaagtaattacatgtgttttagatttaaaaaagcaattgtaggcacaataaatggtcaaataatcttgttgtaaaaacaagtttcaattagtatataactctagtctaaaaagaaataaggaagaatagaagctgaaatagccaggaaatagaatattttcctatcaaaacatcaaagtaggccagacgcggtggttcatgcctgtaatcccagcattttgggaggccgaggcgagtggatcatgaggtcaagagatcaagaccatcctggtcaacatggtgaaaccccatctctactaatacaaaaattagctgggtgtggtggtgtgcacctgtagtcccagctacttgggaggctgaggcaggagaatcgcttgaatctgggaggtggaggttgcagtgagccgagatcatgccactgcactccagcctgttgacagagcgagactccatctcaaaaaaacataattaattcattaattaaagtattctgtttatttttttaagatagtacacagtgccaattagtataaagcaaattttttcacacacggttgatgaaattttaaatctaattattttcgcaaacagtctgtctacatgtatctttaaagaacattaaatattacacattacttattccataaattctccttatggtaaaatatatatatatataaacagttttttcaaacctctgcctttcagtacttgggtaatgatacagtaatattttcatcaatgtggcaaatttgaccacaaaattgaccatatggttaagtaagctacagtgtattatttagataacctattacataaatattaaaatggcttcacaaagaatttgcaaatggtctgagaaatgcttattttatgctaaataaaatgagaacaagattaaaaaatgtatatcataatattaacataagtatgtaaaacaaaattaaaaaactgcaggaaaaaaagaatagaaaaacatacactaacatgatactgaatttttactgactggtgagactaaagtttagtaagctatttttctttctaattttcatcattttccaaagtttccatagagaacagggcttatttttgtaactgagcaaaagtataataagatttactttaaaaaattaaaaatggagttagagtgaacctaccaaaaaagagatggaaacaagttatctctcttcgtttcccttcattggttttctagggaaatctgtattaacagcaaaacagtacccagtgtgcacgtgtgtgtgtgtgtgtgtgtgtgtgtgtgtgtgttatagacatagatagatagacagatagatacatagatatagatagatgatagatagatagatagatgatagatagatagatagatagatagatagatagatagatagatagatgatagatacgtagacagatagatgtggggaaggatataggattataaatgtgagttgagtaaaaattgtattggcctcatgatttttaagctgttttccagaatcaaccagcttgttcttatcctgtaagtggcacactatatatctctattgaaaaaacacattcatctcttcctctgaaaaacaggaaaaattctctcagttccctcaaccatgaggataaatgtctaaagaaattgagctgcttgaatgttcatatcagttataacaacttgtaccgagcagaggggttactgtacctgacattacccagagaataaaataaaatgagcatgctttttcgctaaaatgaagagttcaactcatttgataagtcaactgtgttatctctgaaaaaataaaccttttcacagtccttcttaaaaagaaaaaaatcacacaatgctataattcccagcagactttccattcaattagccattaatagaaatactaaaaagaggtgcttgagggaagaaactaaagctcaaaatttgatatggccaatcatacatgacatttgggattaagttctgccttttagagtactcattcattgaagtacatgttttattcaaaatagatctaatcaaaaatgcgactgagagtgtgctagccatatgagccatatggcgaacacgctggattctgatacctaattaaaataggagtggcctagccttaacatactactggaaactgtccttactatgaaaaaatcagtgacttacagattctttcatggcaagagacttgatcagtcacaagatcagactcaagccagtttcaaaaaactcttggttggaggaaacttaagtaaagttaaaaacaacaactcctctaaggaatctagcactcttaatcagatgtatatgtttaatttgcattttaattctcagagatggtctgcctttgtagcatcaactccgattagaacagagagacgggggaaggctatgctataaatcccggcagtttctaaatctcacctttccaaatggtcgctccacatcaaggttgaggaacactggcagggtaaggaggtggagctggatgcatagttgtttgtgtggtacctgatctgtgaacagacagaggatttcacaggacacttccttgagtatttttaaagaaaagcaaaaccaaaacctgcatatcaaagtcacattggctatgatcaatatggatgttttagatattaccttcctaggaccatctcatttctacttccatgctttgactcacacttatttcctcctacacttacgcatcaaatacgacttgcaggcagagaccatgtctgatatgactggggaagttatcacagcacttgttaaaggctgaataagaactcattgacctcaagtgattggtgaagggaaatctaattcaaccaccctccagctgattatttttcgtgatttcccattgctctgggataaagaatagaattcctaacatgacatcaaaggctgttttatctggcctcgggatgcaatttcaaactcttttcaaactttttgcctttttgatcttaaatgctcaggctacactagccatcttcgaacattatgaacagtgtcatccttcttcatacctcagggcctttgtacttgcactttcttctgcctgcagtatgcttccatttcttcatcacctggctaacttctactcatctgatagatctcaacttggagaatcactttcttggagaacatcctgttcactaggactggtgcctcactatatgacatctactattttttctttcaggaactcatggcatatgaaacgtatagttatgtgtgtgattatttattgatgtgtcattgtacctaagctataagcttcacaagagcaggaactgtgcctggttttgcttaccactgagtctccagcagctaccacggtgcctggcacagaaatcatagtggataagcatttgtggcctgagtggacaatgctgcacagccagtcctgaggcccatccctcaacagtattctccatattacacatctcctaaattcattggatgtcacagcagaaaaacgattccttttttttataaatttctcagtaattgtcttataagaaaaagacacaataaaatgaattcctcataaaaatttgttacaagagaaaggagaaagaaataaaatccagtgtttcttcagtcttttttaattggctttctaaagtttttttttccttaaaaatttaattaagattatcttaaacagcacggccattttaagtggcatggcattatacaagcagtccagacagacatatagttttccaatctttaactgtgttaagcaaatggatgatttctgttttaggtaggcagtgctgtgtgaagaatcataaaatgccatgttttctttgcagcaaaaattacactttgaccaatacctattccacagcaaacagaaaaagtttagtggcaatttgcacagaaattttatggttctggaagagtggtcagacttggaggagaaaggagaacaggtttttggggtctttttaaattttttgtctgcaagactttcaaagccccctttgtactcctatgtgagaagattctccatctgctaaagaacgatctggttaggataagttcttaccttagctgacaactaggttcctcttcctgctattatgctgcttggttcttatttagaggcctgctttaactaaggaaatgcccttgggcttgcattatttgttggctaaactttagaagcagactacagctgtaggaatttcgatatcacatacctgtacaatgtcaaatagcaggagattaaaaaaaaaaaacctaaagtaagaggcactgcaaggtagtttgtcaagagccaagagttctgcagcatatgtttccctagtggcactgtctgtggagcacagaggatttttagggctgtgaaactaatctatgattccataatagtggacgcgtcattatacatttttccaaacccatggaatgtacaacagcaagagtgaaccctaatgtaaactatggactttgggtaataatgcggtgtccttgtagattcatcaattgcaataaacataccactctggtaggggacattgataatggaggaggctatgcatatgtggggccaggggagtctgtgaaaaatctctgcacttctcaattctgctatggactgctccaaaaaataaattccattttaaaaaattgctgtatattggggattatatatgatttgatctactaatagccttgttactactgtttctgaccaaagttttccttctctttaacatatcctgcatattgtttccaaggcaaatcttggcaaatcataaatatctttgaaagtttcccatttctaaaagataaagactaccatatgtcaggtgatgccaagctcctttgcctttaatttcatttcatgcttaaaccctttaatacactgatcttcattcacatcaaatatgacctgtcctgaaagtataaggataagcaggtactaacgagcctctcttagacatatcagctcttgcagccataaagattttcctttatgctgcctaggatcttcccgtctgaaataaatcttgttcttgtttcaactaaacttgcagctctgctgtgttcttcccaaattgccaagtatataagatatccaatctgccagcaaactttatcctccctttggatgtgagaccccaaagatttcaatttagacagctttatttactaagctgtgttacaggatattttaaaataattcagttaaggtggttcaggctatttaactgcgtatttggagggagggtcggtgttgatcttccaatttgaatttaactcttgggccaaattattttcctatggcaattctgaaagaagattgatgtgtaaatgggcacgtcacagacaccaaatggagactccagaaacatagctcatttgtttggccttctgctatggctcatttgtggatcctgtgccatttatggtttagctgaggatgcctgatgcctgtattcacagagccatgctgcctctgtgggctgaacactatgctagtttgtctacgagattccttccagaatgacccagctgtaccacagggttatagctactttccatcatgtcattaatagttctttctgctcacctacactagctcactaatttatccccatccactgcttgatcctgaataactgaggactatgatggtctgtgctgtcaccttcagaatttcaaggccagaagtgtaacttggcataaatctagctagattttgaaggaaaaagagaaaaccatcctagaattccctctcttcacctctgattacttgagtccttgttacaggtcatcccgctcccatagctatcccctccctcttccaacttcctgaccaccggctcctttccatccactttcagatatgtggaagtttcccttgtcttgggaaaccaatacacacaaacacctgtgcttgactgtttgtctctactccttcctccaagtgcagtcgaatgttttgcctccctttaacaccagcttctttaagtgacatgcagtctcaggtgctcctaattcctctccttttagctccctcctaaacaactgaccagaattagaaggtcctctccctttgtcagaaactgttcaaacactttacaaataataattcatttaattatttgtaatcggtactcttatcatcttcacttgagatatgcagaaactgaagcatagataggtaaagtaacttgcctaaggtcacctccagatgagtggcagagtttgaattcaaatgccagcagtctagttccaaaacacatgtcctaaccacactctactgcctcgctccctccaaattctataattggttttcattcctgtgctaataaaactagtctcttagaaacttttggtatatgctctcatctttgattgtagtactcaggctagatatacctgtattgcatattaagttctagtatttacaaacctccccccactttttatgcaagtataatgaaacttcattaagctggaatgaacacattattctaataagggtagaactaaattttatattgttcgtgacataaaatagtcttaattggtcaaattaataagcaaaacaaaaaattaataaggtaataggagcagcatttgacctactcaagggggaaaatatagataattttagaaacacaaatccaggcttctgatatcagaggagtctttcctgatccggataataatatgtataatgcacttattgattcctgccttgcaggagtgtgtgctctagttgggaagcaattgaaataacaagaaatagtagaaaatggcacatagtcactctccagagcataggatggtgatattcaccatcatctactttgttagaatttgcagggtatattctgagcactggcaagttcttcttaggcaccatgccagctgccaccaagagggtagtgatccctgtgggcataaagaaaactgcacattttaaagctaaaaggagccttggagatgatgtaatccaactcttttatttacagatgaggatatgaagccactttcttttacagtcacaaagctagcttgcagcaaagtcctatctggaatctagctttctctttctgctctatcactaggcccaataatagatttgtagatttaatccacgcataaataccctagaacataccttattcatcaaatgcttgtttcttaaagaaatgaaagtatagataactgagcagggttaaaagactaaaacatgtgagctagccaattatactactcagtgagccccacaagagcagagattttcacgtttctgtttgttgatggaccctcagtgagtaaaccagagtcagccacaacgtggtttaattactatgtggtgtttgaatgaatgatttcttctacattttttatatgcaatgtctataagtgagtagatattatttctattttataggtgaaaaaaaaaaaagctgagtgaagttgacttgctcaaatctagacctagaaccagaactagaaaccaggcttctggtgcctaattcattatttagctgtaaaaagattgctttcataaaaaaattaattgttattctgtacagagaatacagacagatttgtcacttcagcaaaattctgaggaaatgggtacagctgcacgttatctactgtcattatttacttgctggtcttttgggtgtgagccatcatttctagtccggggcctgctatatcacactaacaacaaaaataaacggtttccccttcttactttccaaagtttccttcctttcttatctttcctctcagaattcaaactgcctggagaaacaaagtgggcaggctggggaccgtccttccattgagcgttctcacaccacttcgtgagactctgatcaactcaaactatattaaagactccaatgccttacaactgtctcctcaatttaatttcatcttttggagtttttacagcctcactatctaaagagattatacagttactaggctttgtaacttctagcactgcttcttgaatcttcatcttttaagggggttctgtgtttttctctttctacaacatcaaaatatattcttaagataatagaccttaaatgcagttatactggtctcttcacaatagcacagattgtagaagccttaagaattcacagaaaggggaaatattaaagtaattgaggggagttgaggtttcataaggaagtgcagagcatgaaaagaagaactggaagggaggcggggaagtcttgaacaaagacaggactgaatgagcaagagtggaaggcagagagcaaatacagctagttattgtggatgtttcacttttggactaagattggataggggtggatgggaattggagaaatagaactgttaccactttcaaataagtggggacttcgacatagtttggggggattgatagccaaaaaccttaggcaggaagaagggtaaactctagaaatattgcccagctggaatcctggttccaccagttattagctgcgtgaccttgggcaagttactgcaacttgctggccctcagtttccttcttggtggaatgggaataaaggttgtaactacccctataagattgttggtggaattaaaggattaatgcaggctgcccattatgtctgtaatcccagtgctttgggagacctaggcaggaggattcctggagcctaggaatttgagggatcccaggaatctgagccatgatggcaccaatgcactccagcctgggtgacagatcaagaccctgactcttaaatttttaaaaaaggggttaatgtatataaaacacttagaacagaatctgatgcaatgacacaaagtaagcactcagaaaatattagctattcctatttcagccataacaaacaggccatttattatgctagcctcacctagaggttcttgtaagggaaattccctggcccacaacttctgaaggggcaactacaggtcgcctattttgtgcaaagattctgtacattttaggcatacctgattggacaaggtgtgcaagctcaagcaataggttagccactgatctatgactttgccagtcaaggaacagtgaccttataagagacttccttttttgagaatgtcaagaaaataaggaagattagtatcaggaacagagccatgaggaagaagatgattaagctaaggaattatattgacaatacagagaaagaataggcaactgttaatagaaacaaaattatgacaagtagaaaataactgggtccaataatggtggacaataggcaagagattccatttactccagttgttgattttcaggatcttaatctactctccaactccagcctacacactccaagccatactattgtttctttttctttctccttttttttcttttctttttccttttcttttctctctctctcttccttccttccttccttccttcctttcttctttctttctttctttctttctttctttctttctttctttctttctttctttctttctttctttctttctttccttccttccttccttccttccttctttcttttctttcagacagagtctgtctctgtcacctaggctggagcgcagtggcacaatcacagctcattacaacctgacatcctgggctcaagcctcccacctcagccttccaagtagctgggactacaggcatgcatcaccacaccctgctaatgtttttattttttgtagagataggatctcactatgttgtttaggctggtctctaactcctgagctcaagtgatcctcccacctcaacctcccaaagtgttgggattacaggcatgagccactgtgcatggcccataatgctgtttctattacaataaacctcctcttgcttaagctaacataagttttgatctatttcctatggtccaaggaacgtaaataaccaaccaatgcaaacaccttagatgatgagtttgggtatccaacacttgctttagtgatccctggtacccatcaatcaattgactcatggccctccagtgcaccctccatgctgcccccacagttatcctcactcagaatgggctcccattctttttgacatatgcacagactaattttctttcaagggcaagttcaaattccactttctccatgaatacctggggactatactggacagaggtggatccaggttttgtggcatctgaagagtacaaaactttctttaataaaatgaatataaagctaggtgcctaggaaaaggcctgtgaaattgagagactttgaaacttcaacttcattcacttccctgtacatctacttctgataccaggttaagagggactttttctccatgaaattattctaccaggtatattttacaatactgtgtgtaatcacacagacctgctatataaataagctcagtcttacacctgctgcctctcactttgggaatatcatttgtgattggactgcagtattccaccccccaggctgttgggaagaaattcctgatgtctgacagatctactgtcagatttgggagggaaaacatcgatcagtatatgacactgctcctgctcatccagcatctagtgtatgccacctaatattggtagctaagccattctccacacaattgtttctaaagagagcctgctcattacacacatacatactcagacatcccaacatacatgttttgtaaaattgcttcttatttttctattagccttaaaataaagacaaacatttatttcatgggccacaagtctcctgtcatgtttccaccatcattcctctctgtctcccactccatatttgcagagctaaaaaatttactgtccatttgtggacatctatgcaagggagcagtcaataaacattaggagtagttatctctgctttttaaatttcactgttttttcattttctccttcctcattcacccttggctcagttgaagttctcggtaaagactcataaataggtgatagagttgttaattggcttaatttaatcattgcacagtgtaaacatatatcaacacatcacaacataccccataaatacagaacatatacagtgattatttgtcaattaaaaataaggtaaatcacaaatttctaaaaagaggctaaacaactaagtgaataaggagctttatgagggtgaagctttgaagaataaaaaaaggaggctccccagactgattagaagcacagtagagagaggacagccacctagagaaacagatcagagagagcctgaagggaactgtggaaatgcaaaaccatagcccagagagagacctgtcaggtgacagccagaacctaatgactccctggaatcatcagagtgctcgagagggactgcatttcatgaagtcacccaggatgtgcttgagttttttaattaatctgaaaaaaaaaacaacggaactttctatggctagaattggggatatttggaaacatccagagtcagttattgaatatcagtaccacttgattatcagttccattgaggcagggttcaaatctaccttgtttctgctctatgcccacatatcacagtgcctctcctatagtatgaactcattaaatatttagcgaatgaatggataatattttcaacaagactcaagctctttgaaatcacagactgtatcataaatgttctgtaactctaaagaacccagcacaatgcctgacactgagtgacactagttatgatttgctgtctgatttagaagctctttatatgtcaaagggagatatttttttctttaagcctggtgataaccacgcacacctggtcaaattcacatcctgccttatcttttatgtgctcccagctctataaaggtaaaataagcaaaaggaagaacaattattggtatcaaaaatacagtaatctagagactaatccttccctgaactatctttgtcacttcctgattcattgaatttggtcagtttgttccacacgtagagcctcctggctctcagaaccatgaggaaacagccatatccctggaagtagactttaaccagaggctgcttcctgaaaggtcctagtccccagggatttattgccatggaaagcctgaactggccggaagacgaacggtacacacaacctttgggttgagtatagaaaatgttctgtatggtttagctgttgtgactatctgctatgttgctaatcgacacaaatagtaacattattaaagttcattaaggctgggtgtggtggctcatgcctgtaatcccagcacctttggaggccaatatgtgtggattacctgaggtcaggggtttgagaccagcctgaccaacgtggtgaaaccctgtctctactaaaaatacaaaaattacccaagtgtggtggcacacacctgtaatcccagctacttggaaggctgaggcacaagaatcgcttgaaccagagagatggagattgcagtgagccaagatcataccactgcactccagcctgggcagtagactgagactctgcctcaaaaaaaaaaaaaaaattcattaaattaacaaaattattctaactattcaaaattgctctactaataaaacaataagggtaactctgcaaggccaaggtgggaggatcacttgaggccaggaatttgagaccagcctgggcaacacagcaagatctgtccctaccaaaaaagaaagttttaaattagtcaggtgtgctggtgtgagcctatagtcccagctactcaggaggctgaggtgggaggatgagaggatcccttgtgcccaggagttagaagatgcagtgaactatgattgtaccactgcactccagcctgaacaacacagtgagaccctgtctctagaaataaaattaaaaaaaaattttaagtcaataagcaaagcccaagaactcacatcttagttgataatttaaaggaaaaaaataagaaaaagatgtattttccaaaaacagttaagaataaagttacacaatttagaaaaattaaagagatattttagtgaaacaacaaaaatgtactctaaatcttcaaaaacttccaaatacattttcttgaattggtgataatattgtcttccatcccctccccactctcatggaaacccttccatcacgacagccctagggaaatgggagagctaatgccaacttcagcagcaggaggaaacctttgcaaggaagggcctttgccgacaaaatccttctagtgctagaagaggagacagcatagaaagaggagtaggagataacatccttacttctccattacgatggcctcagagtcaaaatccagaagcgggagaaagaacagaaacacacagagaatgaagaaatggtcacaagctctttagtacacaggctcatgaggtgtcaccgcatgcgtgtgtggacatgaaggagaaagccaattatgattccctgactctcctccagcctccctgaagtctccctggggcttatggaaggcagtggaaagctgaacaccatagagactgccatggagttgctattgttggaggccaaaagagtaagagtcatgatcaactcagtgtaccactggaggctatatgagtaaacagcaaactgtttctcataaatgcagaatgttggcgaactgacaaactgtgtatgccacccagaaggactacaggagggcagtcacaatccaggcacaagtgtttcttgtgattaggcaaatctgaagcctgttagtaataatgtgaacctgtgatcaattaagcagctgaccagtcgttacctcctcctccctgctctttctacccaataaatacaaagggctgcctttgctcgctagaagcagggagctctcttcttcccctggacccttccttaaaatagttacttttgtcttaagttttcatttctatgttcgtcactttgttcagtcttttaatgacggtctcaggcagtaacagtagtgacggtctcaagtagtagcagtggcagtctgtcacagctatgattagggctaagatgacattgtcagaggcatttgaaccagagcaactctgaaatctactgggctgcattcccagatggttaggcattctaagtcacaggatgagataggagatcagtgcaggacacaggtcataaagatcttgctgttaaaacagcttacagtaaagaagctggccaaaacccaccaaaaccaagatggcgacaagagtgatctcaggtcatcctcactgctacactcccaccagcaccatgacagtttacaaatgccacggcaacaacaggaagttaccctatatggtctaaaaaggggaggcatgaatactcagccctttgtttagcatatcatcaagagataaccataaaaatgggccacaatcgactctcggggctgctttttctatggattagccattttttattcctttactttcttaataaacttgctttcactttactctgtagactcaccctgaagtctttcttgcctgagatccaagaactgtcttttgggatctggattgggacccctttcctgtaacgccatggcagagacagcagttcctatgaggggacgagcctaaggcaatggactggaggaaggaagtggctgtgcctcaagggtcttctgtgtcactgagatgacagtggggtcaaggaagcaggaccacaaggctagaacatgttgaggaaactgttcccagatttcaccagcactgaaatcaatggtggatgccagtggctgtctagcaaccaggcaagacaacaattgattctggggatttcagggaggacccaaagggcaggatcaggacctgcttttgacaagctgcctcccttcaattacctgcattatcacaagggtatgtgagctttctccttcacacagatgccatcttggctaaggaaagggcgtgctgggagaaaccatgaaagacaacatttgcctcaaagagactgaattaacccaaaatgagaaaataatggattgataaaatatcttcaaccgcaagatcaagaacccatctcctactcttctacctcctagctcctgctccagccagcagagaccaaacatctgtaagagttttgttctttctagaaaaattttaagcagatatctttaagcacctaaaattgtattaattttacaattagtatttactataattgtattacagcctagttgtacactgtataattttcaccctggccattagcaaaaacagagactctaagagccaaacagatatcaatggccctaaacaaatatggttatggttctcccctttataaatctgtgaatgtgagccttttcttttccagtttgatgtattataaaggtgaccaggaaggaaatggaaacaatgtcaaataagaacagccattctaattccaaacaagttaagaatatatgtctaaagacaaattaagtctgacaaaacgtataagttatgttttgttgtataatcagtaataggagtcaatcaagggtctcattgcaattttatctacagttttttacaaggtaaattacaagaaatatagctcagataaaaagaaaatattaaatgcactcttctagtatattaccacatcagtaattgagaaggattaaataaaagactataataaatatggtaattgcactaagtagttccatgataaatcgattcttattctccaagtaagagctgatttgattgatctctatgcacttcagtgttctggaggatttcctagtccctgaagctgcaggtgtggtcactgtcaggggcaaaacacttaacacagctgagaagtgatttgttccctgtggtcccagctatgcataggcataaccacaaccacccaatataatcaaattaaatcccagctagtgtgacactgccataagaataatgattggatactagcagaagctgtcaagggtcttttatacatccgataaataaatccaactgactagtgaaggtcaattcaatttagcactcattgattacatatctttcatgtgtaagacactgtgctaggcattaaaagaaaactttgactcctcaccaataaaaatgttttattgttaaacagctctcattacgtagtgtaaattgtatgtagtttgtggttatgaagcgtctaaattcacaatgcattctcatttctctcagtgacaggagtatcaaaataaaaatgactaaagccccattagtcacaatatgaccatttggaatctggatcttacataaaagtgtttaaaaactcagttgtttaattttaaatatgaagtaatacagcaaattacttatcattcagcttctcttattcttaataacatagtaactgtgatcttcaggcaaaaccttgataaattctttcccataaaataacccataggaagttttaaaagtcatgcaatatgggtacataaaataaggaaccattctcagactatggcagagccttccaattgcttcctagcatccactctcctctctttctaccagagccctgattatgaggtggataccgactaaaacactgcatttccagactctctcccagttagctgtggcaacgtgaccaaattccagccgattatttgtgagcagaagtgatgagacttctaaaattctccttaaaggaaagaggcacacccttctttattccttcctccttcctactgaccagaaggcaaaataatggctggagctcgagcagctatattggattatgaggatgtaaactaagaatgacagctagaaatagctccaatctctgataaccaggaagtagccagatcagccctggactatctacatccagaatttacataaataggaaagagatacccatctgtgttcttttaatcattgttttatttattttttgtttttttctgaagctgaccaaaacctaacatagtgataaagtcatcccatcagccagaataaattctgagcagttatcaagagaaaacttaaagtaatgtgaagagaagccacacttataaaggaaaccaagagctttcattatagctagcctaaaatgaagttaattacctaaattgttcagtcaccaaggctttgggagttaacatgaggaggctggttttattgtgtatcatgcccagaagttccatgataatttcaaattgtttgcatgtaattccccccccaaaacttgtacaatattttgacattcttaaagaggagaggtgacacagtatcatactactgtgtaataaaaatctgctctgccctcctaccgggtttacaatacagatagtggcacaggaaagcgctcagaacagaaatcagaatgcttgaagcttacttaactcactacagacctggaaagttgcttaaattttataaagcttggttataaggataatgataacagcagctccattttctacgcagggaagttgggataatcaaataaaataaatgtatgtcaaagtgttattgttgttactaaaatcattttggtgctcacttatgtttcactgggagaagcactctgttttcagttttctggaataattaccttttaaaagggactcttttttgcctgcattaacttattttctctaccttctcactttcatggttctgcaggataattttatttttatgatgtctgagttttcatgagctacatgtatgcaaatatttttagctaaaacaatattattgagaatgtgtatttggctaactcataactgcttattttgaaactagctgagaagcacttggactgagactgaaaataaaaataaatttattaacaaattatagaaggctgtgcagttagaatatgtcacttgctgattgaaatccaagtgctatatgcagtaaaatttcttcaacccagaatcaagcatccagacatttcacatagcagcatttactttgatagtattggccagttatcaatggtagtaaaaatgcccctggacttacaaaatattgaagtgccttctgaattatcaaaaacatattaccagtcaatggaacctacacacacacacgcacacacacacatgcatatatattttcacatatatacatgtatttgtaaaaatatatatgtgaaaatatatacatacatgtatggatgtgtgtatatacacatcaagcttctgggcatgatatacaatacatgtatgtatgtgtacatatgtgaaaatatatatacacatacagctgggtgtggtggctcacggctgtaatgccagcactttgggaggccgagttgggcggatcacgaggtcaggagatcgagaccaacctggctaacacggtgaaaccccctctctactaaaaaatacaaaaaaaaattagccaggcgtggtggcgggcacctgtagtcccagctactcgggaggctgaggcaggagaatcacttgaacccgggagacggagcttgcagtgagctgagattgcgccactgcactccagcctgggcgacagaacgagactgtctcacacacacacacacacacacacacacacacacatatatatatatataaaatacatattatatctattatacatatgtatcaatgtataatatatatatacatatattatacatatatatacacatatatgcattttatatacatgtatgtatgtacacatataaatacatgtatgtacatgtatatatatttgagacagggtcttgttctgtttcccaggctggagggcagtggcataaccacagcctcccaagtacctggtactacaagtacacactactacacctggctaatttttatgtttgtagagatcgggtttcacagtgttgctcaggctgtgcttgaatttctgggctcaagcaattctcccacctcagcttcccaaagtgctgagattatacaggtatgagcaactgcacctggctggaactaaaatatttaactaactgatatgtaccactccacaatcatataatatggagattaatattaatggcaataaaaacactagattatctgtgtttacctggagcagaatgaaaaatgctacaattccgtttcacaaatagtgaaggtaacatttaatttcttgctcaaaagaaagcaggttatttgaatttattgttgagaactgccttctgaacgtcattcacttcataggcttccttccaatgtgcttctcattgaccttgggcttccatttgattaataataaaagtcacctaaccttaaacttcactcaattcttctctctcagacactcacacacataccattagaactcccactctccaatacaatctagaaaaacaagacactctgcaaggatatatactcagggcttggccctaccctcacacttttgacagtccaaggaaacatggagaaagaggagctggcctgtgcacattacactttggttttactgctcctttcttggaaaccctactcactctctgcccactatccccgaggctgactggtgagacatttcctctcttatcctctcctctccaaaccctcagtcttcccttatgagcctgctttctttctttaattttccactgctactttcattacactctctgagccagaatactagggtatagagaatatatgtggagtgagacagggagggaaggtttctagggagtgagcacaaggagaccctgacaccagtcctttctgggaactgcagggagatgcattccgtgcctcagtctctgaggtgggcccagaagagaattttgaaatgggctacaatagcttcaggtgtctgtcttctcttgagattcgttccctcccagcccttcgtgtctttcccaggtttttccaaagaaatcctaactctaactcatcattaaggcttaactgttctatgtcccattcctctatggccttactaagtggctagaggtaatggaaataattatttatgagatatgagagagtgacagtgatttactgtgttattactcagataatgcatttactttctaagaagggccttttgtgtccttgctcaaagaaatgaaaattcttagattataggtcttatggtggatcctataaggttaggaaagcttttggaaaccctttaaacaataataataggctatatttaattggttatactaaatatcaagcacttttctaaaagctttacacattttagctcatttgatgttcatagtaatcccagaggaaagtactaatacctttacaaatgaaaatactgagccctgaggagggtgagtaatttaccctcagtcacacagctagtaagtaaatgaactggggtttgaacccaagtagtctggctccagaatccctgctctttattcatccagatagctgtcaaacacagcatcaaggctgaagttagtctgggagtcagaaggcccgagttctagagctggctctgcctctaaggagctatgcaactttgaacaagccacttaaactctctcagttgaactgaatttgtggttgatatccttgtttttttggaagcagagcgatttctttaaatgaaatcctaattaaaagcctgatatacacaacagataaaagggagatattgagcctaggctgctgttatagcgacccacatgttgttcaaaattgaacccttcaccccttactaaagatagcgctctgttgaaccagttgaactccttttgactcaatgatctctactgtttctttcagctacaggaccctatgtaaccaattgtgtagacacacctagcagcttcatgtctcaaaatgtgctcttttctctaccatgcactcaggtggaaacagcctagtgttacagagagaaaagaggcaacacttgagcaaccaaggacatcgatttcatcattttacttgatttcctttagggctcaaccaaataaaagatactaattaaagcctcaccctacactatatatttccctctgagaagcagagatgagaaatgcagcttctaagcacttagcacagtgactaccatcttcgaagcatttgattaatgatcatccatgctaatttgaatactatagcaacagtataactaagacccaaaacatttataacaacattgccctgggtagaactttttgagattaatttcattagatacttgaaaataaattcaattaaccttgtttttcttcttcaataaaattagatatgaggtccctcaatgttaaattcccccctcttctaacaagtatatctagatatagatctggatatacttactttcttcccacttccagatattctcttatgaacctcacttctctttttctgcatagtggaacacattcatctttaaaccatttgtttttcagtattactgtcctacgtttgttacatatcccccactaagaaagcagatgtatcacagatggtgtccttgttaaagggaaaacttctagagagacagcgcaagactcctgggtctttggtttgctttataaagcgcatgtgtatacatgggacatgggtgaatatgtctgtgcgatagagcttatgacaccctaaaagctagaggaatcatgctatactcattttctgagaaattcaccaagtattgaaaagtgaactggtcttgggcagaagtctacattttgtacagttaggctaaaatgtctaaccatgttaggctctccttttgcagcagcccattaacaaaactgaggtgtaggtgaagagggttaataacaaaaagctctgtagtctctggagagctcagaagaaagattttcaggaatgactgggaggctgctcaggtgtgctttggagttttccagtctttgagatgtgttacttgcattctttgctcctcgagggcatttgcatccccactgtggttaagtatagtaataagcagaaattagaagctgaatgcaaaccgagtgagtgaaagaataagggatgcagtgaacaataagaagaattgatggagaaactgcagtctagtgatatgaacacatggcaggaagcaaaaagaatttctaaatgtgaacagatcaaaaccctgttcaacttccttgtgccccaaaaggaggtggtcagaagttttcttcaaaggctcttcgttcttggaaggaaagtgttttttcactctttatcagcctctgacttcatagctgtgttaccaaaagggctgggagcaaggatgtgggtttagaccctgcggccaaaggctgctctgctctttgccagttgctctgttcctgccaaccacagctacccttctctcttctagcctggccgctcacctctcagcctggccattctccagctagggccattgcagacatctgaattaatcaaaaactgtcttcccttcatatcacctcagaaacttaatataagaacgtaagaagtgttgcacccactaagactagtagttcattcaatttaatattctctccaatggtgacaccaagggacctttaccgggatggaaaaagaggcattgtgaatagcaagcatgccaaaagtttggatgccattatctctaatttcagtccctaattatagttaactatttacggaaacatgtagtgtatgctgtatctatcaatgtggtaagtctgtaaaccttaatttttttttttttgagacagagtttcactcttgtcgcccaggctgcagtgcagtagtgcgatcttggcccgctgcaacctccgcctcctgggttcaagtgattctcctgcctcagcctccggagtagctgggagtacaagtgtgcaccaccacgcccggctaatttttgtatttttagtagagacagggtttccccatgttggccaacatattcttgatctcctgaccttgcgatccacccccctcagcctcctaaagtgctgggattacaggcgtgagccattgcgaccagccaaaacttaatttttataaactaaaacctcttctgggacatcattgccttttttttatttgtactattttttttggtcatttaaatcaatttaataagtatttctatgtctactgtgtatctataattcaaagccttcacattcttggaagctgaaggtctggggaggagaggaagtgggagggactgggacactaagattaaaatgatgtgtctttcattcaagaaggtaaccatccagtgggggagctagaatcacccacagctcactgtaatataagtagagcagtgagaagtaatcaccgaggcataaatgaggtgtttatggatgtacaaaagagggaatcagtaattctgaatcaggcataaggaaacaactcttagggtaggtgtcatttgagctgggctttaatgaatgagcagaattttcttcattgaaattaacatttaagcaaagtaaacactagaaacagaattgtgaatgtgcataatgtgtttggggagaggattcaaaaaaggctggtatcagtgttgccagaaaaaaattggaatggtagattgggattggtttactgagagctttgaacaagttaaagcttttgggctttgtacagtgggcagtggggaagtagtaaaggacactctaagtctctgctcttgaaatagatagtctaggacactctactatctccactattcaaatgagaaaaatgagattagaaggagtaagaaactcactctaaagaaagtatgaaagtgatatttgagctgaagtttcactctagcgtccaaatactacacctagtcttagtctttctttaaaaaaattttagaattattttaattgacaagtaaaaattatagtaataacatgatgttttgatatatgtcttaatctcaatttaattatttataaaataggaataataacaacactccctagctaactaaaaatttgatcaaataaaactacagatggtaaaatgccttagaaagtacaaaatacttttataagtgttcactattaatattattttacatttatcactattcaactaatataactcctaaatatagttctggaaaggaaattagtgttatttgatgttaatattgtctataaatgattgcattcctactgggctttatatatacgtattatctcatttccttgctatcttgtgaaataggtgttgttatctccaatttatagatgagtaaacagaggctgaaagagattaaaacctactcagtcacacagctggtaagtcaagaaccatacttcaaatttatgtctttaaatccccaaatcccttccataaggctactcattgccttccttattgatgatgctataaaccttggagtttacagtggcacactgaaatgacgtcttcagggaacaattaatgatgccagaaatttcagcatttccaacaaagatgtgagtgtctggttttttgtgctttaaaagagatgtaactctttctaatcctgttaagaattaggttgaatagttaagtagtaattaggcttgacttacctaaaaaaaaaatacccattctatcctactctctgagacaaaataatgtctttaagaataattttactgttgatttaaaaaaacttccctgtttaagtaatggtattggttccttataattattttaaactttaaaatcttccctaaacatttactgaatcatttgtatctattttgtttttgtttttgagaaggagtctccctctgtcacccaggctgaagtgcagtggcgcggctcactgcaagctccgcctcgtgggttcatgccattctcctgcctcagcctcccgagtagctgggactacaggcgcccgccaccatgcccggctaatttttttgtatttttatttatttatttatttatttatttatttatttatttattgagacggagtctcgctctgtcgcgcaggctggagtgcagtggcgagatctcggctcactgcaagctccgcctcccaggttcacgccattctcctgcctcagcctccggagtaggtgggactacaggcgcccgccaccgcgcccagcctttttttgtgtttttagtagagacggggtttcaccatgttagccaggatggtctcgatctcctgacctcgtgatccgcccgccttggcctccaaaagtgctgggattgcaggcatgagccactgcgcctggcctgtttctatgttttgaagtatatttcttggctgggcgtggtagctcatgcgtgtaatcccagcactttgggaagccgaggaggacagatcaattgaggttgggagttcgagtccagactggcaaacatgataaaaccctgtctctactaaaaatacaaaaattagctgagcttggtggtgcatgcctgtaatcccagctacttgggaggctgaggcaggagaatagcttgaacctgggaggtgaaagatgcagtgagcagagattgcactactgcactccagcctgggtgacagagggagactgtctcccaaaaaataaaaataaaataagtaaataaataaagtatacgtctcttctcttggttatgaaacttaaaaatatatacataacaggttagataatattgtacaaaaatttggtgattgttattcatgatagatttattcttctgaaatatgtgtatattttacacatagcaaaaaatgatcagaatagataataagcagagtttgatcaaattcatattgttggcagactttcatattcgatgaagtcaatccaataatccaattataattgttattaatgaccaccagatattctgatttaattattggaaagtaattgctgtagctctttttaaaaaaacatttttgctgttttatgagtagttttccaaaaatgttgtaaactgataaagtgaacatagaaatcatgaaattctagctttgagattagggtcaacaacaatgcatttagtgacacataaagcagaatataagccacatctgaagaggttgaaagcagaacactaagctcagcagctatattcagacaaatctttgtcttttacaccaattccaatattgtagccatagtatgactgttttgagacatagaatcataaaatcctgagttggaagaagacttaaagaagatatttgtattccatccatctacagcaaactccctagtggttttctggtatgtgcttgaatatttgaagtgacagggaactcattattgcttaaggtcagccctgccaccttagggcacattggtttagcacctttctagattaagtcagactctttctctctgtagcttcttagtccgcccttcagggcatatgaaataaatctctatttaatgtgacactccttcatgcatttgagagaatctcaccatggttcttagatgcagtcaggtttgaagggaaatttacaaagacaaatatttgaaagaatattaatcaaaaccataacaatgattaagtttgagtggtgaagtatagggaatttttctttggtcctcgtgctttcctgtattgcttaaattttatacatgaatatatattctaattacaatgaaagaaaatgtagagcgatttacactttgggaaagctatttaagtcctaaatgcaatcagtgaaaactgagacttcgctctgaagaatgagagaatctgaaatctgaaatctgcaagtgataaacctcaatgtccccacaacctagacccacatgatagaagctcattaaaaatgtgaatatgactaaataaatcaacaaatcattcatttaattggtggtcaaaatctacttggagacacagtcatcacttgggaagtaacagctccactaagaaccaagttgttactgctgtgaatccaagtactaagaggaaaagaatcacttccatcctaattcaaattgatttaatgccccttttaattgtgtatttctcaaatacatcacagtccggaaattctctggtagttctgtttgtgactttacagctagagatgaactgaggtactcagaaataaattactgttttgcttgaatctcgatacatctatgaaaattttgcacagggaacgacgatggtgcttattatgatgacggtggataagtaccatatttaaaatctggcgtgtggctgggcacggtggctcacgcctgtaatcccagcacttcaggaggccgaggagggcggatcacgaggtcaggagatcgagaccatcgtggctaacacggtgaaaccccttctctaccaaaaaacaaaaaattagccgggcgtggtggcgggcgcctgtagtcccagctactcgggttgaattcattcaaataaatgtcaattgaccccagagatgcctgagaactgttgactattgtcacacttacattgaaatattcaaaagacaatgtacaaaataagactaaagataaacatcaagatgtacaaatttttccactttatatatctatggataagttgcattctgaattcatttagtgataataatagaattagagtttggagacgctgagattttgtttccttgaacaaaatgttttgcacagttctaatcagtctgatcagttctgtggaaatcagagagcagtcagttgaagagaaaactggtgaatgaataaaatatcaaatgcatcaaatagatttcacctgttagcagaaagggatggaaaactcagaaacagggggcaagaatttttctttctgaaagacaaaatgtgctccactcaaactgcattgtattttaccagaagaagctaaagcaaatttcaaaattaagcagggagagatgataatcagaatagtttcactgatgacaaatggtctgccctaggtcctgaattttctacagtctcttaggagttcctctgtaactaggaagcacaagtatcttctgcttttcagtaagcattctcccaaattacaagtccgagaggacgggtaaaaggaaaaataaaaaaagagacaaaagccaatagggccaaaagagatgtattcttagtaacccaaattgtgataaactcttggctttagcaaaaaccacaggcctgtgtggaagtagaagtgcagtttttctgtacaaccatctgctgccaggaaaccaatagtttctccactgcagaagtggtcctggatcaaacaaggaaggatctaaatgtttgcagtcatgtgcacacacctagattggacatatggaccttcacattttttgctgagaatcttgtttgcttaatctaatcagcactcttagaaaagctgcctcaccactgctccccaaaattatttctggtggtttgaaaatgtccagacattgataatagagtcaaagcctttcttccatggggttttaaacaaaccctcgaagataaacttgaagcttctgaaactaatcacagtagtaattatttgctcatggataacacatgattatattctaaacccaagtcaggtgtgaaccccagctttatttctcattaactgttgtgtatttggtcaagtgacttttcttccacaaaccccagtttccttatctggaaagtgctgataacacctacctgctgtcattgacatgagaatttgataacatacgaaaagtgtaggtgctcataaaatggtatctgccactatggtcattatcaccagttcaaatttctttaaaacgttgttagtgttcatgtgtccctgaaagcattctctttccatttctgggagtttggttacttaacatcctttactattaagaagctcattttaaagcagatgtggtcaaaatgagtgaataattcaagaaggatgaagacatgggatctagacaaaggactatcaatataaataaaagaggcaaaaggatgaatagcagagaaaaccagaaaaatgttagactcccaaagtgggtaaagattatcagataggtttgggcacttggaagactattaagatttagccactgttccaaagcaaacttaagcaaattcaaaacttgatgagttcgtaactctagaaaaaaagagaaatgtattcaagaaaagaaacataattacagtactactgattcctcagtgaaggatattttcattatcatgaaaatgcaaacattgaatgttgatttaatgaaagtcagttataactataatgggagaatgggtgaggagagagctaaatccagcaaaatagaaaatcagcatataatgtctataaagttgattgagtgtgagataacaatatattatttaaaattatggtgtcatatgctagaaaaaacattgaaaaaataagctgaaaggagtagccactggaaagcaggtggtctaggggtagggttagaatggggactgtgggtttcatgcatgataagcctttcagcactatttgactttttaaagagatgcacatagtattttaataaaaatttatgaaaaaacttaagaaaagaaatacacatttgaggtataacagatatctctcttgctccttcacacacacacaaataagcacaagtgtataaaaatctatgtaacttactctttgttacaagagttccttagccacaaataaatgaatatccatcatttaacaattaaaggcataggatttagcagttaggatgaagagtaaagcaaaaggaggcagaaaatcttaacaaatggaagacatggtacctgtattcaaggattttgcaatttggttgagaaaagaaatccatctcattcaggagaaagagtgggaacctgaaatttctttttggagaaaaaaagaatctatacttttgagtcttgctatttttgtctcctagagttttcctgtgagctgttttccaggactcagaagagaaaagcttatctgtgtttagctgacaagaccaccttcatgacatttccagagagaaaggagaatcatggcttttcagtgagaagataccacatagaaatatcatccccttattttacagatgaggtactaagcctaaaagaagctgtgtatttttcccaagttcacacatcctgtctgtgacaagaaccagctttctaacgtcacttgtgtgttctggtgaatgtgcgattgcccaatactaaactgggaagtctgtagtaaacatgagatgagaacaatcataattaattttctaatattgttcaattaatgaaatgaatataacaaagtaacactaaccacttgtatagcactttcaagtgtctttactgggtgcaaagcctcatacctgtaatcccagcactttgggaggctaagacaggaggaatgcttgaggccaggagtttaagaccagcctgggcaacacagtgagacctgtttctaaaaacaataaaaaataaaaaaaataagcctagtgaggtgtcgcatgcctgtagtcccagccactggggaggctgaggtgggaggatcacttaagccaggaggctgaggctgcaacgagttatgatcacaccatggcactctagccttcgggacagagtaagaccctatctcttaaaaaaaaagtctgtattttcattatctcatttaattgtaacaatcttatgctgataagaaaattcaagttgattcagagacatttaatggattgtcaagggcaaataaccagtaaataacaaatcaaataattcgaccaaggtgttctggctccttgtccaatgtagaacattttctctttcattatgacacacaaaactttagagagcatttttgtaaaatgactgtatttaaaatatactttaaaatattttaaattacatatggccaaaataaatgaattagttcagctttggattattaatagtctgaatgaatagtcacagggatattcaaaacggtcatggtgtgagaaaatctcggacagggataagagtcatgcatatctaattagagctgcccaacatttaaggcagtgattacacttcatgatatgccaatattatttctccaaaatatttcaagtaaaaacccgttttgtcccgttaattcttaaaataaaagggttgggcaaaaaatttaaatggtcaagaaatgttgaaactaacaaaggacaattgcttttcctctaaaaacagctcctcctggatctcctaagaagaagactccaactcacagaccactgctgactcattaaaatcaacttgtaatgtcatgcacatactgtgtatctgtccaattcatgcacatacatccagaatgtaggatgctttggtatcaaagagctgtttatgattgacaaatacttcaatgctctaagattccattttcatcttctttaataaggaaagacaaatgcaaaaatacatgtcattaattgctctgcatttttccctccagagaaatgcaaaccataaacatcagtaagattctactaatagctttaaaagttggcttaaaccattattaattatacatttgtaagacggtctgtgactgcatgccttgctttcttattcaaaggttcaatcaataaggtcatccctgccacttgcactctgaatggcaatgcacaaatttagtgcctatagaagtataaatagatatgtgtctacatatatatcctagtatcatgaagttacattttaaccatgtagcttgcttgtgtataggagattacatttttccagggaggtgggtagatgacatttttattgattttttaaatagctacattataaatctctcttgttgggccagcacaaggcaaaactaaaacaacatctttattgtaaggcaaatgcatctttggataacttgtaatattttttttaaatgggtctttcacttttcaacctgttttggggtgagtaacctatattgctcctctcagatcaaattgtgttatttcttatcatcacatgattgcaacttttagagaaaaatgattgcagttccttataataattctacctccagttacattgatttactgttatggacatatcgttagatagatgtcaaggaattttggcattcactgggaagtaattacattgacttagttccagttttaggtttgagtttcctaaccaaacgtggaaagctttgcagttccttaaatcatagaggctctcacagaaggatttcttaacctatgggcataaatgccgaagaggtctatagatagacttcggcaggtctgtacaatttctgacactgtgcaaaaatcctctgcaccttttgtgggagtaccacatacctatcatcaatttctcagaagggtcgttgatcctaaaataattaagaaccaatgttctttctaattaaatatcacttaaaacagcctcaattgtggatttcagaattattttctctcaatgttctttgcaaaatcagattcaaacaaccttgtatgttatattcaaagccttctttttaaaaattgcataagaatattatgcataaacactgattatccatagtcttttgtaacttggcctcagaaacttatggttaacagattaggtccctcattctaattgtatttttttatcagactttgattttcagtgtggtaggtaaacccatcttcccattttatacaaacaataggtttcagtagtgtcagttatagagatcatgacttgaactctgttatcaaaatgtatgataataactctagacctgaggaattgaagactggcatgaactcagaaagtcacaggctcatcaagagacattgcccaatatttgttctttgataaaaatcatctttcagataaaatgaagcttctgcagctttgttatacagactaaatatgcaaacatctaatttaaggaaatagtttgataaattagttttctccttcggagagaattgtctggaaatgtgtacttaaagatgtagaattataacagattttttaaaggtctttggagacaaagactcactttaggtatcactttgagagacatacaaaccctaattccttttatcaaaaagagaatagagattggaggcatcaatagaaagatgatactttctaagaaattgtgcctaatcatctgtgaataggtttatgtgattatggaagctgatcagggcctgtggtgatccaggcattgttgtagtggcagcaccacatttttgtgcagtcagacacaaactggcattctagtacctgctgcttcaggaaatgccagaacagtgcctatgtggaccaaggccccacagatggcctcacccctcaaacccttgggtacatagcacctgtttagtggccctggcccttgcttttaaggagtggttccaactgagggcaattatgtcccccatagtacatttggcaatgtctgtgaatatttttgattgtcacatcagagaggtattgctggcatctcatgagtagaagtcagggacattgggaaataacctacaatgcataggacagccctcacaacaaagaattacctgtcccatgtgtcaatagtgccaaggttgagaaaccctgccctaaagccatgccactttgatgaccctgagaggttatatagaaaggatctatgtagagccacactacccacaggaccactaaagtttagtccatttgacagatttggaaactgtaatgctttggacagagtgaagtgaaaaaatatcctacaatgtccttcctttacaggttaacacctattcctttccccaaaatgaggattaaatgccaccttctacaggaatacctcccatgttagcatcacgtttccatgtattctcatgataccatgtgcttactctaattgcagctctgattatttcctgttcccctaccaggttataaattcactgagagcttgctgtttttattaattcttgggtcttagtacctaccagagcttggcacttaataggtatgcaataaatatatgttgaaggaaagagcaagcctgcagaagtgacttaaattctccatgacaaacatccatccagaatggatttactcaaggctagtactagcaagcacactggccccaaggacatttggccccatgccctctgaggacatgaaactggggaatgtctcaccccatggcctgtaggtttaccagcatgatggtggaaatttcgggtgagccatagccatagtagtcataatgacttttaaattttatttatgtatttattttaataatcacaattgtacatattcgcagggcacagagcgatgtttcgatacatataatgtatactggtcagatgagggtaattagcacatcatcatctcaaacatttatcatttctttgtgttgggaacattcaatagcctccttctagctatttgtaactgtatattagcattaactgtagtcatcctacaggagtatagaacactggaacttatttctgttatctctcttatctagctatgatttttgtatactttaacaaaactctgcctatcctgaaatactaaagaatcaagattgtagagacaataagatctggtcctaggcctagaacccccacatgggaggaaccagggacagaattctccttggatatcttttctcacgaagaaagagggatacttttaatgagcttgactttgcagtctacatttgacagagcttctcccttcattgaagaaggaagaccaatagtgacctcaataagtacatgaacaaatagctggggatcccagtattcataaccaccaatactcagctcacaccaaaactcaggcacaagtcaattaaagggttgtactatgagcaaggacaattcttattttggctgcctgtaaattacaccaaaatccacaagaaagggaaataactaagcttacaataatttataaatgcactctgtgttaagaacaataatcttgagataataaaacaaagaaacatcatgttgaaaatcggaaaagagcaactctcatatttatattaaatcaacaataatttgttatgcacatgattatggaatataaaacaaaatgatctaatttttccagatagcatggggctgttgcattacattgtgctattatttgacaaagcacatcaaatgggatttcagcaaaatacttaacatagttataggtaaagtattcctgacgtgagttgacatcaggaagaaaacacagcgacatttcagaatattcaactttattttccattgacaaacacgacataaataacacacatttattaaatacacagactagccatgacttgaatgccagcaaaagtctaacgtacttttcatacgctcttttattttttgtctccacagtattgaagaccagcctttaaaacatactagaagatatatttaaatacactgacgataactacccataaaactttacatagaggtgataaaagagacttttccatttaatcaagtatatagagatggatgctgaggaggagaggtgaagaacactatgcttttgatactgatctttacaatatggattaaagtgccaatgatttcagctcctcctaggcacaccatgtaaatagtacttacattcatttgttacaaacagatcaaaataatcagtgcctattttaattggtttgcttaaacaggcttacactatttgtacaaaaacatttgataaggagagcaagaaggcaaagtatttttttctctttcaaggaagagttgggaaggaagagagttcagcagtcaataatggcctgagtgaacttatcatttgctttgacagacaagacccctggccactcagtagtactactgatgctcaagtgttcaaagataaatgcagtcggtcccttcctctctttgcttccagggcctggcacaaaatgatgaaggttaacaggtagaaaatggacaggttttccatcatatctttttctatgttctctgccccacccacatgagtatcctttcaaaagtagaacgttgaagtgtattagtaaatcacacgcatttccctctgcttaacattacaactttgatttctacagacatggaaaactgtatgagaaatctatatttgaattactattaaagtttaatgattggctgtttttgcctagacgtttggcttactttaattaaaggatcaaaatattctaattctaaagcatttaacaatagcattgaagagatgcacaaatgataataacttgagaagtggaatcatctccaaaaatgctcaaaaaagcatgaaaaggctgacttgtttctgatggtgatctctttccttcttatctttactcccataataaattcttcaacaaagcagacttactacacaacagattctgatctgtttcacatattaggctactggcactttaaaaatatgaagttattatctctcctcttaaaaacaatcccagcctcatcaacaggaattatgtctgttactttctttctgtgaaagaatggataagcacagtagagtcaaggggactaggagaaaacagtgtagtttcaaatgaagaaatacataatctagtagatatctgggttgcttattacatgaaactgattgatacaaagcttctgaaaataagataatttttattctcagtaaagaaaatgtgtgacataaataaatataatacatatctgattgaattatatttctagagaatcataatgcactctgcttatggtatcataatgtaatggtatatgactaaacttatataaattataacccttaaatagaatcttcattttaggaattataaaagggaatatatcaaataaaatattttccctaattcttttatcatcatcaccacctagttagtttccttacaatactgaactgatgtcagcttcttaacaaatatgtatgtgagtttaggttggttattaaattttgtaaattggctcgatcataacctatgtcatgaaacatcacagacatctgtcactttgtcagcactttgttgcaactcagaaaagtcttatggactaggccacagttgcacaattctgcacattttttagacctcagttttaacagattttgagatatgtaaacatataaaacaagcaataaacaagcagctgtgaaaatttgtcattgttgatggtttgtacttgttatacagataaaaaatagaaattttaattcttcaagttaggctttttatgtgtttgtaataataaatactctgtagtctccctgtgtcattcagctcctagaatcctgtgtattgcaggagaagcttttggggttaaattatgaaaataaatagatattatgcatgtctaaaatttcaaagaacaaaagttttctattttctttttctgagttgatctcaaccaaaagaactattagtgattgctgatgtggagaaggttgaaagctgaccaataatttggagtcaaaaagaacaaaattataaaaagcgttgaataaataaaaagcctaatctacttgaaaatccaatattagaatactgccacagagtgacccccttattaaaatactgtttgccagtttttagtttgtctgtcactcaatgccaatgtgctcacaggatctttcatagttaacttacatgaggttttgcattattttctgcaacatggtcggatatttcataaaataaagaaatgtaagtagaaatatatgtataccctatatttcagactagtttaaatctggcatgattaaacacttacatttacctaaaatatcttgggatatatacagcactaggttaacttggtaaatattgagataactcatttttgtttcttcaacttcaagatatttttaagacattcatcatacctattttatttgaaaagtaaactgctctcattaagtaacatgtgatcattcttctctgtgactcagcatagtatataaattcattgtttggaaaatcaacactacttggtaaaattgacacttgctaattttacatatatttctacatttcattcgcttacttcttccaccatggttttcttggcctttaattgtcttttaaccaatacttcaaaattcaggaattgtcataatctatacatgcatttttcctgattagacatatgtatggacaaactaagtatacatgagtgaacttgaaagccaataaaattaaacttagacacgtctttctgctgtgactacatatatcctctttctaaccaccgctctagtctctgtacatctctgaaatctaacctcaaccatcatgaaaaggctgaaatcatttgggattttcatttcttatcaggtttccccatactaacgaatgcctagataataaaactcatatgccatttacataatttctttgttttccacctccctttcaagcttgttaaaaaaaacacaaaagctgccattcatcccctcctaaaatatatcccctgggcaggaatttaatttgcagttaagaataagtgtcaggttttttgcctttctgtatttttgcagtttgatgaaaagtgatattcttgtgatagtaatgtccactatcatttggaagtatcagtctcctaaattattagtataaataaagcactgtgttgtacagcagtatgacactacacccttgaagataaattcatatttctgtaattaaataatcagaaataattcactttatcagcctgatggactgtaatggcatgaagcacttcaatcatatggtatgtgccttgccaatgtgtactgtcctggcaaacttctgctcattgattcactgaataaatatgtattagacagtttctatattccaggtgctatactagatgctggaaggaataacctaatcatgctcatgccactcaaattcacattgcctctgtgtctatctgactagaacttagggtcacaggaccaaccaagaggtaaagcctctttattatgtgatttcagtgcacttttgaaaaaaagtaggtagttttgtcttatacccaatgagatgacctacaggataatccaattctatggcatagagagattttagtatagtctatttatcaccttttccaaaatttagattagtagaaccatcattaattacataagcactctcaacagattttgtctccaaattcaatttgacatggtcatttaaaataattagccccaattgacataggctggtgtatatatcaatctgatagacatattgtacctatcaaaattaattctttaccactaaacacacacagaaatatgcagttactacaagaagtataaataaatctcaagcttttaaaaaactagaaaagcagtgcaagaaactgcaaatgaaaatcttcacaataaaaagttaatgggtttacaaaatgaatgcaccaaagaatatggcaagctttgtgtaggcataactacaggattactatgtttggtggggagacatttttaagaagtgcaattcccaaaacttaatgtagtgatctacttgtgcacaaatacgtcaagcttagctattgaggtttgtattcatgtagactgtaggaaaaacattttagtaataaatatttagatagagccactttgaggagcaggcagaagagctgtgaagggtcaatgttattaactttcttatataaataggccaaaatatggaaagtattcattgagtcttcaaaatatttatttgttttggaatcagtattggaatttaaagagtcaaagactggggaacacttttggtgaataatcaagggaaatatatattcagagtacctatagttagtgctcaaatcggtccttacatagcattctgaaaaaccacttcacgactctcataggtcagtttcatgaatcttccttaggctcatagaaatgtaaaatatattcaaaagaaagaataattagcaatttgggtagtcacaaactccatatttcaaacaaatggaattggttcttattcagataaagagtaaacctaattatcaatccaagtaaacttaaactttgttaggttaggagctaatttgctgtattgagcaatatttgaataatggtatcgatgaatattataaatacattatacatttttaactgtaattaaacttttctttaatgtaaggaggaaaaaagtgacagaaagcgagagaggcaatgaaagagaacacagcaatgtctttgaataaaaacaaactgctatcccttgtcttcaatgatgtatgtggttaaattcctcatgtattcagtgtactggaatattaactatccccgctccccaatagaccaagatcatttataaaaaatgttttcatcacataattaatcacatattcagctacgaatggcagactcaacaaaaacactagactgttattaatatattttcctttgtttgtgtttcactacttttggcacatagggattttctatgcttctaagaccatttagctttataccaaaaattccacttcaatgcataaacagtggcatgccagagatgcctaaattcacagtaaggtttagcgatatttgttaccaaaagctgtgcacatgcaagttaagtgttttctttcatgcttctgtctgtattatttcattagataatgagataggctgccctttctgtccatcattagagcagctggagacagcatttgctacctggcaaaactttcgaagaaggatctttcttaacagcaggtaaacccaaggatccaagatctggttcagtgaagccaggcgaacagctattaagaagaagttgcattctttctgcttctccgtgtgtgtcttgcagtgctcaactgatgtctgattgaagatcattttcaacatcattatctaagaaaaggggacaaataattgtttcaaagattagtaaggtcatatgcatctcctctacactgtactttgcacatagttggttttcaataaattggttgttggattgaaatgattaattcaagcaacatttatacttggataacacagtcctgaattatacaagacattcctaggtattttcccacatttgtggctatttatcatgatgtagcttttaaaacatgcatgtcttcaggctcttgattcttggaatttaagaagcttgaaaataacacatctcaaaatgagccaaagtcatgtttgttgcagaaaacaccacaagttcacccaaatgagagccaacacttcaacaataacaaaaacatcttaatcttaaatttccagtagttctaattttaaaaattactgcagaaaaagtagacgcaagaaaggaggaaatattattattattattattattattgccactagcattttcagaatccttactatttagcagacatggtgccgagttcttcatatgcatttaataaacagcataacacaggtagtattaccacttccttctggatgagccagactaataccatatgatgtacaatattatacttttctttgcccccacccaatatacactgcaatgtaaactccatgatagcaggaatttgggactattttttccccaagtgcctagatcaataggtagcagatagcagatgttcagtaagtatttgtgagagaacaaatttttatatttgaaggaatatattatacaacataaaaatgacagtatatgagttatatgtatttgtgcgagaacaaatttttatatttgaaggaatatattatacaacacacaaatgacagtatgttatataatatgtatttatatttgaattaaaaagatgttcttatgcatattaaaaatgttcaggccaggtgtggtggctcacgcctgtaatcccggcactttgggaggccgaggcaggcggatcacttgaggtcaggagttcgagaccagcctgaccaacatagagaaaccctgtctctactaaaaatacaaaattggctgggtgtgatggtgcatgcctgtaatcccagctactcaggaggctgaggcaggagaatcccttgaacccgggaggtggaggttgcagtgagccaggatcatgccattgcactccagcctgggcaacaagagcaaaactctgtctcaaaaaaaaaaaaaaaagaaaacaaattggaactatttcacctgctgtttcccagctatgcaactcctaggaatatactgtccagaattcctgcaccaagagtactgtatatgactgtttcataacagcattgttcataatagcaaaaaaagcaggaacaactcaaacatgggttcacaatcccaagcaaagaaatgagctgagtttgtaactggctcctaagtttcccattctagacctatacagctattgagtacttgacatgtagccaaagcacactgaaatgttagaatatgttgattccataatggaataataatatttctatatattgtgttaaataaacatatattattcaaattaatgtcacttgtttcttttgactttttaaaaatgcagctactagaaaactttaaattatatgtggcttgtggtttttttttgctcacagtacatttctattgaacctaatctctctctcttgaggcttacacttatctgtatgttctgccctcaggtcacataacttaaattgaattcaacatccctgagcatccaaaacatccctaaccacttaaccacaattccagtgatggcactttgatacactcaccctggatcaacatttcagagtctgtgaactcttcttttcctcatcctctgcaatgccttttgctcttgcttcactctcattcttgttcagatcttcctctcatttgaattatggtaataacagacacccagatggtacatgtacggactgaatgtttgtgcctcccttcaatttatatgtgggagccccaaccctttatgtgatggtattaggaagtgaggcctttgggaggtaattaggtttagatgaggtcatgagggtggagctcctataatgggattattatccttataagaagagggagaagaacccacaggtctctccttcagccatgtggggcacagcaagaagacagcagtctacaagccaggaaaagggccttcaccagaaactgaatctgggggcaccttgatcttagaatcttcagcttcctgaatggtgagaaataaatgtctgctgtttaagccatcaagtttacacctttgttatggcagcccaagcagactaagacagtgtttacagatatctgcccatcacaggtgcagcttccaatcccagctgtgatcaaatcctctccaactagaaaatcatcaatgtcttcccattgtccatcgaacagaaatttaactctggtattcaaagccctctacagtactgtccaaactattctttccagttttgtctcccactaattgcctatacagactccaaactctagctatagtccattggttttattctttcctccctcttggcctttattctttcttttttctacccctgcaacacttttaatcctcatcatttctacttctgagacttccaagtctttcaggactatctcagttgttcctgattattccaaaccactggcctctgaaggcctacaattgtgtgtgtgtgtgtgtgatataaccacatatttgtagtagatagacagatagacaatactagcaggcatccacatgtccctcaaaaacttggacgtatgggggaagaaaatgtgggtctctaagatttaaagtggacataacatcaacacgtaggaacccagctccaaggttactgaacttgactgcaagcaattgaacaaagtatcgacatatctgaaatcgatttgctttgggaaaaaggatacttaaccatcaggtttgagtattttctattcttgttggcaaaattgactactattgtgagataaaagatgtaattgtctatattagtttgaagtaagtaaatatttgattcttttaattccccatcttctgtgtctttttccactaagctgataatgactggtcccagtgttgataagtcaacaggaaaagagagctgagtcataggatttctggtattgccaattctgctcatgtatactcaattttatttcaaaaatacaattatataacaaaaaagcaggtagagcaggttaagcagacagacaagagagagaggaaataatacacgaaaattcttacaagactgtgtgacactggtatccagccattttcccttttgtcttatttagtcacagtttttattcttaaacgaatccctggcaaaggggatgggaatttccagttttggcttataaggcaaactcatgctctggggcttgactcatattttgttttttgagacagtgtctcactccgtcaccaaggcttgggtgcagtggcacaatcatagctcactgtagtcctgaactcctgggctcaaatgatcctcctgcctcagcctcccgagatgctgggattacaggtatatgccaccacactcaattaatatttttattttttgtagtgacggggtctcactatgttaactaggctgatctcaaacttctggcttcaagcaatcctcttgtgtaatttctttcacaggaatttttccaaatgatttatccaataaaagcaaatagtagctatacaataaataaatgttcagaggagcattatatatgccagcaagaaattgcagacacatacatctctaacatcaggtgtaaagcttaataaaacaataattcacaaatagtatatataagtattaagtgaaaaaacagaatataagatactttatatataaagttttgttgttatattatttaaaataggcagacttgtggaaggcaatggaattactgctatttaacaataatttacttttaaacaatataatttaattttaaaattgtatgtacacaggccaggtgtggtggctcatgcctgtaatcccagcactttgggaggtcgaggcagatggatcccctgaacccagcagttcgagaccagcctgggcaacatggtgaaaccctgtctctattaaaaacacaaaaattagccgggcatgatggtgtgtgcctgtaatcctagctacttgggaggctgaagcaggagaatcacttgaacctaggaggcagatgttgcagtgagccaagatagcaccactgcactccagcctggatgacagagtgagacttgggctcaaaaaaaaaaaaattgtatgtatataaaaacatttcaaatgatgttaatgaaagtcttttatttaaagaaagcagatggttattattcccttctttggtaaatatggacaattatacaccgaatttacttaaaataaatatatttacatcaatatattctgatgctggctggcttatcatcctatgagctgaatgctaccccccatcatagaaggcagaataatgcccctcctgccacacacaaagatatccatttctcggtccctggaatctgtgaatacgttaccacacaagacaaaaaggactctgcagatgtgattaaggtaaaggacccagacgtgaggagataatcctagattacctgcgtggacccaatgtaaaaacaagtgtcctaaaaaatcagagaacttttcccagctgtggccagagggagagatgactatagaagaatggtcagagatacacagtatctctggctttgaaggtggaggaagggatccaggaggtaaggaatgaggatgacctcctctaaaaactgaaaaaggcaaagaaacacttttctctcagagacttaaaaagtaatgcagccctgtagcacctttactttagcccagtgagatccatcagacttctaacctacagaacagagaaatgtgtgttgctcttaagccactgatatggtctagctctgtgtccccgcccaaatctcatgtcaaattctaatcctcagtgttggagaaggggcttggtgggaggtgactggatcatgggggcagacttcccccttgctgttcttataatagtgagtgacttctcatgagatatgcttgtttaaaagtgtgtaacactttcctctctgctctctttcctgctccaccatgtgaagatgtgtctgcttccccttcaccttccaccatgatcacaagtttcttgaggcctccccagccatgcttcctgtacagccagcagaacctgtgcttttgagacagtcttgctctgttccccaggctggaatgcagtggtgcaatcttggctcactgcaaccttcacttcctgtgttcaagccattcttgtgcctcagactcccaagtagctgggatcacaggcacgtgccaccaggcctggctaatttatgtatttttagtagagatggggtttcaccatattggccaggctggtctcaaactcctgggctcagggaatccacccgtctcgaccttccaaagtgctgggattacaggcgtgagtcaccaccacctggccccaggtagttctttacagcaagtctcaggtggactaatacagccaccaagattacaataatttgctacagcagcagtagaaaacaaatatgcccacacactgagctctcaaccaatgttaagaggaatagaaggaatgagcttgaaaacgattttttcattctcatagataaaatagcctaggaagcttctttaaatttttttactttcctaggaaacttaaaaataaatgaataaagtaaaagtaaacttcattctaactcctgtcccaattatctcaatttctaaatttacaacatgcaaaaccgaatgcctgttattctagtggcatcagtcaatgtgtttgactaaaagttataaaattaatattttcaactcagttggctttatgaaaaaaagcttattaatccctttcccctctttttataaactattagaaaagttttgcttatctttttcagtcctttaccccacccaatagttaaatatatttgaccacttactatcctccagaaagtgttctgggcctcgtctagaattatctaaaaactcacttaaattatgtttttattttctctataaaataaagaattggatttctctaactttttgtgatcaggaaaattcacaaaattacttattaaaatgatacgtcagtcattttacacagtcctccttgattatttgaaaattaatttttgtgaggctaataatttaaaattattgttatgaggcaaatataggtttcatatgccttacattgtttagtacactgtaatttcctattgagaatgcaatgattctgaaattataaaatcagccagtagctggcacatgaggagagacattagctttccccagaaatcatgagatgtgcaatatagagataattggaattagaagcagtgagcatgctactgccatttccaaatggcagcagagatgaaactggggctccaaattcttcatccaattttgaacataaattcaaattagcatccatctgttgagtctttatatttaagccataattataatttctgtgtatgtgtttgcaaatatctttcagactgtttagactttgagagaaaaccttaggcatgaatatggtagaattaattattcctattagtccaattctgtgtcatacaagggagagggaccaaagaaaaagcaggatgctcagctaacagagaggctgtttactggttttagcaaacacacatataccctgcactatttctcctttcaaacagcctcatataacaaatgatctggtcaagggagtcgtgagaccaattctagctgaacggagctgcagctgttctgtcagccccttccctgggttccacgtgactctcccaggccctctagcagagctctcccttggttatcagcagtaatagagagcttctttatgcacttgagataactgggaacacaactacatcagtgacctctaaattcgccatccctgtctactgtcaagtacaattaccttgttccatcctaaaggaaaaaaatgatttaccctttccccagtgataacgttcttttaagtgttcaaagcattaatcagggaggctgtctttaatattctatccttggattttattctattgcagcaggatttataatcacacacttaaaaatctttagtacttcacttcttaatttaaaaatgccttgggttgtaggccacacatatctattaaagatgataaatgaggaaacccagaaaaattaatttatgggggaggaaataaattggttagctgcccttaggctcaattctggggtgtttctgcatttccagtttattcctaatgcaagtgtttaagagaagtttcctcacaagccaatttttatctgcgatgttttgttttccgtaattctctgttgttaggttatgggagaataacctgctctactggaaattcccccctataatttgataagtgtatttcatcataatacactaaaaccagtctgggccctttaaactagttaattatgtaatttgaaggatttgcatgggaagaagcttcactgtggattaagaaacaattgtagtctctccaatctggttacaacagttctccagttgtcaaatcatctctggatcctagactactgtttcaaaagctttccctgccttatttaaactgaaaacattacaaataaacagctcataaacattaaaaaaattagtagaatttgtgccatttcgtcattactactacgtaattttataagattttttaaaacaacaatggattaagaatcaagtaaattatattgctagttttgccatcatttacaactttagaaaagtcatttatctctgaactttattaaatttattagtaagcagtggggctggactggatggcctctgcatacacctctacagtttttttttgatgatttttggggcaaagctggaaaatgaaaggatttcatttggcaaataattaaaacctacaggaaataggtgtgaaacaaaagtcaaaattcctcttcaaaaaaaaactccaaggggcaaatggaggaaagagaaaaattacaaagttagaagacagtgtatgagaacaagggactagattcatgaagctttggtgtatgttagcagagtgtgtgtgtgtgtgtgtgtgtgtgtgtgtgtgtgtagtggggtgggggtatttttattaaaagaaatagcagattctggcaaacatactgaccaagagttaaagaacttccataagtctgactcaattctgcttctagtttggagactagttacctaattttggttcttaacttcttccttctctaaaacatgattcacacacacttactgtgtatcgtctccaactagcagagcagttgcaaaaattaaaatgtgataagaataattaataccttcaatttatatagcatacctcttcccatgcctcaggcactcacactattgcagatgcttccaaaaaaaaatgtcttgacattcacaaacagaacaaaaaaatgcttaggggaatacgacaaagaaataaatgaattgtgtctatattgcttgaatttcttgctaataaagtagttttagaaaactcacctcaaatttgcactttaaaaatgtttagtaatgcagaatcattattcagttactggatatggaaaatcaaaattataaagaagccagcagcccgctaccacattatttgctacataaaaatttccctttcaagtagtataaattgtaaattctgtatgacttggctcagaatagctcaagacgtatgtctagataaatgtttatctttctattagaacagtcacacaatgtcaatatctaagtaagtattcaaattctggctgaaagggggaaggcaaaatctattctatcaaaggattcatttcttggattatggatgatggattagctgggtgacacacaagttagaagagttatctttactatatttcaaacacctatatttcagatgtcaaaagaaagtctagataatatgtcattgtcaaggcttaaagtacattaatccttaaaaatgcttagatttcagagttttttcctcccaaaatatagtttcatttaaaccccaaatgttcaattttactctcatccattcagaaaatcggagtgttcgtgacaattaaaaacaactaaacacttaaaggaaaaaaatcagagatgtgaattaattgtgtgtgcagagatagtcacctcaatataaaaatagaaagttagaaaaacctagatgactgacaatagagcactgcttaaactatggaccatccttcatatgcataatttatatctattctaatgctgacatttaaaatcatgctgttgaatattagtaacatgaagaatatttagtaacatgaagaaatgttcagaatgtgaaaagtgaaaataaatgttgcacagtataatccaaattttaaaaaataactgtgcttatttatagtaaaatatgctagaagtagttttctctgggtgagaattatggcaatatctattttcttctctgtatgttttccccaaattctttacaatacacatgctattttttacactttaaaaagcattacatttagagtagctggtgacttagctataaacaatcatctatccatgtattggtaaagtgttagtgttgcaatcctagaactataatgtggtcattttaggatgaattcttaagaggtcaatgtgtgcataatttaacaagaggtaagcagtctgacactctgtatgttcaaaacatttagcttgatcaacaaattaattatggcttactaaatttagtgataaattaagtggcctcagtgatggacttgatggacaatacagacatgacatacaaaagaatcccttcctgtgacatagtgggtacacaatgcagggtgatgaatatggttctaatctgatatgatacattcttattaaactttgcagtatgtcaaaatgacactgccttttaaatctattaagacttcatctcacaggagaatccaaaatagatgcatcttatattcaggatggacactgggtgaatatgagcagattgaggtgtccttaaatgtatgctcaccaatcctaattcattctctagtcagtgctctctctctctcttacacacacacacaaacacacatatacacaggcacacacacacacatacacacacaaatgaacagaatctgtttagggggcttcccaccttcttgccaccaacttcagcatctgcagccatccattctttccttcctcttatttgactggaagaggtgtcctgtctatctaaggcacaccctctgtctagcccctggatcttatccatcctgaatttcagagaccatatactctcaattgttcctgtcctcttttatagttaacttctcccacttttggcagtttcccagtcacattttaacatgtccaaatttttgccaccttgagaaaataaaacctgtgtggaattctcacctacctacatatagactgctccagaagttacagccaaatttcccaaaagaggtgtctaccctccttacctttaaacttattccaaaacctgctgcagcctgacctctgtgttcacaaatcctcagacaaggctgttcccaaggccaccaacaaggttgcagaatcaacgccacagtcttacttgtctgtaacatcagacctaattgaatgtagctgtctcttgaaacattctcttccctaatattcgagtcaccatttgttctgattttattactaattttcctgctacctttctgggtattcctctgcagtcccctttatatgctcctgtttctcgctgtctcaaaatatgttagcatttctgaattgtatcttagagagcctcctcttcttactgtgaataaactgactatgtgtggtctttcatctcaatggcttcaaaccccatttatgtgctataggccataccttttctctgagctccaaatggattagtttagctgctattgcacggctttgtttgaatgtcttacatcaaattcaacattttcaaaatgaaaattcttatctttttcctcaaaggtgtttctacattaatcttccctatcacagtaaatccccatctctaaaacagaaacctgggagttacccttgattcatttctctgtgtgtctttctctacgtctctctgtctctctccacattccaccacattcaccatattcctcacatccaatcaatcacggagtctccaactaacctcttatggttttttttttaatctatcacttctctcatttacacccccaattgaccataaactgaggtctccatcgtctcttgtctgaactatcacaatcatcaatgacatgatttgttggcctccatctggcctggcccatgctgctgcttaaaaaagatgcttgtaaaatgaaattttaatcttgttattccactttgcaaagtccttcatttatacacattgccctgagtataaagtccaaacacttaaattcaaagctcctctttacttggtgagtacctgttgtgttctctagcctaagttctcaccattttttaccctcatgcatcagtattccaattatcttgaacttcttgcaggtctttaaaagtgacagttctttcttgcttttgaggcattacaaatgtggatctttaagtcttaaaactctcatcctctttttctttacttgaaaaattctgacttatttcgtgcgtggtcttgaaacatcaatttatttgatatttctcttgacaaaagcaagccttaatacaatcttcatatggattcccataattctctacttctctacattttatcttgctgcttgtttttaattgttggtctctctcaataatcgaaaattgttacaagagtagggatcaattctatcctatattctaggtatatcacagcaagggccaagcccagtagattaataaagtttttgaattaacaaataagtgaatgagagcaagggtatagtgcatcctgcccatttgggggtacagattctagagttttgatgtaatggacaaatctaccgacattctatccttttctttctttttttttttttttttttttgcctcagcctctcgagtagctgggattacaggtgcccgccaccgtgcatagctaatttttgtatttttagtagagatggggtttcaccgtgttgaccaggctggtcttgaactactgatctcaggtgatccacctgcctcaacctcccagtgtgctgggattccagtcatgagccaccgtgcccggctgaaaaaaatacttgattcttttatttatttatttatttatttatttatttatttatttatttatttttattatactttaagttttagggtgcatatgcacaacgtgcaggtttgttacgtgtatacatgtgccatgttggtgtgctgcacccattaactcgtcatttaacattaggcatatctcctaatgctatccctcccccctcccccaccccacaatgagaacacatggccacaggaaggggaacatcattcaatccttttcaagattccaggcccttccttccttccttccttccttccttccttctttccttcctttttttccttccttccttccttcttattataattagccaggataacagcttcaaactaggtgctaatggactataagcacatcttcttatcattcatgattttaagtggaacgttctggtgttcagatgacagccagtagtaaccctgaggctggtaagttggggttatagaatgaaaggagaaccaagtatttaaaataaaatatattgaatctataagaggatattctattaactgtatatctaataacatttatttaaaatatagcccaaggaaaaaaagaagatattatgcatatcaacacagtctttaatgaggatatcatcaaatttctaatacttagtgtcaaaagtccttttattactgtaagtgttatatatgattctagcactccttgcttatagaagttttgcccaaaaatataacaccatatcttatgcttaacaactgaagacgaataataacaaaacagcaactaatgcttatataatacttactataagagactatgcttgcctgtgaggtgagtgagttgcaggaatgtcttcaatgctgctactgggtagccccaagaggagagaaagtcaccagaaatatttggttgcaactttttcccttcacaagagccaagcagtaaaattgtgggttaaacccagttaacatggctctctttggaaaggttgaggcattgaaggccaaacttcctgtcatgattaggaaatcacagactgttcttaatgttaaagcgaaagcaatgctattgtgtgatactttcagctcctcaagttgtgaatctggcattgtgtgattactccccccttgcttatactgtaataaatatttaaaataccccccagaatctgagataacacatcagtaacagtttaatttagcacttgcaaaattccctccccaggttaggcttgtactcagtattggcatcaggaacttcctaacattatattcattcattttccttttcccaacacaaaacacacccctggctaaatttaccagctttctttacagctaactcttgtcctgttgactgtaaataggaactgagtaatactcacagtccctgacctatataagtgctatgtaagtactacttgctgttttgttattatttgaatgttatgtattacaaacggaagcaacacataggtggcagctgaaaaccagcaagtgccatgcgatatttatattactcattgtaaactttagtttccgaaacttctgaaaaaaatgtttcttttgtttttcaggaaatcggactttaaaaactcacttaaataatggttagtacttacaattttataccaggtttgaaggaagtttgaataagacacaacttgtatgcaatgcaggaaaatggaaaattataatgtgttcatcttccgtgtttacccccttaggctgcttttgtctcttctattgatttatttggattaatactatattattactaatattatattatttagattaatactatattattatttactttgctgtgggactttggtcatggacatggctgttggacatggcttcaaaaatatgttactattataatgtttctaagaataaattagatagacggtaaaaatggacccccatcttttattattaatatcccaattttggataactttttctctgtattctgggttggtccaacagcaaagtaaataataagaacaagaaggaagcaaacatgaggaagaaacctgttcctaccatgactcaaatgcctaactcctatgaggatcacaggctcccaggctcctgtaaaaagataaacagatcccaacaccattgactccctctctccttaacgtgtgaacccagtgagagcaattcttactgtactacttaccttctagggaggaccttaaacaagtaataataaaacagttcctacaactatcatagggaaaatgcttttggtgaattcatctaaaatcctatatttgatgtaagtttcttttgttattttttttaagagacggggtttctctgtcaccgaggctggagtgcagtaatgccatcataatttactcactgtagcctcaaattcctgggttcaagggttcctccctagtagctagtactacaggcatgtgccaccatgccgggttaatttttttctttttaaatttttgtagagacaggcatctccctacattgctcaggctagtcttgaactcctagcctcaagtgattctcctgctttggcctctcaaagcactgaaattaaaaacaaaagattttatgcaacctcaccaaggcgaagtagatattttcaggaatggttttgcaggaattggcaaatagatctattgagacttggaactatccggttccccaacccatttaaccagaacaggtctgttttcatctatttctctaaagagatgtattgacatagtccccccggttaaaacaattggaaaatcatcagtctaatgcagtactatccaagagaaatgtaattcaagccacaaatctgcagcacatgtatgcttttgcattttctagtagccagattttttttaaaaaagtaaaaagaaacattttgaattttaattcacccaatatatctgaaatgttacatcagcatgtagtgaacataaaaattattaatgcaatattttactttttacctttttgtatttaatcttaaaactctgctgtgtagtttacatttaaagtatctcaatttggattaatcacatttcaagaggcaaataaccatatgtggctagtggctactatgctactatgctgtatagatgaaagtttagtgctttattctttttgagggttttccacctttattctgtcaattaaactgtgtaggtatcatcactgcagtgtccactattggtcacctacccagggtccattcatccatctcccctgctcatggacatagttattttcactggatcctatgtgcttcagggctgaccccatccctagctacaggaatgtgccggggttagggatgatcatgtgaccccatactagctaatgagatccaacagtttcctcgtttttaagagaaagtcatagaaaaacacagcttctctctcctgctagaagttaaccaggaagcacgtactacagctaccacttgcggggaacaagccgtaggatgaagccaagactgtactgcgaaagagagatgcggcaaactttggtcctagatgacgatgctgagctttcggattaaccaactctgaaggctgccctaattttggatttcagttatgttttttattcccaaaccactacattacatcatctctaataatgactgagggcaacataaatatagtgacactctggagcaacttttgaagcattatgttttttcctttgttttttattttttactatgtttccctattgtcgccgaaattcctcatgtttaattgttatccccagggcacctttccaaacatccctttcattttttccgtctttaaacaccaggcattagagcaactgttttcttgtgctccttcccattgcttccaattaacttctctcttccattataaaaacaatgttgtctctcttacagttgtctaccctaaaggtatgtttaaatcttctctagaatttttattactaacaacaaagtggagacaataaaagtaaagaataaagaaaaatatgcactattatcttaaatactaacaacttttactgtattaataatacccatgattcattagattcaagttggattagtggctttagaatgaaaaagatttgagtttgattcactcaacactatttatcatctgtggccttaaagcaagttgcttactcaacaagtgaaaaagtaaaataaaataaaacaaaaaacaggaactgatgtcacctacatttcaagatttatgtgaagattaaaaaaccatctaatgtatgcaaaactcttaaagctaggatttataccttgatcttcttattcctattctagtgtccttttcacttaattacacttcccttcttcattcatttcacaatcatttattgcgtgatttctttgggccaggaagatttattgaaaaacaaggcaagatctctgcttttaagcagtttataatttaaactgaatcagacaaatagagggagaccataaagcttagtggttaattacataggcaataaaatcagacaaatctggatttgaccccaagaaagttactttacatctcaaaaccagtttcctcttctgaaaacgaagatgacagtatcccctcaagttgtcatcaatagaacaaaatgaaattatatctgtgaaatgcaatgtgcataaattataaaataagcatttgtctattgtggccaatcatcctcattgccataattataactgtgcataattaagtataaaggtatgcacaggcactatggagtaaagaggaggggcacttaaatcagtttctatggccgggcgtgatggctcacacctgtaatcccagtactttggcaggcctaggcaggaggatcacttgaggtcaggaattcgagactagcctggccaacatggtgaaaccccatctgtactaaacatacaaaaattagctgggtgtgttggtgcacacctgtaatcccagttgctccggaggctgaggcaggagaatcacttgaacctgggaggtggaggttgcactgagccgagatcacgctactgcactccagcctgggtgacagagtgagactccatctcaaataataataataataataataataataataataacaaaataagtaaataaataaataagtttctaggttcagagaaacccctgtctgccaaaacagcagatgctttgtaggtatttgagacaaagtccacatttctgagtgtgaaattgtgtgaatcattataagagctgcaaactgatttttatcactgaaggtaaggatgctggggtagggatggaaaaaaatggtacagtggtaaatgtggccaaatccaagatcttgaggattaaactaaggaatctgaagccttttaatctgggtgagaggctactatagtaacatgcctgaattccatgttagagagtcaccgtggtcacactgaggttctctaaggctctttctcttttccctaattataagaaaaaagatgaaagcaggtttgcaagaatcccaattgcactgtatcatactggaggctttagaactgtcaaaacaaagtttctaattttgactgtagtcaaacactttcccaccaagcaaaaagaattcaatatacagttttatttgttttataaatagtttagtgaaaagaataatatatgtgacttgtactagctgaaaaatgtttgcctagtaaaactttatcactggatgtgaatgttctaagcctaaaagacacacagaagtaaataaaattgatgccacacctttacaaaaaacacttcctaaattgccggtatcgtggtgaatggaatcatttaacaagttactgtcagacaagtgaaaactcctgtcaccttctacgggatttttcagaatatgctccctagatactcaagctcctacaaaggtcaatcagttgatgaatcaatagctattctacaggaaatctccatcaccataattatctgacccagacaatttcagtgattttttttttactattctcaatcaatttgttcttttttgtacaatattttcaacgaagtgatttgaaaatatttttataaactaataagagagaaaaacgtgacacatagcattatagtgtacaaaagcctaagatctactaattactaggaatatgattagagaaagttataaaatcttttctgtcttattatttgcaactgaaacatgggaatgaaaggtaacaaactcaaaaattgttgtgaagattaaattaggtaatatatggaaagggtaattgtcaagtatgtacctgcacataacaggcattcagtaaatagaagtccttttattttttgtggctctcttcagtttgcgctccaccagtctcactgctaccccaatttcccaacagataggtggcaggaaaacacacacacacacacacacacacacacacacacacacaaacgtgcacacacgcacatgtgcacaaggcttcaaaagtatgttactattataatgtttctacgaataaattggatagatggtaaaaatgaacccccaccttttattattaatatcccaattctggataaccgtttctctgtattctgggtgggagagaaatcccagcacatatgtcataaaccaagtgctggaggtgcctgagccttcatcctttgttatagcataggggtaaataacccaagctacagcagtcaggctggcaacagaagtttgaattttacaagcataacacaaagaagaagggggtttttagacattggattcatcacagaggcatgcagcaaacatttttccagcaggactttggctgtgcagcctgaagttcatcatcaagaacatcctgggtcttgcctgttttccaaacctgacctgccagatttctctggactctgtgagctcctgaaatccttctacatatgctctttgcacttggagtcacagttggttgtttgcaacccagaaccatgtctaaggaggagggtagaattctgaagtcagaagatattccatgcttcctgatattgatctgtagcaaaatttaattagaaatagatgctagagaaaagaattttaaaatgttccctaatgtcttttatagagcaaaagctaatattaagaaatttgcttttggatccaggcaaatccctagtctattcttggagaaaattactaccattaaataaattcaaaagtctgccacccagcatgttggccgttagcacagctactgatttataaagaaaaagctggttgccagaataacataaaacccagactacaactcatcctttatggaaaaatcaagaaagaacttcttttttcttctctagtcatctcactatggtgttaatggagtattcgtgagattttcgtcttataaggccacctctcattatactcttacttctggaaaattctctgagcctgaatctggaaaattctctgagcctgaatctttcctcatagcctagaaaactcatactagtctttgaaaatgcaactttgtcatctatgactgtttcttgtgtttataaaacaaaacaatagaaaaaatctatgatgtctaaacagtgcttcaagatgatgtattcagtaaaatattgtattattataaaagcaaaattaaaacctcacatgtagaccacaaatataaacttattaacttgaagctttgaaaaaagaacacaagacctagccaaagagctgcaaagctatggcttaggctggttccttaggagcagagcctgaagtggggattctgatacatagcaagaagctgaagttagagtctcagaaagagacagtgctggcttccatcttctataaggccacctccactcttcacactcctgcaatttatgtgaatcaagcaactccccctacctttttatatttatttatttgcttaagctagtttgcattagttttcgatcatttgcagccaaacaatcctgattttaaaagtagggagtattaatttgagaactgctctccttttaggagaaaaagaggccaacagtaaccagaacccgtttagaaagaacaatgacaacaaaaagtttcttctgagacctagcctggaaatcagcatgctccagatcttctggggatcacgaatcttatgacattctattattttataagcaaattttggtaacttctgtgtctctgtgtgactgttctgattcatgtctcagaaaaaaggaaataacatctattagatcaaatttacctcctaattctctcttcctagttgtgtaagcttagagcagtcacttccttcttggggagccaaatggaaagccatatgtagatagctggccacctcaaaaccaaaggcctggagaggaagagagaggtcctatttcttgtcagagtcataggacagggattagagaaatttcaaaatgtctggcaaactgtctccaaaacactatgtcaatatgggtacttcactccaatcccagttgtcaccgcctcttacctggatgacttcaacagccttctacctggtgtccctgttcccacacatacctttctgcaatccagctccacatagctgccagaaggatgcttcaggctttattctggcacactgcttcattttcttaatggtatttatcacaatcactagacttctagtttatttattgcctctctccttccactagaatgctaattccctgagagcatgaaactagcctaattcactgccatatttccagcacctagaactgtgcctgacacattgtatggactcaataaacaaatactgattgcatgcatggataaatgaattctgaatggttctcagctttgtttctttttttgaaaattaaagatggaaaatgctgctgcttttttttttgagtcaatttcaagtttctccaggaaatcgtcttaaagacaacacattccttgaggacaagggtcacgtcattgtagcactaccttacacacaatcagtattcaataagtgtctgctaaataaattataaatcatggctcctccttctgccgtggtcaaggtaattttttgttatttttctgcttaaaaacttagtagaactcctcattacctaataatataatgctgcattagtaatactactctgtatagttattggtatagtatttttatctttaaaaattaaaaaaacctttaaaaataaaagatgtctttaagtaaatttagtattgttatgatgtgtctgtatctggattctttatctggccagcattttgataggatttctttgtaatttggtggaggtaatattagttttatcttattttattttgagtgagaagaatcttattttaaaactcatttatgtgagttatattaataactacaaaacaatgatttatactagcagggaaaaactgttaaagtttttaaacctaatattttaatctaacatttttatcgctaaattttcttttaatgtgttccttttgtcatttattgattttcctggatttgacataacaggtattttataagatgatatatatgctaccttttgttcacataaattgaaatagctaagtccctttatgtttgccatatttaccaaagtacctggcacaaaatgcaccagaatctagggcagtcattttatgtaaatgcacatgagtttacattgctaatataattgttgatccacttataacttgtgcaataaagtatgtatgcagtgactgagttgtcagtaaaaaatgtaacctctttgtgataaaacataatagtaaaataaaaataaatgtagtattgctctaactaatccaagagctagtattagcaccgaagggtggaagcaaaagggaggacagattctgactcagtcaatataagggaaatgaatttttctaatacaaagaacagctcaagatgaattggggtattctaaggcatcatggcatggaggaaacatggacaaatgaattctaaatggttctcagctttgtttctttattgaaaatttattggcctttcaatcccagcctgtctacttaatagctttgctaccttgaacaaatcactcaactcctctcagctttagttttctcatcataataactttggcgacaaaaatgcctatctcatagggttattgcaagaaattttaaaaaaagtatgtgtgagaaagagcctggcacaatcttggctctaagaaaattcctagagttcttgaaaggtaaaaaatttcctattattaagggtgttcaacaaagtgtaaacaaagctggaacaatttcactaagaatattctagaaagatatcaaatattagatgagttgttttcctaaacgaggtttgtgaattcaggttttataatgcacactctcttattttacaaatatagaacagtatagaaaatcaatacaaattgcccaaaatgaaatacaaattctcattcctaatcttaagcaatctacttatgtgtttctccctttcccttcagtctctatttgactatatctatagtttttgacattctcaaatgtacttctacaaaaacagatctgcttaccattcccagcacatctggttcaatattttccgtggtgcatctgcacagatccactgctgcttcccctctctcaccgattctaggccaagctacttcccactcctcttttaaagcaacatttaaggaagaaggcttttctttatattaatgtctctacatctccatctgtcctcagtactcgagggctctgatgctctacccatctaatccattaggcaaccttaagtggtcttaaaacatgaagcagatcaaatcattcccctacagctttcagttgtttttcattgtacttgtggtagaaatctaaactcccaaacaaaaatgacaaggttgtgaattatctggccctgcctccctccctagctggccttgcaggcaatctcttttttactcactctaatccatccatctggccttctttcagttcctccaatgcttccagtgtattcctgcactgacaccttcacatactgctctttcttccttgaggtcttatcttgtaagactcgtcataaatgacctttttcccagagatgccctccctaatcccaatgcatcagtaggagatcttccttgacactctctcaaattacctttctcttgccttcataaagtgctcgtttttgatgtataaaaaggtatgccagcatccatctgcacttctctggtcaagtgggcagaacaaattacattggagcagaagtttcagaagaattacttattctggtaaatttggaatcattagctttacacaggggaaattgtgtggtataccaaaggaaaacccacacaacactctgtggtcacttgggaagaggtagatggtgcttaaggggcccagggacttctggtcaaagaggagatcaagaaactgaacctcttctctcaagatttgaagccaaaaaacttggagcagagtggatttggccacattcactacagggaaaagacatacaagccttaaaagaaaacttagagaaagggaaaaactgggtatggtggtgcacaactaatagtacaactatgcagaggctgaggctggaggatcacttgagcccaatagttcaaggctgcagtgagctatgatcacaccactgtactatagcctgggtgacagagcaagaccctatctcaaaataaaataaattaattaaaaataaaaaataaaagaaaggggcccggcacagtggctcacacctgtaatcccagccctttgggaggccgaggtgggcggatcacaaggtcaggagatcgagaccatcctggctaacacggtgaaaccccgtctctaccaaaaatacaaaaactagccgggtgtggtggtgggctcctgtagtcccagctattggggaggctgaggcaggagaatggcatgaacccaggaggcggagcttgcagtgagccgagatcgtgctactgtactccagcctgggtgacagaacgagactttgtctcaaaaaaaaaaaagaaagggaaagacacatttctcaggagataatctgagtaccacccagagcctaatgatcccagaagtaaggctgattctagagcagcatgtggcctgaggtcagcagccctttgagtccatgtactcactctggcagtgtttgtgctcggagaattgcagctgagcattacagctggagtcacaggtgtgaattaatgtgctccctaattatggagtccaagcacagacccagtacagttggggccaagcgtgttccattagggccatcatgctgcactggaccagccgtgtcctgcccacatgaggccaatctcatgtgtgatagtaagggcaaccacagtaagacctatccgactagttacattggcttattggaacgactgattatctactgtctgtctaccttagtagactgaaagctatgtgaaggaagatagcattccatttggcttaccatcgaggctaccacgtagagctgcacagattgcatactgctcaactccaaagattgtcattgtcttacaatataatgtgaatagcactctctcgagcaacgtaactgctcaacctttatagctaaatgaatccgtgctgaccaccactgtattaccagagtgatgagagtggcaggcacataacaagctctcaataaatatttatagaatcgctggataaaagaatgtgtgatctattttgtccatttgcatacatttctatgctttttcctaataagtttttacgtattttcccccatatatctgaaatagtatgtccaatagggacgatttaatctatttagagctacaggaagtgagaactgaaaggaggattagagtcgttaatcgttttatcttaccggttagaaaaggaaagtccggcaagataaagtgacttagatcacatggcaaggccgtgaccagatccaggtctcttgccatccagtgccttgttctctctgtggcactcacttgcttctttaataactttcttctgttcttcttatgaagcagagaggagtcctcacaagtcgggggtcacttaatcactgatgctactctgtggctgaggagctggctgttgaggcattcttctatttggggaaatatgaaagtgtgtgatctgccaggagctctgacccaaataaggttgttggtagcaagatgttaccagtgaaatttcatacatcaaacagcaattagtgctccactttactgtcttgtgaatttctcagaatgaatcttatcttttacaatcactctttcatcattttcaacattaatcacacacttcttttttccaaatttttatgaatcacaacagcagcatattctcaaccatagaaaatgacatttattatgtgttcagaaagagagacaaaaagatatacaaatcaaatttactctcaggatataacaaaaaattagtggaaagtatatgttttaaattacacttaatatttggggaccaattattgcttgaaataaacaggcttccagttccaacatggccttttgtttttgtattaccaagagtttttaaacagtaatggtatctggtggagaatttatcttgtatctatattgcacaacttttgcctaaattagtaggcattttcttttttctaaaaataaagtgtgaatactcaagcctcctcttccatttctgctaccatttttcattttagatcgatgatccttcaaatatctatcataaaattagttcactaaaataatatttggattttaagtaagcacccacataagtcactgaaatgtcctccctataaatgtggtcccagagaatatctggaaaggccactggatagaaaaataacacattgtgctatttgcaggccacaaataatattaatgtgttgtcaggacctggtcaaactgtatgaagcagtttacaactctatgattcacacactttggtctgacttaaggcttgtgtaaattcaattctgggctgtcagtcagcagcacaggttctgttcagtcccaacatttctaattgcctgtgaaaagatgaagacaactgagggagagactctctcaagaagtttgcagaatgacttgatcctagacaacagttagatgcacaattagttcaactcaagattccattgagaataggtttgtgcacatataggataacaggaagacgaccctgactggaaagagctcacatgagaggctgtgggtgctagcaagacccacatttaactccaacacagaggaatgactgttcaggtggggaggggaactgttcactgcagataagtcctccccttctcagggccatcgagcagaaaagagcattccagacctgtgacagaggtcttcaggacacaaggtactagctcttccctcaggtgtaagggaaaggggaaatgggatcagtgtgttttggagttagagagctaactagaagctgtaaaagggaacagattacagggctgagagaatgcagaggagggatggtggcagggggagggaaggagggatgaattacaataccttataaaaatttaggcaccctgtaatcccagcactttgggaggctgaggtggatggatcatgaggtcaggagatagagaccatactggctaatgcagtgaaaccctgtctctactaaaaatagaaaaaattagccgggtgtggtggtgggcgcctgtagtcccagctactcgggaggctgaggcaggagaatggcatgaacccgggaggcagagcttgcagtgagcggagattgcgccactgcactccagcctgggtgacagagcgagactctgtctcaaaaaaaaaaaaaaaaaaaaagaaaaaaagaaagaaaaattaggcacagttggtttaccatttttctttctgtttctgaaagttgcattctccaccacattttttccccaatgaactataactaatcaagctgtgaaacactacttgcctcctttctccagtttgctaggagaaaggtctatctcaacacaagagtcaacactactatccagtaaaacatcacagtggtattcctcatatggaaggaatgttcccagcttgctaaaaggactcagtaataaagtattttcatagtactgtatactaccccattattttcacatatgttaatcttgttggttttcattataacactgtgaaatgagctgggtaggcatttttgtttcagaaagaaagagagagagagaaagaaagaaagagagggagggagggaagaaagaaagaaagaaggaaagaaagaaagaaagaaaaaaaagaaagagaaagagagaaagaaaaaaagaaagaaaagagagaggaggagagggaagggaagggaagggaaaggaaaggaaaggaagggaagggttcataaagttatcaagtgaattgtctaaggccaaaagtaattgcttatttacatggggccagaccctgtcttctgatttggttgctcaagtattcagtcaaggccagcgcggtggctcgtgcctgtaatgccacagcactttgggaggcagaggcgagaggatcacaggaggacaggagtttgagaccaaactgcccaacatggtgaaatcccgtctctagtaaaaaaaaaatacaaaaattagcagggcatgtggtggtgcatgcctgtaaccccagctactcgggaggctgaggcacgagaatcacttgaacccaggaggcagaagttgcagtgagcccgagatcatgccaatgcactccagcctaggcaacagcgagactttgtctcaaaagaaaaaaaaaagtattcagtcaataaacacgtattgggcagaccttatgtggcaagcaattatgatagttcctaggaaaaaataatgtgcaagacacacactgtacttgaccttagcagaactaaaagaacagaaagacaataaaccaatgtctccaatgaagtgtgactcagactgtgaaagggaaatgcggggtatcatgagatcagggcacccaatcacggcctagagaggatgaaggaaggcttcgctagaaaatggcttctaacttgagatcttagccaatccaagagaggtgggtgcttggcagatattgctgaatggctgaggggtaaagtggcaatgaaaaatggagaaagaagtgctctgtgtaaagagagcagggtgcaggaattcacagagagttcccatgttgtatgtatctcagtcatatgctgcccaactgtcatttctgtataagaatcaattacagatgttcctcaacttaaaacagggttacgtctgggtaaactcactgtcagttgaaaatattgttaagttgaatatattgtaagatcaaagatgcgtttaatacgtttaatacacctaacatactgaacatcatagcttagccttgcctatcttaaacatgctcagaacacttacattagcctacaggtgggcaaaatcatctggcaacacagtccactgtggagtattggttgcttaccttgtgtttgcgtggctgactgggagctgtgcatgcatcaccaaagagtatcatactgcatatcactagcccaatagaagatcgccattccaaattccaagtacagtttctactgaatgtgcattcctttcacaccatcatgaagttgaaaaagcataggtcagagactgtctttactatgtttacagtaaaatgttgccatatacttaggggacaagatataagaggaacccccccaaaatgaggctccttcattggttaccatctttatgaaagttggaagtttctagggaaaaggaggactagagagattgtctaatgattctcaagaagcacagctggcaggagttgaaatacaaacttccttcctgtctttttgtaaagcaattggaaaaaatgggagagtaagaatttgacatgttacagttgtagatcttagtgttgtgaggcatgaatgagataaatgtggaacactggcaggttgcaaaaatgttacgcagatgtacagcgttttaggggggacttccctgcatttctgtcctgcaatgcaagggcagaaccaaaaactgaaacttagcacccagtatccctcacctaccacccctctgcaccctcagatgaatcatagtctgttacagatgcctgtggtgcatattcctgagtgttagtcccagaaaactaaacctatggaaacttttataatttagttgttgaccttcacagcttgttcaaaagagaagggccagtgactcacaattatattacaacttcagaccatgtgaatttcttcaaagatgatggcttaagaagtgtttaattcttggctctttctgataaactcaaaagagtgaagtcctcatcttgtcattcagggactaaccatctaaatttgttttcttgaacatttttaaaacatcattcccattgatctagtgtgcaccctttgttctcattgggctgggttttgggacacacttgctctcagtcatgaagtcatgaaatgaggttatgccaattcatcttcctggaaatctcctctggcaaattcagactgacttttttctgagagccaaaggcattaattacatcctatcttgtattataattctttaaatatttcactcataaatgtggaaattctgcttttctgaacagattataacattaatcagttttataatcatagaatattttgttgaccttcacacctttttcaaaagagaaaaattatagaatatttttcctacaatgtggattcatatgtttaatcactttctctgaagcaacatcctgaatatggcagaaagttgaggcagaagagattagcaattgaataatacttttatatgctataaaacaacattatttctgaaaataattcatcatacatatctaccacatgtggcatattaaaggcaaatttcgcttgtcaaaatacatcagtgactccttaactaaaatgaaaaaaaatcacaactacattgtgaaatatcttcttgaactgaaacatctctgtatttgtggatactgagcagggaattcagtggttcaagattaaaggcaaaagtttctaaggctgcttttatccagttccaagattgatgatgagaaactgtttgttgctcatacctcacttttcatgatgttcatagctggctttgtatttactgtttttgagatagcttacagtattagccacattctacctgtttgggagtgccaagttataaaagtacaaaatgtactcatagcttcctttgaacaaaatcctaaggttattcccatttctggaaatttagctatcaggtcaaacaactgagctatggtgagcatcattcataaaatataaaacataaaataatgataaaaatcaaatagattgcattgctggatgaactggctgattgcaacagaatgacaatgtgatgccttacataagcagtaactaaaaactgtaggtcatctatcatggtgacataatttcccactgtactctcttaatttcacattttatattgtattttgcaaaatttctgagaaaaagaaaaaggaaacaaagcttttgtttaaggatacataaacctctatttaagtatttatgtagtgtgaacttgtagctgttgggacattttcttattatggtgtttctgtactaccaagttttcctgcagtaacaactgaatatttattatagtcatgatagtcttccaggatatactcagggtcctttcaagtaagaagtttggacaattagaatagtatcctacacccaacttaacgaatgctagcaggaaacctatattacactcatagttagaaaaaacagcgttaatctctcattttaacactaatatgctgaaaattcaattcactaaattctagtgtttttattcttataattctctattaagaaagcagctttgccagtttcttttctttgtagtaattccaactttgtacagtaaatctttttgaagatatttggagttttttttttgttttttgttttttttttagagggagtcctgctctgtcacccgtgctggagtgcagtggcgtgatctcggctcacagcaacctctgtctccctagcctaagtaattctcctgcatcagcctcccgagtaactgagattacaggcgcatgccaccatgccccgctaatttttgtatttttagtagaggcggggtttggccatgttggaatgctggtctcgaactgctgacctcaaatgatccactcacctcggcctcccaaagtgctgggattacaggcgtgagccactgcgcccagccgatggaaccattttctttaaaaagttctcatttctcctaggccgggcacggtggctcatgcctgtaatcccagcactttgggtggccgaggtgggcggatcacctcaggtcaggagttcgagaccagcctggccaacatggtgaaaccccatctctactaaaaatacaaaaattagccaggtgtggtggcgggcgcctgtaatcctagtgactccaaaggctgaggcagtagaatcacttgcacctgggaggtggaggctgcagagagctgagatctcaccactgcactccagcctggagtttttttttttgagacagagtctcaaaaaaaaaaaaaattctcctttttgatatgatcacatgtttaatttattttgtttaatgtttttataattgaattaataaagtacccagtaaaatgctataaatcaataagtattatccaaatgaaaataaattgaaattaagtaagactagtttcaaatgcagtctttcttgaaagagtgagtttggccatcctaaattacagttttcaagattgatctactttctttctgaggccaccatacttttggtactagaattaaagtgtctaaatcaaaaacacactacatggcttcgctttgacttaaaaacaaaatgcacaaacaataaattataagtctgattaactgtatgggtattttgttcaattgatttaactgcattttttttccctaggatataaatcatgtgatacagcaaactcaaagatgtgggactcaaatgacacttgtgaaaaactgataccctgtttgcctttaaagttatattaattaccacactttagtaaagtgtttactatttagaactctttcttccttcctagttggccacctgtacactccattcctcagccataaaagtaaatactgtatatctaaaactggtgctggttttgataagccatagtgatgacatcagcctgagttccaactcctggaataaagaactgtgaccatacagcgacttgtgggcagttaggtctcagcataacactccttgtcccctcatgtcactgatttggagccaaggtttgtgctccaatctaccaaaccaggttaaagaaattacatttctattttcaaatgcaagggatttaaaagtatacatggcgcacaaaaaactcaacgtacttaatgcctaatgccactgaactgtacacataataatggttaaaatactgaattgtatgtaatatattttaccataattaggaaagaaaaaaaactgcgttcacgtgtttcaaaggttttccacaactgtataatacatatagttggttatacctttgtaacagtgaccatatcgctctttctgcaacatctattaacccagacaccccagggcctaagtaagcatccattcttcaggaattagtaaacagcacttacacacggacatttctagctaaaagtaacacagacaaaaaaacctcaaaaatatcacgtaagggcaggtgttaggcaaagagcctctgcaaacatcccttgctcctctgcattgctctggtgtgaggagctaggacatggagaaacctctacctcctatctcaggattagcgaaccctgcttgagtgctacaagggtaagtaaatgctggcctgaagaagctgctgagcttccggatcccactgactgtcgttcgggcacttcctagagggtcaagcaccatggcgaaaggctgaggaggcaactcgtatctttcattctcctgcctcatcaagaatgaaccttgaaggcacccataggtcgcgcagtctttcagaagctgcaggagggctgtgactgtatggggttgcagactgaaaatcttattaacgtgaaagaggaatttgaaattaaaaaaaaaaaacccggccgggcgcggtggctcacgcttgtaatcccagcactttgggaggccgaggcgggtggatcacgaggtcaggagatcgagaccacggtgaaaccccgtctctactaaaaataaaaaaaaaaaattagccgggcgtggtggcgggcgcctgtagtcccagctactcggagaggctgaggcaggagaatggcgtgaacccgggaggcggagcttgcagtgagccgaggctgcgccactgtactccagcctgggtgacagagcgagactccgtctcaaaaaaaaaaaaaaaaaaaaaccccacaatatcaggctacagttatcatagcaattctgcttttaatgcactcaggacaaacttctagctctgcatatatgtcatttcaatgacacatcctgtctcctacccgactagaatgtgagcagccctgtgatctctatgtgctcataaacagtgcctaatgcgaatcctggctcttggaaggcgctcagctagtaagtgaggagctcagctctgaagctgtaaccaagaccgcgcgggcaggaggaaaggacacttcagcgctctgcggttgcaaacacacccctgcgggtgctgccacttagcaaagtcttaggttcccgcttactcgcacacgcatcctgacttcccccaaccctggaactacctaccaggagcggagaccagcagaccgacagcacgcacatgatccccataagctgaatggccgtctcggtcgtgatgcggccccactgggcactggactgagatgccgtggccttggcccggcagcgggacaccagggccttaatggtggccaggttgcaggaaaaggtgactgtcagcgccaagagccccaggaaggcaaaggcagaggcgaagaaaaggttgccccagttatgcgaagagctagtcccgttgccccctcgcccggtgctgatgaagcaccacgtcccgggccactggacggtgtactggcccacgcccagcaccggcagcagggcgaaggcgagcacggccagccacacgccgagcagcacagcgcgggtggcacgcgtcttcatgtggctcgcataccagtgcggcgccctgatggccagcgcccgctcgacggccatggcgctggcgatgaacaacgaggagagcccgaaaacagtcatggtcagcccgaaaaaggtgcagagccgccccgacgggtcgatgtgctcccaacgctgcttggacaggtacacgacgatgacgaccggggtggtgagaagctgcccgaccaggtcggtgagcgccagccagccgatgcacagcaggaaggacttcttgcgcttgctctcccggcgccggtagctgcgcgacacgagcagcatggccagtgcgttgcccacgaaaccagtgagcagcatggtgatcgggaaggccacggacaccgatccgcaatcctcgccagaccctggagggcgcgtgaggttgccccgcgcctcggcggaacgctcgggcgcccacatgcctgtgtaggagtggttgaggcgggtgcagaagggggcatcccctccgtagccccgggtctccttcatgttggcttcgaggtgaggaggggatggcgtccagagagccgcagcgggagggggcagacgcggcgcgggcggcggcggaggtcggcgtttaccgcggctggggctgggctgccccccatggtgcggggcgcagccgccgccctactccgctgctgggaccgcggccgcggcggcgccagggctcactggcccgggagggagccacgccttcctctctgggaaacctctggt

SEQ ID NO: 1471 - DNA, 41955 bp, Homo sapiens
tcataatgacttttaaattttatttatgtatttattttaataatcacaattgtacatattcgcagggcacagagcgatgtttcgatacatataatgtatactggtcagatgagggtaattagcacatcatcatctcaaacatttatcatttctttgtgttgggaacattcaatagcctccttctagctatttgtaactgtatattagcattaactgtagtcatcctacaggagtatagaacactggaacttatttctgttatctctcttatctagctatgatttttgtatactttaacaaaactctgcctatcctgaaatactaaagaatcaagattgtagagacaataagatctggtcctaggcctagaacccccacatgggaggaaccagggacagaattctccttggatatcttttctcacgaagaaagagggatacttttaatgagcttgactttgcagtctacatttgacagagcttctcccttcattgaagaaggaagaccaatagtgacctcaataagtacatgaacaaatagctggggatcccagtattcataaccaccaatactcagctcacaccaaaactcaggcacaagtcaattaaagggttgtactatgagcaaggacaattcttattttggctgcctgtaaattacaccaaaatccacaagaaagggaaataactaagcttacaataatttataaatgcactctgtgttaagaacaataatcttgagataataaaacaaagaaacatcatgttgaaaatcggaaaagagcaactctcatatttatattaaatcaacaataatttgttatgcacatgattatggaatataaaacaaaatgatctaatttttccagatagcatggggctgttgcattacattgtgctattatttgacaaagcacatcaaatgggatttcagcaaaatacttaacatagttataggtaaagtattcctgacgtgagttgacatcaggaagaaaacacagcgacatttcagaatattcaactttattttccattgacaaacacgacataaataacacacatttattaaatacacagactagccatgacttgaatgccagcaaaagtctaacgtacttttcatacgctcttttattttttgtctccacagtattgaagaccagcctttaaaacatactagaagatatatttaaatacactgacgataactacccataaaactttacatagaggtgataaaagagacttttccatttaatcaagtatatagagatggatgctgaggaggagaggtgaagaacactatgcttttgatactgatctttacaatatggattaaagtgccaatgatttcagctcctcctaggcacaccatgtaaatagtacttacattcatttgttacaaacagatcaaaataatcagtgcctattttaattggtttgcttaaacaggcttacactatttgtacaaaaacatttgataaggagagcaagaaggcaaagtatttttttctctttcaaggaagagttgggaaggaagagagttcagcagtcaataatggcctgagtgaacttatcatttgctttgacagacaagacccctggccactcagtagtactactgatgctcaagtgttcaaagataaatgcagtcggtcccttcctctctttgcttccagggcctggcacaaaatgatgaaggttaacaggtagaaaatggacaggttttccatcatatctttttctatgttctctgccccacccacatgagtatcctttcaaaagtagaacgttgaagtgtattagtaaatcacacgcatttccctctgcttaacattacaactttgatttctacagacatggaaaactgtatgagaaatctatatttgaattactattaaagtttaatgattggctgtttttgcctagacgtttggcttactttaattaaaggatcaaaatattctaattctaaagcatttaacaatagcattgaagagatgcacaaatgataataacttgagaagtggaatcatctccaaaaatgctcaaaaaagcatgaaaaggctgacttgtttctgatggtgatctctttccttcttatctttactcccataataaattcttcaacaaagcagacttactacacaacagattctgatctgtttcacatattaggctactggcactttaaaaatatgaagttattatctctcctcttaaaaacaatcccagcctcatcaacaggaattatgtctgttactttctttctgtgaaagaatggataagcacagtagagtcaaggggactaggagaaaacagtgtagtttcaaatgaagaaatacataatctagtagatatctgggttgcttattacatgaaactgattgatacaaagcttctgaaaataagataatttttattctcagtaaagaaaatgtgtgacataaataaatataatacatatctgattgaattatatttctagagaatcataatgcactctgcttatggtatcataatgtaatggtatatgactaaacttatataaattataacccttaaatagaatcttcattttaggaattataaaagggaatatatcaaataaaatattttccctaattcttttatcatcatcaccacctagttagtttccttacaatactgaactgatgtcagcttcttaacaaatatgtatgtgagtttaggttggttattaaattttgtaaattggctcgatcataacctatgtcatgaaacatcacagacatctgtcactttgtcagcactttgttgcaactcagaaaagtcttatggactaggccacagttgcacaattctgcacattttttagacctcagttttaacagattttgagatatgtaaacatataaaacaagcaataaacaagcagctgtgaaaatttgtcattgttgatggtttgtacttgttatacagataaaaaatagaaattttaattcttcaagttaggctttttatgtgtttgtaataataaatactctgtagtctccctgtgtcattcagctcctagaatcctgtgtattgcaggagaagcttttggggttaaattatgaaaataaatagatattatgcatgtctaaaatttcaaagaacaaaagttttctattttctttttctgagttgatctcaaccaaaagaactattagtgattgctgatgtggagaaggttgaaagctgaccaataatttggagtcaaaaagaacaaaattataaaaagcgttgaataaataaaaagcctaatctacttgaaaatccaatattagaatactgccacagagtgacccccttattaaaatactgtttgccagtttttagtttgtctgtcactcaatgccaatgtgctcacaggatctttcatagttaacttacatgaggttttgcattattttctgcaacatggtcggatatttcataaaataaagaaatgtaagtagaaatatatgtataccctatatttcagactagtttaaatctggcatgattaaacacttacatttacctaaaatatcttgggatatatacagcactaggttaacttggtaaatattgagataactcatttttgtttcttcaacttcaagatatttttaagacattcatcatacctattttatttgaaaagtaaactgctctcattaagtaacatgtgatcattcttctctgtgactcagcatagtatataaattcattgtttggaaaatcaacactacttggtaaaattgacacttgctaattttacatatatttctacatttcattcgcttacttcttccaccatggttttcttggcctttaattgtcttttaaccaatacttcaaaattcaggaattgtcataatctatacatgcatttttcctgattagacatatgtatggacaaactaagtatacatgagtgaacttgaaagccaataaaattaaacttagacacgtctttctgctgtgactacatatatcctctttctaaccaccgctctagtctctgtacatctctgaaatctaacctcaaccatcatgaaaaggctgaaatcatttgggattttcatttcttatcaggtttccccatactaacgaatgcctagataataaaactcatatgccatttacataatttctttgttttccacctccctttcaagcttgttaaaaaaaacacaaaagctgccattcatcccctcctaaaatatatcccctgggcaggaatttaatttgcagttaagaataagtgtcaggttttttgcctttctgtatttttgcagtttgatgaaaagtgatattcttgtgatagtaatgtccactatcatttggaagtatcagtctcctaaattattagtataaataaagcactgtgttgtacagcagtatgacactacacccttgaagataaattcatatttctgtaattaaataatcagaaataattcactttatcagcctgatggactgtaatggcatgaagcacttcaatcatatggtatgtgccttgccaatgtgtactgtcctggcaaacttctgctcattgattcactgaataaatatgtattagacagtttctatattccaggtgctatactagatgctggaaggaataacctaatcatgctcatgccactcaaattcacattgcctctgtgtctatctgactagaacttagggtcacaggaccaaccaagaggtaaagcctctttattatgtgatttcagtgcacttttgaaaaaaagtaggtagttttgtcttatacccaatgagatgacctacaggataatccaattctatggcatagagagattttagtatagtctatttatcaccttttccaaaatttagattagtagaaccatcattaattacataagcactctcaacagattttgtctccaaattcaatttgacatggtcatttaaaataattagccccaattgacataggctggtgtatatatcaatctgatagacatattgtacctatcaaaattaattctttaccactaaacacacacagaaatatgcagttactacaagaagtataaataaatctcaagcttttaaaaaactagaaaagcagtgcaagaaactgcaaatgaaaatcttcacaataaaaagttaatgggtttacaaaatgaatgcaccaaagaatatggcaagctttgtgtaggcataactacaggattactatgtttggtggggagacatttttaagaagtgcaattcccaaaacttaatgtagtgatctacttgtgcacaaatacgtcaagcttagctattgaggtttgtattcatgtagactgtaggaaaaacattttagtaataaatatttagatagagccactttgaggagcaggcagaagagctgtgaagggtcaatgttattaactttcttatataaataggccaaaatatggaaagtattcattgagtcttcaaaatatttatttgttttggaatcagtattggaatttaaagagtcaaagactggggaacacttttggtgaataatcaagggaaatatatattcagagtacctatagttagtgctcaaatcggtccttacatagcattctgaaaaaccacttcacgactctcataggtcagtttcatgaatcttccttaggctcatagaaatgtaaaatatattcaaaagaaagaataattagcaatttgggtagtcacaaactccatatttcaaacaaatggaattggttcttattcagataaagagtaaacctaattatcaatccaagtaaacttaaactttgttaggttaggagctaatttgctgtattgagcaatatttgaataatggtatcgatgaatattataaatacattatacatttttaactgtaattaaacttttctttaatgtaaggaggaaaaaagtgacagaaagcgagagaggcaatgaaagagaacacagcaatgtctttgaataaaaacaaactgctatcccttgtcttcaatgatgtatgtggttaaattcctcatgtattcagtgtactggaatattaactatccccgctccccaatagaccaagatcatttataaaaaatgttttcatcacataattaatcacatattcagctacgaatggcagactcaacaaaaacactagactgttattaatatattttcctttgtttgtgtttcactacttttggcacatagggattttctatgcttctaagaccatttagctttataccaaaaattccacttcaatgcataaacagtggcatgccagagatgcctaaattcacagtaaggtttagcgatatttgttaccaaaagctgtgcacatgcaagttaagtgttttctttcatgcttctgtctgtattatttcattagataatgagataggctgccctttctgtccatcattagagcagctggagacagcatttgctacctggcaaaactttcgaagaaggatctttcttaacagcaggtaaacccaaggatccaagatctggttcagtgaagccaggcgaacagctattaagaagaagttgcattctttctgcttctccgtgtgtgtcttgcagtgctcaactgatgtctgattgaagatcattttcaacatcattatctaagaaaaggggacaaataattgtttcaaagattagtaaggtcatatgcatctcctctacactgtactttgcacatagttggttttcaataaattggttgttggattgaaatgattaattcaagcaacatttatacttggataacacagtcctgaattatacaagacattcctaggtattttcccacatttgtggctatttatcatgatgtagcttttaaaacatgcatgtcttcaggctcttgattcttggaatttaagaagcttgaaaataacacatctcaaaatgagccaaagtcatgtttgttgcagaaaacaccacaagttcacccaaatgagagccaacacttcaacaataacaaaaacatcttaatcttaaatttccagtagttctaattttaaaaattactgcagaaaaagtagacgcaagaaaggaggaaatattattattattattattattattgccactagcattttcagaatccttactatttagcagacatggtgccgagttcttcatatgcatttaataaacagcataacacaggtagtattaccacttccttctggatgagccagactaataccatatgatgtacaatattatacttttctttgcccccacccaatatacactgcaatgtaaactccatgatagcaggaatttgggactattttttccccaagtgcctagatcaataggtagcagatagcagatgttcagtaagtatttgtgagagaacaaatttttatatttgaaggaatatattatacaacataaaaatgacagtatatgagttatatgtatttgtgcgagaacaaatttttatatttgaaggaatatattatacaacacacaaatgacagtatgttatataatatgtatttatatttgaattaaaaagatgttcttatgcatattaaaaatgttcaggccaggtgtggtggctcacgcctgtaatcccggcactttgggaggccgaggcaggcggatcacttgaggtcaggagttcgagaccagcctgaccaacatagagaaaccctgtctctactaaaaatacaaaattggctgggtgtgatggtgcatgcctgtaatcccagctactcaggaggctgaggcaggagaatcccttgaacccgggaggtggaggttgcagtgagccaggatcatgccattgcactccagcctgggcaacaagagcaaaactctgtctcaaaaaaaaaaaaaaaagaaaacaaattggaactatttcacctgctgtttcccagctatgcaactcctaggaatatactgtccagaattcctgcaccaagagtactgtatatgactgtttcataacagcattgttcataatagcaaaaaaagcaggaacaactcaaacatgggttcacaatcccaagcaaagaaatgagctgagtttgtaactggctcctaagtttcccattctagacctatacagctattgagtacttgacatgtagccaaagcacactgaaatgttagaatatgttgattccataatggaataataatatttctatatattgtgttaaataaacatatattattcaaattaatgtcacttgtttcttttgactttttaaaaatgcagctactagaaaactttaaattatatgtggcttgtggtttttttttgctcacagtacatttctattgaacctaatctctctctcttgaggcttacacttatctgtatgttctgccctcaggtcacataacttaaattgaattcaacatccctgagcatccaaaacatccctaaccacttaaccacaattccagtgatggcactttgatacactcaccctggatcaacatttcagagtctgtgaactcttcttttcctcatcctctgcaatgccttttgctcttgcttcactctcattcttgttcagatcttcctctcatttgaattatggtaataacagacacccagatggtacatgtacggactgaatgtttgtgcctcccttcaatttatatgtgggagccccaaccctttatgtgatggtattaggaagtgaggcctttgggaggtaattaggtttagatgaggtcatgagggtggagctcctataatgggattattatccttataagaagagggagaagaacccacaggtctctccttcagccatgtggggcacagcaagaagacagcagtctacaagccaggaaaagggccttcaccagaaactgaatctgggggcaccttgatcttagaatcttcagcttcctgaatggtgagaaataaatgtctgctgtttaagccatcaagtttacacctttgttatggcagcccaagcagactaagacagtgtttacagatatctgcccatcacaggtgcagcttccaatcccagctgtgatcaaatcctctccaactagaaaatcatcaatgtcttcccattgtccatcgaacagaaatttaactctggtattcaaagccctctacagtactgtccaaactattctttccagttttgtctcccactaattgcctatacagactccaaactctagctatagtccattggttttattctttcctccctcttggcctttattctttcttttttctacccctgcaacacttttaatcctcatcatttctacttctgagacttccaagtctttcaggactatctcagttgttcctgattattccaaaccactggcctctgaaggcctacaattgtgtgtgtgtgtgtgtgatataaccacatatttgtagtagatagacagatagacaatactagcaggcatccacatgtccctcaaaaacttggacgtatgggggaagaaaatgtgggtctctaagatttaaagtggacataacatcaacacgtaggaacccagctccaaggttactgaacttgactgcaagcaattgaacaaagtatcgacatatctgaaatcgatttgctttgggaaaaaggatacttaaccatcaggtttgagtattttctattcttgttggcaaaattgactactattgtgagataaaagatgtaattgtctatattagtttgaagtaagtaaatatttgattcttttaattccccatcttctgtgtctttttccactaagctgataatgactggtcccagtgttgataagtcaacaggaaaagagagctgagtcataggatttctggtattgccaattctgctcatgtatactcaattttatttcaaaaatacaattatataacaaaaaagcaggtagagcaggttaagcagacagacaagagagagaggaaataatacacgaaaattcttacaagactgtgtgacactggtatccagccattttcccttttgtcttatttagtcacagtttttattcttaaacgaatccctggcaaaggggatgggaatttccagttttggcttataaggcaaactcatgctctggggcttgactcatattttgttttttgagacagtgtctcactccgtcaccaaggcttgggtgcagtggcacaatcatagctcactgtagtcctgaactcctgggctcaaatgatcctcctgcctcagcctcccgagatgctgggattacaggtatatgccaccacactcaattaatatttttattttttgtagtgacggggtctcactatgttaactaggctgatctcaaacttctggcttcaagcaatcctcttgtgtaatttctttcacaggaatttttccaaatgatttatccaataaaagcaaatagtagctatacaataaataaatgttcagaggagcattatatatgccagcaagaaattgcagacacatacatctctaacatcaggtgtaaagcttaataaaacaataattcacaaatagtatatataagtattaagtgaaaaaacagaatataagatactttatatataaagttttgttgttatattatttaaaataggcagacttgtggaaggcaatggaattactgctatttaacaataatttacttttaaacaatataatttaattttaaaattgtatgtacacaggccaggtgtggtggctcatgcctgtaatcccagcactttgggaggtcgaggcagatggatcccctgaacccagcagttcgagaccagcctgggcaacatggtgaaaccctgtctctattaaaaacacaaaaattagccgggcatgatggtgtgtgcctgtaatcctagctacttgggaggctgaagcaggagaatcacttgaacctaggaggcagatgttgcagtgagccaagatagcaccactgcactccagcctggatgacagagtgagacttgggctcaaaaaaaaaaaaattgtatgtatataaaaacatttcaaatgatgttaatgaaagtcttttatttaaagaaagcagatggttattattcccttctttggtaaatatggacaattatacaccgaatttacttaaaataaatatatttacatcaatatattctgatgctggctggcttatcatcctatgagctgaatgctaccccccatcatagaaggcagaataatgcccctcctgccacacacaaagatatccatttctcggtccctggaatctgtgaatacgttaccacacaagacaaaaaggactctgcagatgtgattaaggtaaaggacccagacgtgaggagataatcctagattacctgcgtggacccaatgtaaaaacaagtgtcctaaaaaatcagagaacttttcccagctgtggccagagggagagatgactatagaagaatggtcagagatacacagtatctctggctttgaaggtggaggaagggatccaggaggtaaggaatgaggatgacctcctctaaaaactgaaaaaggcaaagaaacacttttctctcagagacttaaaaagtaatgcagccctgtagcacctttactttagcccagtgagatccatcagacttctaacctacagaacagagaaatgtgtgttgctcttaagccactgatatggtctagctctgtgtccccgcccaaatctcatgtcaaattctaatcctcagtgttggagaaggggcttggtgggaggtgactggatcatgggggcagacttcccccttgctgttcttataatagtgagtgacttctcatgagatatgcttgtttaaaagtgtgtaacactttcctctctgctctctttcctgctccaccatgtgaagatgtgtctgcttccccttcaccttccaccatgatcacaagtttcttgaggcctccccagccatgcttcctgtacagccagcagaacctgtgcttttgagacagtcttgctctgttccccaggctggaatgcagtggtgcaatcttggctcactgcaaccttcacttcctgtgttcaagccattcttgtgcctcagactcccaagtagctgggatcacaggcacgtgccaccaggcctggctaatttatgtatttttagtagagatggggtttcaccatattggccaggctggtctcaaactcctgggctcagggaatccacccgtctcgaccttccaaagtgctgggattacaggcgtgagtcaccaccacctggccccaggtagttctttacagcaagtctcaggtggactaatacagccaccaagattacaataatttgctacagcagcagtagaaaacaaatatgcccacacactgagctctcaaccaatgttaagaggaatagaaggaatgagcttgaaaacgattttttcattctcatagataaaatagcctaggaagcttctttaaatttttttactttcctaggaaacttaaaaataaatgaataaagtaaaagtaaacttcattctaactcctgtcccaattatctcaatttctaaatttacaacatgcaaaaccgaatgcctgttattctagtggcatcagtcaatgtgtttgactaaaagttataaaattaatattttcaactcagttggctttatgaaaaaaagcttattaatccctttcccctctttttataaactattagaaaagttttgcttatctttttcagtcctttaccccacccaatagttaaatatatttgaccacttactatcctccagaaagtgttctgggcctcgtctagaattatctaaaaactcacttaaattatgtttttattttctctataaaataaagaattggatttctctaactttttgtgatcaggaaaattcacaaaattacttattaaaatgatacgtcagtcattttacacagtcctccttgattatttgaaaattaatttttgtgaggctaataatttaaaattattgttatgaggcaaatataggtttcatatgccttacattgtttagtacactgtaatttcctattgagaatgcaatgattctgaaattataaaatcagccagtagctggcacatgaggagagacattagctttccccagaaatcatgagatgtgcaatatagagataattggaattagaagcagtgagcatgctactgccatttccaaatggcagcagagatgaaactggggctccaaattcttcatccaattttgaacataaattcaaattagcatccatctgttgagtctttatatttaagccataattataatttctgtgtatgtgtttgcaaatatctttcagactgtttagactttgagagaaaaccttaggcatgaatatggtagaattaattattcctattagtccaattctgtgtcatacaagggagagggaccaaagaaaaagcaggatgctcagctaacagagaggctgtttactggttttagcaaacacacatataccctgcactatttctcctttcaaacagcctcatataacaaatgatctggtcaagggagtcgtgagaccaattctagctgaacggagctgcagctgttctgtcagccccttccctgggttccacgtgactctcccaggccctctagcagagctctcccttggttatcagcagtaatagagagcttctttatgcacttgagataactgggaacacaactacatcagtgacctctaaattcgccatccctgtctactgtcaagtacaattaccttgttccatcctaaaggaaaaaaatgatttaccctttccccagtgataacgttcttttaagtgttcaaagcattaatcagggaggctgtctttaatattctatccttggattttattctattgcagcaggatttataatcacacacttaaaaatctttagtacttcacttcttaatttaaaaatgccttgggttgtaggccacacatatctattaaagatgataaatgaggaaacccagaaaaattaatttatgggggaggaaataaattggttagctgcccttaggctcaattctggggtgtttctgcatttccagtttattcctaatgcaagtgtttaagagaagtttcctcacaagccaatttttatctgcgatgttttgttttccgtaattctctgttgttaggttatgggagaataacctgctctactggaaattcccccctataatttgataagtgtatttcatcataatacactaaaaccagtctgggccctttaaactagttaattatgtaatttgaaggatttgcatgggaagaagcttcactgtggattaagaaacaattgtagtctctccaatctggttacaacagttctccagttgtcaaatcatctctggatcctagactactgtttcaaaagctttccctgccttatttaaactgaaaacattacaaataaacagctcataaacattaaaaaaattagtagaatttgtgccatttcgtcattactactacgtaattttataagattttttaaaacaacaatggattaagaatcaagtaaattatattgctagttttgccatcatttacaactttagaaaagtcatttatctctgaactttattaaatttattagtaagcagtggggctggactggatggcctctgcatacacctctacagtttttttttgatgatttttggggcaaagctggaaaatgaaaggatttcatttggcaaataattaaaacctacaggaaataggtgtgaaacaaaagtcaaaattcctcttcaaaaaaaaactccaaggggcaaatggaggaaagagaaaaattacaaagttagaagacagtgtatgagaacaagggactagattcatgaagctttggtgtatgttagcagagtgtgtgtgtgtgtgtgtgtgtgtgtgtgtgtgtgtagtggggtgggggtatttttattaaaagaaatagcagattctggcaaacatactgaccaagagttaaagaacttccataagtctgactcaattctgcttctagtttggagactagttacctaattttggttcttaacttcttccttctctaaaacatgattcacacacacttactgtgtatcgtctccaactagcagagcagttgcaaaaattaaaatgtgataagaataattaataccttcaatttatatagcatacctcttcccatgcctcaggcactcacactattgcagatgcttccaaaaaaaaatgtcttgacattcacaaacagaacaaaaaaatgcttaggggaatacgacaaagaaataaatgaattgtgtctatattgcttgaatttcttgctaataaagtagttttagaaaactcacctcaaatttgcactttaaaaatgtttagtaatgcagaatcattattcagttactggatatggaaaatcaaaattataaagaagccagcagcccgctaccacattatttgctacataaaaatttccctttcaagtagtataaattgtaaattctgtatgacttggctcagaatagctcaagacgtatgtctagataaatgtttatctttctattagaacagtcacacaatgtcaatatctaagtaagtattcaaattctggctgaaagggggaaggcaaaatctattctatcaaaggattcatttcttggattatggatgatggattagctgggtgacacacaagttagaagagttatctttactatatttcaaacacctatatttcagatgtcaaaagaaagtctagataatatgtcattgtcaaggcttaaagtacattaatccttaaaaatgcttagatttcagagttttttcctcccaaaatatagtttcatttaaaccccaaatgttcaattttactctcatccattcagaaaatcggagtgttcgtgacaattaaaaacaactaaacacttaaaggaaaaaaatcagagatgtgaattaattgtgtgtgcagagatagtcacctcaatataaaaatagaaagttagaaaaacctagatgactgacaatagagcactgcttaaactatggaccatccttcatatgcataatttatatctattctaatgctgacatttaaaatcatgctgttgaatattagtaacatgaagaatatttagtaacatgaagaaatgttcagaatgtgaaaagtgaaaataaatgttgcacagtataatccaaattttaaaaaataactgtgcttatttatagtaaaatatgctagaagtagttttctctgggtgagaattatggcaatatctattttcttctctgtatgttttccccaaattctttacaatacacatgctattttttacactttaaaaagcattacatttagagtagctggtgacttagctataaacaatcatctatccatgtattggtaaagtgttagtgttgcaatcctagaactataatgtggtcattttaggatgaattcttaagaggtcaatgtgtgcataatttaacaagaggtaagcagtctgacactctgtatgttcaaaacatttagcttgatcaacaaattaattatggcttactaaatttagtgataaattaagtggcctcagtgatggacttgatggacaatacagacatgacatacaaaagaatcccttcctgtgacatagtgggtacacaatgcagggtgatgaatatggttctaatctgatatgatacattcttattaaactttgcagtatgtcaaaatgacactgccttttaaatctattaagacttcatctcacaggagaatccaaaatagatgcatcttatattcaggatggacactgggtgaatatgagcagattgaggtgtccttaaatgtatgctcaccaatcctaattcattctctagtcagtgctctctctctctcttacacacacacacaaacacacatatacacaggcacacacacacacatacacacacaaatgaacagaatctgtttagggggcttcccaccttcttgccaccaacttcagcatctgcagccatccattctttccttcctcttatttgactggaagaggtgtcctgtctatctaaggcacaccctctgtctagcccctggatcttatccatcctgaatttcagagaccatatactctcaattgttcctgtcctcttttatagttaacttctcccacttttggcagtttcccagtcacattttaacatgtccaaatttttgccaccttgagaaaataaaacctgtgtggaattctcacctacctacatatagactgctccagaagttacagccaaatttcccaaaagaggtgtctaccctccttacctttaaacttattccaaaacctgctgcagcctgacctctgtgttcacaaatcctcagacaaggctgttcccaaggccaccaacaaggttgcagaatcaacgccacagtcttacttgtctgtaacatcagacctaattgaatgtagctgtctcttgaaacattctcttccctaatattcgagtcaccatttgttctgattttattactaattttcctgctacctttctgggtattcctctgcagtcccctttatatgctcctgtttctcgctgtctcaaaatatgttagcatttctgaattgtatcttagagagcctcctcttcttactgtgaataaactgactatgtgtggtctttcatctcaatggcttcaaaccccatttatgtgctataggccataccttttctctgagctccaaatggattagtttagctgctattgcacggctttgtttgaatgtcttacatcaaattcaacattttcaaaatgaaaattcttatctttttcctcaaaggtgtttctacattaatcttccctatcacagtaaatccccatctctaaaacagaaacctgggagttacccttgattcatttctctgtgtgtctttctctacgtctctctgtctctctccacattccaccacattcaccatattcctcacatccaatcaatcacggagtctccaactaacctcttatggttttttttttaatctatcacttctctcatttacacccccaattgaccataaactgaggtctccatcgtctcttgtctgaactatcacaatcatcaatgacatgatttgttggcctccatctggcctggcccatgctgctgcttaaaaaagatgcttgtaaaatgaaattttaatcttgttattccactttgcaaagtccttcatttatacacattgccctgagtataaagtccaaacacttaaattcaaagctcctctttacttggtgagtacctgttgtgttctctagcctaagttctcaccattttttaccctcatgcatcagtattccaattatcttgaacttcttgcaggtctttaaaagtgacagttctttcttgcttttgaggcattacaaatgtggatctttaagtcttaaaactctcatcctctttttctttacttgaaaaattctgacttatttcgtgcgtggtcttgaaacatcaatttatttgatatttctcttgacaaaagcaagccttaatacaatcttcatatggattcccataattctctacttctctacattttatcttgctgcttgtttttaattgttggtctctctcaataatcgaaaattgttacaagagtagggatcaattctatcctatattctaggtatatcacagcaagggccaagcccagtagattaataaagtttttgaattaacaaataagtgaatgagagcaagggtatagtgcatcctgcccatttgggggtacagattctagagttttgatgtaatggacaaatctaccgacattctatccttttctttctttttttttttttttttttttgcctcagcctctcgagtagctgggattacaggtgcccgccaccgtgcatagctaatttttgtatttttagtagagatggggtttcaccgtgttgaccaggctggtcttgaactactgatctcaggtgatccacctgcctcaacctcccagtgtgctgggattccagtcatgagccaccgtgcccggctgaaaaaaatacttgattcttttatttatttatttatttatttatttatttatttatttatttatttttattatactttaagttttagggtgcatatgcacaacgtgcaggtttgttacgtgtatacatgtgccatgttggtgtgctgcacccattaactcgtcatttaacattaggcatatctcctaatgctatccctcccccctcccccaccccacaatgagaacacatggccacaggaaggggaacatcattcaatccttttcaagattccaggcccttccttccttccttccttccttccttccttctttccttcctttttttccttccttccttccttcttattataattagccaggataacagcttcaaactaggtgctaatggactataagcacatcttcttatcattcatgattttaagtggaacgttctggtgttcagatgacagccagtagtaaccctgaggctggtaagttggggttatagaatgaaaggagaaccaagtatttaaaataaaatatattgaatctataagaggatattctattaactgtatatctaataacatttatttaaaatatagcccaaggaaaaaaagaagatattatgcatatcaacacagtctttaatgaggatatcatcaaatttctaatacttagtgtcaaaagtccttttattactgtaagtgttatatatgattctagcactccttgcttatagaagttttgcccaaaaatataacaccatatcttatgcttaacaactgaagacgaataataacaaaacagcaactaatgcttatataatacttactataagagactatgcttgcctgtgaggtgagtgagttgcaggaatgtcttcaatgctgctactgggtagccccaagaggagagaaagtcaccagaaatatttggttgcaactttttcccttcacaagagccaagcagtaaaattgtgggttaaacccagttaacatggctctctttggaaaggttgaggcattgaaggccaaacttcctgtcatgattaggaaatcacagactgttcttaatgttaaagcgaaagcaatgctattgtgtgatactttcagctcctcaagttgtgaatctggcattgtgtgattactccccccttgcttatactgtaataaatatttaaaataccccccagaatctgagataacacatcagtaacagtttaatttagcacttgcaaaattccctccccaggttaggcttgtactcagtattggcatcaggaacttcctaacattatattcattcattttccttttcccaacacaaaacacacccctggctaaatttaccagctttctttacagctaactcttgtcctgttgactgtaaataggaactgagtaatactcacagtccctgacctatataagtgctatgtaagtactacttgctgttttgttattatttgaatgttatgtattacaaacggaagcaacacataggtggcagctgaaaaccagcaagtgccatgcgatatttatattactcattgtaaactttagtttccgaaacttctgaaaaaaatgtttcttttgtttttcaggaaatcggactttaaaaactcacttaaataatggttagtacttacaattttataccaggtttgaaggaagtttgaataagacacaacttgtatgcaatgcaggaaaatggaaaattataatgtgttcatcttccgtgtttacccccttaggctgcttttgtctcttctattgatttatttggattaatactatattattactaatattatattatttagattaatactatattattatttactttgctgtgggactttggtcatggacatggctgttggacatggcttcaaaaatatgttactattataatgtttctaagaataaattagatagacggtaaaaatggacccccatcttttattattaatatcccaattttggataactttttctctgtattctgggttggtccaacagcaaagtaaataataagaacaagaaggaagcaaacatgaggaagaaacctgttcctaccatgactcaaatgcctaactcctatgaggatcacaggctcccaggctcctgtaaaaagataaacagatcccaacaccattgactccctctctccttaacgtgtgaacccagtgagagcaattcttactgtactacttaccttctagggaggaccttaaacaagtaataataaaacagttcctacaactatcatagggaaaatgcttttggtgaattcatctaaaatcctatatttgatgtaagtttcttttgttattttttttaagagacggggtttctctgtcaccgaggctggagtgcagtaatgccatcataatttactcactgtagcctcaaattcctgggttcaagggttcctccctagtagctagtactacaggcatgtgccaccatgccgggttaatttttttctttttaaatttttgtagagacaggcatctccctacattgctcaggctagtcttgaactcctagcctcaagtgattctcctgctttggcctctcaaagcactgaaattaaaaacaaaagattttatgcaacctcaccaaggcgaagtagatattttcaggaatggttttgcaggaattggcaaatagatctattgagacttggaactatccggttccccaacccatttaaccagaacaggtctgttttcatctatttctctaaagagatgtattgacatagtccccccggttaaaacaattggaaaatcatcagtctaatgcagtactatccaagagaaatgtaattcaagccacaaatctgcagcacatgtatgcttttgcattttctagtagccagattttttttaaaaaagtaaaaagaaacattttgaattttaattcacccaatatatctgaaatgttacatcagcatgtagtgaacataaaaattattaatgcaatattttactttttacctttttgtatttaatcttaaaactctgctgtgtagtttacatttaaagtatctcaatttggattaatcacatttcaagaggcaaataaccatatgtggctagtggctactatgctactatgctgtatagatgaaagtttagtgctttattctttttgagggttttccacctttattctgtcaattaaactgtgtaggtatcatcactgcagtgtccactattggtcacctacccagggtccattcatccatctcccctgctcatggacatagttattttcactggatcctatgtgcttcagggctgaccccatccctagctacaggaatgtgccggggttagggatgatcatgtgaccccatactagctaatgagatccaacagtttcctcgtttttaagagaaagtcatagaaaaacacagcttctctctcctgctagaagttaaccaggaagcacgtactacagctaccacttgcggggaacaagccgtaggatgaagccaagactgtactgcgaaagagagatgcggcaaactttggtcctagatgacgatgctgagctttcggattaaccaactctgaaggctgccctaattttggatttcagttatgttttttattcccaaaccactacattacatcatctctaataatgactgagggcaacataaatatagtgacactctggagcaacttttgaagcattatgttttttcctttgttttttattttttactatgtttccctattgtcgccgaaattcctcatgtttaattgttatccccagggcacctttccaaacatccctttcattttttccgtctttaaacaccaggcattagagcaactgttttcttgtgctccttcccattgcttccaattaacttctctcttccattataaaaacaatgttgtctctcttacagttgtctaccctaaaggtatgtttaaatcttctctagaatttttattactaacaacaaagtggagacaataaaagtaaagaataaagaaaaatatgcactattatcttaaatactaacaacttttactgtattaataatacccatgattcattagattcaagttggattagtggctttagaatgaaaaagatttgagtttgattcactcaacactatttatcatctgtggccttaaagcaagttgcttactcaacaagtgaaaaagtaaaataaaataaaacaaaaaacaggaactgatgtcacctacatttcaagatttatgtgaagattaaaaaaccatctaatgtatgcaaaactcttaaagctaggatttataccttgatcttcttattcctattctagtgtccttttcacttaattacacttcccttcttcattcatttcacaatcatttattgcgtgatttctttgggccaggaagatttattgaaaaacaaggcaagatctctgcttttaagcagtttataatttaaactgaatcagacaaatagagggagaccataaagcttagtggttaattacataggcaataaaatcagacaaatctggatttgaccccaagaaagttactttacatctcaaaaccagtttcctcttctgaaaacgaagatgacagtatcccctcaagttgtcatcaatagaacaaaatgaaattatatctgtgaaatgcaatgtgcataaattataaaataagcatttgtctattgtggccaatcatcctcattgccataattataactgtgcataattaagtataaaggtatgcacaggcactatggagtaaagaggaggggcacttaaatcagtttctatggccgggcgtgatggctcacacctgtaatcccagtactttggcaggcctaggcaggaggatcacttgaggtcaggaattcgagactagcctggccaacatggtgaaaccccatctgtactaaacatacaaaaattagctgggtgtgttggtgcacacctgtaatcccagttgctccggaggctgaggcaggagaatcacttgaacctgggaggtggaggttgcactgagccgagatcacgctactgcactccagcctgggtgacagagtgagactccatctcaaataataataataataataataataataataataacaaaataagtaaataaataaataagtttctaggttcagagaaacccctgtctgccaaaacagcagatgctttgtaggtatttgagacaaagtccacatttctgagtgtgaaattgtgtgaatcattataagagctgcaaactgatttttatcactgaaggtaaggatgctggggtagggatggaaaaaaatggtacagtggtaaatgtggccaaatccaagatcttgaggattaaactaaggaatctgaagccttttaatctgggtgagaggctactatagtaacatgcctgaattccatgttagagagtcaccgtggtcacactgaggttctctaaggctctttctcttttccctaattataagaaaaaagatgaaagcaggtttgcaagaatcccaattgcactgtatcatactggaggctttagaactgtcaaaacaaagtttctaattttgactgtagtcaaacactttcccaccaagcaaaaagaattcaatatacagttttatttgttttataaatagtttagtgaaaagaataatatatgtgacttgtactagctgaaaaatgtttgcctagtaaaactttatcactggatgtgaatgttctaagcctaaaagacacacagaagtaaataaaattgatgccacacctttacaaaaaacacttcctaaattgccggtatcgtggtgaatggaatcatttaacaagttactgtcagacaagtgaaaactcctgtcaccttctacgggatttttcagaatatgctccctagatactcaagctcctacaaaggtcaatcagttgatgaatcaatagctattctacaggaaatctccatcaccataattatctgacccagacaatttcagtgattttttttttactattctcaatcaatttgttcttttttgtacaatattttcaacgaagtgatttgaaaatatttttataaactaataagagagaaaaacgtgacacatagcattatagtgtacaaaagcctaagatctactaattactaggaatatgattagagaaagttataaaatcttttctgtcttattatttgcaactgaaacatgggaatgaaaggtaacaaactcaaaaattgttgtgaagattaaattaggtaatatatggaaagggtaattgtcaagtatgtacctgcacataacaggcattcagtaaatagaagtccttttattttttgtggctctcttcagtttgcgctccaccagtctcactgctaccccaatttcccaacagataggtggcaggaaaacacacacacacacacacacacacacacacacacacacaaacgtgcacacacgcacatgtgcacaaggcttcaaaagtatgttactattataatgtttctacgaataaattggatagatggtaaaaatgaacccccaccttttattattaatatcccaattctggataaccgtttctctgtattctgggtgggagagaaatcccagcacatatgtcataaaccaagtgctggaggtgcctgagccttcatcctttgttatagcataggggtaaataacccaagctacagcagtcaggctggcaacagaagtttgaattttacaagcataacacaaagaagaagggggtttttagacattggattcatcacagaggcatgcagcaaacatttttccagcaggactttggctgtgcagcctgaagttcatcatcaagaacatcctgggtcttgcctgttttccaaacctgacctgccagatttctctggactctgtgagctcctgaaatccttctacatatgctctttgcacttggagtcacagttggttgtttgcaacccagaaccatgtctaaggaggagggtagaattctgaagtcagaagatattccatgcttcctgatattgatctgtagcaaaatttaattagaaatagatgctagagaaaagaattttaaaatgttccctaatgtcttttatagagcaaaagctaatattaagaaatttgcttttggatccaggcaaatccctagtctattcttggagaaaattactaccattaaataaattcaaaagtctgccacccagcatgttggccgttagcacagctactgatttataaagaaaaagctggttgccagaataacataaaacccagactacaactcatcctttatggaaaaatcaagaaagaacttcttttttcttctctagtcatctcactatggtgttaatggagtattcgtgagattttcgtcttataaggccacctctcattatactcttacttctggaaaattctctgagcctgaatctggaaaattctctgagcctgaatctttcctcatagcctagaaaactcatactagtctttgaaaatgcaactttgtcatctatgactgtttcttgtgtttataaaacaaaacaatagaaaaaatctatgatgtctaaacagtgcttcaagatgatgtattcagtaaaatattgtattattataaaagcaaaattaaaacctcacatgtagaccacaaatataaacttattaacttgaagctttgaaaaaagaacacaagacctagccaaagagctgcaaagctatggcttaggctggttccttaggagcagagcctgaagtggggattctgatacatagcaagaagctgaagttagagtctcagaaagagacagtgctggcttccatcttctataaggccacctccactcttcacactcctgcaatttatgtgaatcaagcaactccccctacctttttatatttatttatttgcttaagctagtttgcattagttttcgatcatttgcagccaaacaatcctgattttaaaagtagggagtattaatttgagaactgctctccttttaggagaaaaagaggccaacagtaaccagaacccgtttagaaagaacaatgacaacaaaaagtttcttctgagacctagcctggaaatcagcatgctccagatcttctggggatcacgaatcttatgacattctattattttataagcaaattttggtaacttctgtgtctctgtgtgactgttctgattcatgtctcagaaaaaaggaaataacatctattagatcaaatttacctcctaattctctcttcctagttgtgtaagcttagagcagtcacttccttcttggggagccaaatggaaagccatatgtagatagctggccacctcaaaaccaaaggcctggagaggaagagagaggtcctatttcttgtcagagtcataggacagggattagagaaatttcaaaatgtctggcaaactgtctccaaaacactatgtcaatatgggtacttcactccaatcccagttgtcaccgcctcttacctggatgacttcaacagccttctacctggtgtccctgttcccacacatacctttctgcaatccagctccacatagctgccagaaggatgcttcaggctttattctggcacactgcttcattttcttaatggtatttatcacaatcactagacttctagtttatttattgcctctctccttccactagaatgctaattccctgagagcatgaaactagcctaattcactgccatatttccagcacctagaactgtgcctgacacattgtatggactcaataaacaaatactgattgcatgcatggataaatgaattctgaatggttctcagctttgtttctttttttgaaaattaaagatggaaaatgctgctgcttttttttttgagtcaatttcaagtttctccaggaaatcgtcttaaagacaacacattccttgaggacaagggtcacgtcattgtagcactaccttacacacaatcagtattcaataagtgtctgctaaataaattataaatcatggctcctccttctgccgtggtcaaggtaattttttgttatttttctgcttaaaaacttagtagaactcctcattacctaataatataatgctgcattagtaatactactctgtatagttattggtatagtatttttatctttaaaaattaaaaaaacctttaaaaataaaagatgtctttaagtaaatttagtattgttatgatgtgtctgtatctggattctttatctggccagcattttgataggatttctttgtaatttggtggaggtaatattagttttatcttattttattttgagtgagaagaatcttattttaaaactcatttatgtgagttatattaataactacaaaacaatgatttatactagcagggaaaaactgttaaagtttttaaacctaatattttaatctaacatttttatcgctaaattttcttttaatgtgttccttttgtcatttattgattttcctggatttgacataacaggtattttataagatgatatatatgctaccttttgttcacataaattgaaatagctaagtccctttatgtttgccatatttaccaaagtacctggcacaaaatgcaccagaatctagggcagtcattttatgtaaatgcacatgagtttacattgctaatataattgttgatccacttataacttgtgcaataaagtatgtatgcagtgactgagttgtcagtaaaaaatgtaacctctttgtgataaaacataatagtaaaataaaaataaatgtagtattgctctaactaatccaagagctagtattagcaccgaagggtggaagcaaaagggaggacagattctgactcagtcaatataagggaaatgaatttttctaatacaaagaacagctcaagatgaattggggtattctaaggcatcatggcatggaggaaacatggacaaatgaattctaaatggttctcagctttgtttctttattgaaaatttattggcctttcaatcccagcctgtctacttaatagctttgctaccttgaacaaatcactcaactcctctcagctttagttttctcatcataataactttggcgacaaaaatgcctatctcatagggttattgcaagaaattttaaaaaaagtatgtgtgagaaagagcctggcacaatcttggctctaagaaaattcctagagttcttgaaaggtaaaaaatttcctattattaagggtgttcaacaaagtgtaaacaaagctggaacaatttcactaagaatattctagaaagatatcaaatattagatgagttgttttcctaaacgaggtttgtgaattcaggttttataatgcacactctcttattttacaaatatagaacagtatagaaaatcaatacaaattgcccaaaatgaaatacaaattctcattcctaatcttaagcaatctacttatgtgtttctccctttcccttcagtctctatttgactatatctatagtttttgacattctcaaatgtacttctacaaaaacagatctgcttaccattcccagcacatctggttcaatattttccgtggtgcatctgcacagatccactgctgcttcccctctctcaccgattctaggccaagctacttcccactcctcttttaaagcaacatttaaggaagaaggcttttctttatattaatgtctctacatctccatctgtcctcagtactcgagggctctgatgctctacccatctaatccattaggcaaccttaagtggtcttaaaacatgaagcagatcaaatcattcccctacagctttcagttgtttttcattgtacttgtggtagaaatctaaactcccaaacaaaaatgacaaggttgtgaattatctggccctgcctccctccctagctggccttgcaggcaatctcttttttactcactctaatccatccatctggccttctttcagttcctccaatgcttccagtgtattcctgcactgacaccttcacatactgctctttcttccttgaggtcttatcttgtaagactcgtcataaatgacctttttcccagagatgccctccctaatcccaatgcatcagtaggagatcttccttgacactctctcaaattacctttctcttgccttcataaagtgctcgtttttgatgtataaaaaggtatgccagcatccatctgcacttctctggtcaagtgggcagaacaaattacattggagcagaagtttcagaagaattacttattctggtaaatttggaatcattagctttacacaggggaaattgtgtggtataccaaaggaaaacccacacaacactctgtggtcacttgggaagaggtagatggtgcttaaggggcccagggacttctggtcaaagaggagatcaagaaactgaacctcttctctcaagatttgaagccaaaaaacttggagcagagtggatttggccacattcactacagggaaaagacatacaagccttaaaagaaaacttagagaaagggaaaaactgggtatggtggtgcacaactaatagtacaactatgcagaggctgaggctggaggatcacttgagcccaatagttcaaggctgcagtgagctatgatcacaccactgtactatagcctgggtgacagagcaagaccctatctcaaaataaaataaattaattaaaaataaaaaataaaagaaaggggcccggcacagtggctcacacctgtaatcccagccctttgggaggccgaggtgggcggatcacaaggtcaggagatcgagaccatcctggctaacacggtgaaaccccgtctctaccaaaaatacaaaaactagccgggtgtggtggtgggctcctgtagtcccagctattggggaggctgaggcaggagaatggcatgaacccaggaggcggagcttgcagtgagccgagatcgtgctactgtactccagcctgggtgacagaacgagactttgtctcaaaaaaaaaaaagaaagggaaagacacatttctcaggagataatctgagtaccacccagagcctaatgatcccagaagtaaggctgattctagagcagcatgtggcctgaggtcagcagccctttgagtccatgtactcactctggcagtgtttgtgctcggagaattgcagctgagcattacagctggagtcacaggtgtgaattaatgtgctccctaattatggagtccaagcacagacccagtacagttggggccaagcgtgttccattagggccatcatgctgcactggaccagccgtgtcctgcccacatgaggccaatctcatgtgtgatagtaagggcaaccacagtaagacctatccgactagttacattggcttattggaacgactgattatctactgtctgtctaccttagtagactgaaagctatgtgaaggaagatagcattccatttggcttaccatcgaggctaccacgtagagctgcacagattgcatactgctcaactccaaagattgtcattgtcttacaatataatgtgaatagcactctctcgagcaacgtaactgctcaacctttatagctaaatgaatccgtgctgaccaccactgtattaccagagtgatgagagtggcaggcacataacaagctctcaataaatatttatagaatcgctggataaaagaatgtgtgatctattttgtccatttgcatacatttctatgctttttcctaataagtttttacgtattttcccccatatatctgaaatagtatgtccaatagggacgatttaatctatttagagctacaggaagtgagaactgaaaggaggattagagtcgttaatcgttttatcttaccggttagaaaaggaaagtccggcaagataaagtgacttagatcacatggcaaggccgtgaccagatccaggtctcttgccatccagtgccttgttctctctgtggcactcacttgcttctttaataactttcttctgttcttcttatgaagcagagaggagtcctcacaagtcgggggtcacttaatcactgatgctactctgtggctgaggagctggctgttgaggcattcttctatttggggaaatatgaaagtgtgtgatctgccaggagctctgacccaaataaggttgttggtagcaagatgttaccagtgaaatttcatacatcaaacagcaattagtgctccactttactgtcttgtgaatttctcagaatgaatcttatcttttacaatcactctttcatcattttcaacattaatcacacacttcttttttccaaatttttatgaatcacaacagcagcatattctcaaccatagaaaatgacatttattatgtgttcagaaagagagacaaaaagatatacaaatcaaatttactctcaggatataacaaaaaattagtggaaagtatatgttttaaattacacttaatatttggggaccaattattgcttgaaataaacaggcttccagttccaacatggccttttgtttttgtattaccaagagtttttaaacagtaatggtatctggtggagaatttatcttgtatctatattgcacaacttttgcctaaattagtaggcattttcttttttctaaaaataaagtgtgaatactcaagcctcctcttccatttctgctaccatttttcattttagatcgatgatccttcaaatatctatcataaaattagttcactaaaataatatttggattttaagtaagcacccacataagtcactgaaatgtcctccctataaatgtggtcccagagaatatctggaaaggccactggatagaaaaataacacattgtgctatttgcaggccacaaataatattaatgtgttgtcaggacctggtcaaactgtatgaagcagtttacaactctatgattcacacactttggtctgacttaaggcttgtgtaaattcaattctgggctgtcagtcagcagcacaggttctgttcagtcccaacatttctaattgcctgtgaaaagatgaagacaactgagggagagactctctcaagaagtttgcagaatgacttgatcctagacaacagttagatgcacaattagttcaactcaagattccattgagaataggtttgtgcacatataggataacaggaagacgaccctgactggaaagagctcacatgagaggctgtgggtgctagcaagacccacatttaactccaacacagaggaatgactgttcaggtggggaggggaactgttcactgcagataagtcctccccttctcagggccatcgagcagaaaagagcattccagacctgtgacagaggtcttcaggacacaaggtactagctcttccctcaggtgtaagggaaaggggaaatgggatcagtgtgttttggagttagagagctaactagaagctgtaaaagggaacagattacagggctgagagaatgcagaggagggatggtggcagggggagggaaggagggatgaattacaataccttataaaaatttaggcaccctgtaatcccagcactttgggaggctgaggtggatggatcatgaggtcaggagatagagaccatactggctaatgcagtgaaaccctgtctctactaaaaatagaaaaaattagccgggtgtggtggtgggcgcctgtagtcccagctactcgggaggctgaggcaggagaatggcatgaacccgggaggcagagcttgcagtgagcggagattgcgccactgcactccagcctgggtgacagagcgagactctgtctcaaaaaaaaaaaaaaaaaaaaagaaaaaaagaaagaaaaattaggcacagttggtttaccatttttctttctgtttctgaaagttgcattctccaccacattttttccccaatgaactataactaatcaagctgtgaaacactacttgcctcctttctccagtttgctaggagaaaggtctatctcaacacaagagtcaacactactatccagtaaaacatcacagtggtattcctcatatggaaggaatgttcccagcttgctaaaaggactcagtaataaagtattttcatagtactgtatactaccccattattttcacatatgttaatcttgttggttttcattataacactgtgaaatgagctgggtaggcatttttgtttcagaaagaaagagagagagagaaagaaagaaagagagggagggagggaagaaagaaagaaagaaggaaagaaagaaagaaagaaaaaaaagaaagagaaagagagaaagaaaaaaagaaagaaaagagagaggaggagagggaagggaagggaagggaaaggaaaggaaaggaagggaagggttcataaagttatcaagtgaattgtctaaggccaaaagtaattgcttatttacatggggccagaccctgtcttctgatttggttgctcaagtattcagtcaaggccagcgcggtggctcgtgcctgtaatgccacagcactttgggaggcagaggcgagaggatcacaggaggacaggagtttgagaccaaactgcccaacatggtgaaatcccgtctctagtaaaaaaaaaatacaaaaattagcagggcatgtggtggtgcatgcctgtaaccccagctactcgggaggctgaggcacgagaatcacttgaacccaggaggcagaagttgcagtgagcccgagatcatgccaatgcactccagcctaggcaacagcgagactttgtctcaaaagaaaaaaaaaagtattcagtcaataaacacgtattgggcagaccttatgtggcaagcaattatgatagttcctaggaaaaaataatgtgcaagacacacactgtacttgaccttagcagaactaaaagaacagaaagacaataaaccaatgtctccaatgaagtgtgactcagactgtgaaagggaaatgcggggtatcatgagatcagggcacccaatcacggcctagagaggatgaaggaaggcttcgctagaaaatggcttctaacttgagatcttagccaatccaagagaggtgggtgcttggcagatattgctgaatggctgaggggtaaagtggcaatgaaaaatggagaaagaagtgctctgtgtaaagagagcagggtgcaggaattcacagagagttcccatgttgtatgtatctcagtcatatgctgcccaactgtcatttctgtataagaatcaattacagatgttcctcaacttaaaacagggttacgtctgggtaaactcactgtcagttgaaaatattgttaagttgaatatattgtaagatcaaagatgcgtttaatacgtttaatacacctaacatactgaacatcatagcttagccttgcctatcttaaacatgctcagaacacttacattagcctacaggtgggcaaaatcatctggcaacacagtccactgtggagtattggttgcttaccttgtgtttgcgtggctgactgggagctgtgcatgcatcaccaaagagtatcatactgcatatcactagcccaatagaagatcgccattccaaattccaagtacagtttctactgaatgtgcattcctttcacaccatcatgaagttgaaaaagcataggtcagagactgtctttactatgtttacagtaaaatgttgccatatacttaggggacaagatataagaggaacccccccaaaatgaggctccttcattggttaccatctttatgaaagttggaagtttctagggaaaaggaggactagagagattgtctaatgattctcaagaagcacagctggcaggagttgaaatacaaacttccttcctgtctttttgtaaagcaattggaaaaaatgggagagtaagaatttgacatgttacagttgtagatcttagtgttgtgaggcatgaatgagataaatgtggaacactggcaggttgcaaaaatgttacgcagatgtacagcgttttaggggggacttccctgcatttctgtcctgcaatgcaagggcagaaccaaaaactgaaacttagcacccagtatccctcacctaccacccctctgcaccctcagatgaatcatagtctgttacagatgcctgtggtgcatattcctgagtgttagtcccagaaaactaaacctatggaaacttttataatttagttgttgaccttcacagcttgttcaaaagagaagggccagtgactcacaattatattacaacttcagaccatgtgaatttcttcaaagatgatggcttaagaagtgtttaattcttggctctttctgataaactcaaaagagtgaagtcctcatcttgtcattcagggactaaccatctaaatttgttttcttgaacatttttaaaacatcattcccattgatctagtgtgcaccctttgttctcattgggctgggttttgggacacacttgctctcagtcatgaagtcatgaaatgaggttatgccaattcatcttcctggaaatctcctctggcaaattcagactgacttttttctgagagccaaaggcattaattacatcctatcttgtattataattctttaaatatttcactcataaatgtggaaattctgcttttctgaacagattataacattaatcagttttataatcatagaatattttgttgaccttcacacctttttcaaaagagaaaaattatagaatatttttcctacaatgtggattcatatgtttaatcactttctctgaagcaacatcctgaatatggcagaaagttgaggcagaagagattagcaattgaataatacttttatatgctataaaacaacattatttctgaaaataattcatcatacatatctaccacatgtggcatattaaaggcaaatttcgcttgtcaaaatacatcagtgactccttaactaaaatgaaaaaaaatcacaactacattgtgaaatatcttcttgaactgaaacatctctgtatttgtggatactgagcagggaattcagtggttcaagattaaaggcaaaagtttctaaggctgcttttatccagttccaagattgatgatgagaaactgtttgttgctcatacctcacttttcatgatgttcatagctggctttgtatttactgtttttgagatagcttacagtattagccacattctacctgtttgggagtgccaagttataaaagtacaaaatgtactcatagcttcctttgaacaaaatcctaaggttattcccatttctggaaatttagctatcaggtcaaacaactgagctatggtgagcatcattcataaaatataaaacataaaataatgataaaaatcaaatagattgcattgctggatgaactggctgattgcaacagaatgacaatgtgatgccttacataagcagtaactaaaaactgtaggtcatctatcatggtgacataatttcccactgtactctcttaatttcacattttatattgtattttgcaaaatttctgagaaaaagaaaaaggaaacaaagcttttgtttaaggatacataaacctctatttaagtatttatgtagtgtgaacttgtagctgttgggacattttcttattatggtgtttctgtactaccaagttttcctgcagtaacaactgaatatttattatagtcatgatagtcttccaggatatactcagggtcctttcaagtaagaagtttggacaattagaatagtatcctacacccaacttaacgaatgctagcaggaaacctatattacactcatagttagaaaaaacagcgttaatctctcattttaacactaatatgctgaaaattcaattcactaaattctagtgtttttattcttataattctctattaagaaagcagctttgccagtttcttttctttgtagtaattccaactttgtacagtaaatctttttgaagatatttggagttttttttttgttttttgttttttttttagagggagtcctgctctgtcacccgtgctggagtgcagtggcgtgatctcggctcacagcaacctctgtctccctagcctaagtaattctcctgcatcagcctcccgagtaactgagattacaggcgcatgccaccatgccccgctaatttttgtatttttagtagaggcggggtttggccatgttggaatgctggtctcgaactgctgacctcaaatgatccactcacctcggcctcccaaagtgctgggattacaggcgtgagccactgcgcccagccgatggaaccattttctttaaaaagttctcatttctcctaggccgggcacggtggctcatgcctgtaatcccagcactttgggtggccgaggtgggcggatcacctcaggtcaggagttcgagaccagcctggccaacatggtgaaaccccatctctactaaaaatacaaaaattagccaggtgtggtggcgggcgcctgtaatcctagtgactccaaaggctgaggcagtagaatcacttgcacctgggaggtggaggctgcagagagctgagatctcaccactgcactccagcctggagtttttttttttgagacagagtctcaaaaaaaaaaaaaattctcctttttgatatgatcacatgtttaatttattttgtttaatgtttttataattgaattaataaagtacccagtaaaatgctataaatcaataagtattatccaaatgaaaataaattgaaattaagtaagactagtttcaaatgcagtctttcttgaaagagtgagtttggccatcctaaattacagttttcaagattgatctactttctttctgaggccaccatacttttggtactagaattaaagtgtctaaatcaaaaacacactacatggcttcgctttgacttaaaaacaaaatgcacaaacaataaattataagtctgattaactgtatgggtattttgttcaattgatttaactgcattttttttccctaggatataaatcatgtgatacagcaaactcaaagatgtgggactcaaatgacacttgtgaaaaactgataccctgtttgcctttaaagttatattaattaccacactttagtaaagtgtttactatttagaactctttcttccttcctagttggccacctgtacactccattcctcagccataaaagtaaatactgtatatctaaaactggtgctggttttgataagccatagtgatgacatcagcctgagttccaactcctggaataaagaactgtgaccatacagcgacttgtgggcagttaggtctcagcataacactccttgtcccctcatgtcactgatttggagccaaggtttgtgctccaatctaccaaaccaggttaaagaaattacatttctattttcaaatgcaagggatttaaaagtatacatggcgcacaaaaaactcaacgtacttaatgcctaatgccactgaactgtacacataataatggttaaaatactgaattgtatgtaatatattttaccataattaggaaagaaaaaaaactgcgttcacgtgtttcaaaggttttccacaactgtataatacatatagttggttatacctttgtaacagtgaccatatcgctctttctgcaacatctattaacccagacaccccagggcctaagtaagcatccattcttcaggaattagtaaacagcacttacacacggacatttctagctaaaagtaacacagacaaaaaaacctcaaaaatatcacgtaagggcaggtgttaggcaaagagcctctgcaaacatcccttgctcctctgcattgctctggtgtgaggagctaggacatggagaaacctctacctcctatctcaggattagcgaaccctgcttgagtgctacaagggtaagtaaatgctggcctgaagaagctgctgagcttccggatcccactgactgtcgttcgggcacttcctagagggtcaagcaccatggcgaaaggctgaggaggcaactcgtatctttcattctcctgcctcatcaagaatgaaccttgaaggcacccataggtcgcgcagtctttcagaagctgcaggagggctgtgactgtatggggttgcagactgaaaatcttattaacgtgaaagaggaatttgaaattaaaaaaaaaaaacccggccgggcgcggtggctcacgcttgtaatcccagcactttgggaggccgaggcgggtggatcacgaggtcaggagatcgagaccacggtgaaaccccgtctctactaaaaataaaaaaaaaaaattagccgggcgtggtggcgggcgcctgtagtcccagctactcggagaggctgaggcaggagaatggcgtgaacccgggaggcggagcttgcagtgagccgaggctgcgccactgtactccagcctgggtgacagagcgagactccgtctcaaaaaaaaaaaaaaaaaaaaaccccacaatatcaggctacagttatcatagcaattctgcttttaatgcactcaggacaaacttctagctctgcatatatgtcatttcaatgacacatcctgtctcctacccgactagaatgtgagcagccctgtgatctctatgtgctcataaacagtgcctaatgcgaatcctggctcttggaaggcgctcagctagtaagtgaggagctcagctctgaagctgtaaccaagaccgcgcgggcaggaggaaaggacacttcagcgctctgcggttgcaaacacacccctgcgggtgctgccacttagcaaagtcttaggttcccgcttactcgcacacgcatcctgacttcccccaaccctggaactacctaccaggagcggagaccagcagaccgacagcacgcacatgatccccataagctgaatggccgtctcggtcgtgatgcggccccactgggcactggactgagatgccgtggccttggcccggcagcgggacaccagggccttaatggtggccaggttgcaggaaaaggtgactgtcagcgccaagagccccaggaaggcaaaggcagaggcgaagaaaaggttgccccagttatgcgaagagctagtcccgttgccccctcgcccggtgctgatgaagcaccacgtcccgggccactggacggtgtactggcccacgcccagcaccggcagcagggcgaaggcgagcacggccagccacacgccgagcagcacagcgcgggtggcacgcgtcttcatgtggctcgcataccagtgcggcgccctgatggccagcgcccgctcgacggccatggcgctggcgatgaacaacgaggagagcccgaaaacagtcatggtcagcccgaaaaaggtgcagagccgccccgacgggtcgatgtgctcccaacgctgcttggacaggtacacgacgatgacgaccggggtggtgagaagctgcccgaccaggtcggtgagcgccagccagccgatgcacagcaggaaggacttcttgcgcttgctctcccggcgccggtagctgcgcgacacgagcagcatggccagtgcgttgcccacgaaaccagtgagcagcatggtgatcgggaaggccacggacaccgatccgcaatcctcgccagaccctggagggcgcgtgaggttgccccgcgcctcggcggaacgctcgggcgcccacatgcctgtgtaggagtggttgaggcgggtgcagaagggggcatcccctccgtagccccgggtctccttcatgttggcttcgaggtgaggaggggatggcgtccagagagccgcagcgggagggggcagacgcggcgcgggcggcggcggaggtcggcgtttaccgcggctggggctgggctgccccccatggtgcggggcgcagccgccgccctactccgctgctgggaccgcggccgcggcggcgccagggctcactggcccgggagggagccacgccttcctctctgggaaacctctggt

SEQ ID NO: 1472 - DNA, 195456 bp, Homo sapiens; identical to SEQ ID NO: 1470

SEQ ID NO: 1473 - DNA, 195456 bp, Homo sapiens; identical to SEQ ID NO: 1470

SEQ ID NO: 1474 - DNA, 95377 bp, Homo sapiens; identical to SEQ ID NO: 1469

SEQ ID NO: 1475 - DNA, 77028 bp, Homo sapiens
atcttttagaagtccacaaagttttttattttaatacagacaaaatagattcttttattttataaaaacgtaataaagtttgttattcaacaactgttatttattaattttgcctttgtatatgctgccagaaaagaaatattaagaaatcctgacttggtcatggtgaatcagaaggcctacctggatttttttatcactctaactgcgcagctaatcattcaacctcaaatttgttttttatgacactccaaggatgcccttagctgcatcactcctttgtcatcaaaagcttagaaataacaattaagcagattcctgagttactaaatgacacataactagaattgagacttaggaacttttagttccatgctaagcccacagggacacaacatctctaaaacattaatcataattgggcacaaatattttttgtcacgattccctcctgccctcatttgcttttatatgtcgttaagttcatatcctattaattgaattatcactctcaatatgttgacttttcaccatcataagcttatactgatttttcaaactcatattgcaaaagcaagctatcatgaaatgtaaagatgtccactttggttaagattcacgtaaaggtttgaagttggagaaaactcctggaacacaggtctttcttttcatcacttttcctccaatcatcatctgtgaaattcttcccaacttcttaaatgcatattcaaaatcccatccaagaaaccaatctaatattcagaggcatggattataataataaagttgatctccatgggtattactgacaaaacaatcattaaaataaaaagataaaaatgaagaaataatccaaattaaaatatataattatccttctcaggtgggaagaaatatgcaaattcagggaagcaggaattgcaataaaatgtccaactccgttctttcattatctgttagaatagagagagaaagatgcaataagcatggatggggattattttttttaaattttgtgtatggtgtgaggagtaaaatataagtaataaatttgtttgctttaaacgtttaaaacattctcttttgaagtaattacatgtgttttagatttaaaaaagcaattgtaggcacaataaatggtcaaataatcttgttgtaaaaacaagtttcaattagtatataactctagtctaaaaagaaataaggaagaatagaagctgaaatagccaggaaatagaatattttcctatcaaaacatcaaagtaggccagacgcggtggttcatgcctgtaatcccagcattttgggaggccgaggcgagtggatcatgaggtcaagagatcaagaccatcctggtcaacatggtgaaaccccatctctactaatacaaaaattagctgggtgtggtggtgtgcacctgtagtcccagctacttgggaggctgaggcaggagaatcgcttgaatctgggaggtggaggttgcagtgagccgagatcatgccactgcactccagcctgttgacagagcgagactccatctcaaaaaaacataattaattcattaattaaagtattctgtttatttttttaagatagtacacagtgccaattagtataaagcaaattttttcacacacggttgatgaaattttaaatctaattattttcgcaaacagtctgtctacatgtatctttaaagaacattaaatattacacattacttattccataaattctccttatggtaaaatatatatatatataaacagttttttcaaacctctgcctttcagtacttgggtaatgatacagtaatattttcatcaatgtggcaaatttgaccacaaaattgaccatatggttaagtaagctacagtgtattatttagataacctattacataaatattaaaatggcttcacaaagaatttgcaaatggtctgagaaatgcttattttatgctaaataaaatgagaacaagattaaaaaatgtatatcataatattaacataagtatgtaaaacaaaattaaaaaactgcaggaaaaaaagaatagaaaaacatacactaacatgatactgaatttttactgactggtgagactaaagtttagtaagctatttttctttctaattttcatcattttccaaagtttccatagagaacagggcttatttttgtaactgagcaaaagtataataagatttactttaaaaaattaaaaatggagttagagtgaacctaccaaaaaagagatggaaacaagttatctctcttcgtttcccttcattggttttctagggaaatctgtattaacagcaaaacagtacccagtgtgcacgtgtgtgtgtgtgtgtgtgtgtgtgtgtgtgtgttatagacatagatagatagacagatagatacatagatatagatagatgatagatagatagatagatgatagatagatagatagatagatagatagatagatagatagatagatgatagatacgtagacagatagatgtggggaaggatataggattataaatgtgagttgagtaaaaattgtattggcctcatgatttttaagctgttttccagaatcaaccagcttgttcttatcctgtaagtggcacactatatatctctattgaaaaaacacattcatctcttcctctgaaaaacaggaaaaattctctcagttccctcaaccatgaggataaatgtctaaagaaattgagctgcttgaatgttcatatcagttataacaacttgtaccgagcagaggggttactgtacctgacattacccagagaataaaataaaatgagcatgctttttcgctaaaatgaagagttcaactcatttgataagtcaactgtgttatctctgaaaaaataaaccttttcacagtccttcttaaaaagaaaaaaatcacacaatgctataattcccagcagactttccattcaattagccattaatagaaatactaaaaagaggtgcttgagggaagaaactaaagctcaaaatttgatatggccaatcatacatgacatttgggattaagttctgccttttagagtactcattcattgaagtacatgttttattcaaaatagatctaatcaaaaatgcgactgagagtgtgctagccatatgagccatatggcgaacacgctggattctgatacctaattaaaataggagtggcctagccttaacatactactggaaactgtccttactatgaaaaaatcagtgacttacagattctttcatggcaagagacttgatcagtcacaagatcagactcaagccagtttcaaaaaactcttggttggaggaaacttaagtaaagttaaaaacaacaactcctctaaggaatctagcactcttaatcagatgtatatgtttaatttgcattttaattctcagagatggtctgcctttgtagcatcaactccgattagaacagagagacgggggaaggctatgctataaatcccggcagtttctaaatctcacctttccaaatggtcgctccacatcaaggttgaggaacactggcagggtaaggaggtggagctggatgcatagttgtttgtgtggtacctgatctgtgaacagacagaggatttcacaggacacttccttgagtatttttaaagaaaagcaaaaccaaaacctgcatatcaaagtcacattggctatgatcaatatggatgttttagatattaccttcctaggaccatctcatttctacttccatgctttgactcacacttatttcctcctacacttacgcatcaaatacgacttgcaggcagagaccatgtctgatatgactggggaagttatcacagcacttgttaaaggctgaataagaactcattgacctcaagtgattggtgaagggaaatctaattcaaccaccctccagctgattatttttcgtgatttcccattgctctgggataaagaatagaattcctaacatgacatcaaaggctgttttatctggcctcgggatgcaatttcaaactcttttcaaactttttgcctttttgatcttaaatgctcaggctacactagccatcttcgaacattatgaacagtgtcatccttcttcatacctcagggcctttgtacttgcactttcttctgcctgcagtatgcttccatttcttcatcacctggctaacttctactcatctgatagatctcaacttggagaatcactttcttggagaacatcctgttcactaggactggtgcctcactatatgacatctactattttttctttcaggaactcatggcatatgaaacgtatagttatgtgtgtgattatttattgatgtgtcattgtacctaagctataagcttcacaagagcaggaactgtgcctggttttgcttaccactgagtctccagcagctaccacggtgcctggcacagaaatcatagtggataagcatttgtggcctgagtggacaatgctgcacagccagtcctgaggcccatccctcaacagtattctccatattacacatctcctaaattcattggatgtcacagcagaaaaacgattccttttttttataaatttctcagtaattgtcttataagaaaaagacacaataaaatgaattcctcataaaaatttgttacaagagaaaggagaaagaaataaaatccagtgtttcttcagtcttttttaattggctttctaaagtttttttttccttaaaaatttaattaagattatcttaaacagcacggccattttaagtggcatggcattatacaagcagtccagacagacatatagttttccaatctttaactgtgttaagcaaatggatgatttctgttttaggtaggcagtgctgtgtgaagaatcataaaatgccatgttttctttgcagcaaaaattacactttgaccaatacctattccacagcaaacagaaaaagtttagtggcaatttgcacagaaattttatggttctggaagagtggtcagacttggaggagaaaggagaacaggtttttggggtctttttaaattttttgtctgcaagactttcaaagccccctttgtactcctatgtgagaagattctccatctgctaaagaacgatctggttaggataagttcttaccttagctgacaactaggttcctcttcctgctattatgctgcttggttcttatttagaggcctgctttaactaaggaaatgcccttgggcttgcattatttgttggctaaactttagaagcagactacagctgtaggaatttcgatatcacatacctgtacaatgtcaaatagcaggagattaaaaaaaaaaaacctaaagtaagaggcactgcaaggtagtttgtcaagagccaagagttctgcagcatatgtttccctagtggcactgtctgtggagcacagaggatttttagggctgtgaaactaatctatgattccataatagtggacgcgtcattatacatttttccaaacccatggaatgtacaacagcaagagtgaaccctaatgtaaactatggactttgggtaataatgcggtgtccttgtagattcatcaattgcaataaacataccactctggtaggggacattgataatggaggaggctatgcatatgtggggccaggggagtctgtgaaaaatctctgcacttctcaattctgctatggactgctccaaaaaataaattccattttaaaaaattgctgtatattggggattatatatgatttgatctactaatagccttgttactactgtttctgaccaaagttttccttctctttaacatatcctgcatattgtttccaaggcaaatcttggcaaatcataaatatctttgaaagtttcccatttctaaaagataaagactaccatatgtcaggtgatgccaagctcctttgcctttaatttcatttcatgcttaaaccctttaatacactgatcttcattcacatcaaatatgacctgtcctgaaagtataaggataagcaggtactaacgagcctctcttagacatatcagctcttgcagccataaagattttcctttatgctgcctaggatcttcccgtctgaaataaatcttgttcttgtttcaactaaacttgcagctctgctgtgttcttcccaaattgccaagtatataagatatccaatctgccagcaaactttatcctccctttggatgtgagaccccaaagatttcaatttagacagctttatttactaagctgtgttacaggatattttaaaataattcagttaaggtggttcaggctatttaactgcgtatttggagggagggtcggtgttgatcttccaatttgaatttaactcttgggccaaattattttcctatggcaattctgaaagaagattgatgtgtaaatgggcacgtcacagacaccaaatggagactccagaaacatagctcatttgtttggccttctgctatggctcatttgtggatcctgtgccatttatggtttagctgaggatgcctgatgcctgtattcacagagccatgctgcctctgtgggctgaacactatgctagtttgtctacgagattccttccagaatgacccagctgtaccacagggttatagctactttccatcatgtcattaatagttctttctgctcacctacactagctcactaatttatccccatccactgcttgatcctgaataactgaggactatgatggtctgtgctgtcaccttcagaatttcaaggccagaagtgtaacttggcataaatctagctagattttgaaggaaaaagagaaaaccatcctagaattccctctcttcacctctgattacttgagtccttgttacaggtcatcccgctcccatagctatcccctccctcttccaacttcctgaccaccggctcctttccatccactttcagatatgtggaagtttcccttgtcttgggaaaccaatacacacaaacacctgtgcttgactgtttgtctctactccttcctccaagtgcagtcgaatgttttgcctccctttaacaccagcttctttaagtgacatgcagtctcaggtgctcctaattcctctccttttagctccctcctaaacaactgaccagaattagaaggtcctctccctttgtcagaaactgttcaaacactttacaaataataattcatttaattatttgtaatcggtactcttatcatcttcacttgagatatgcagaaactgaagcatagataggtaaagtaacttgcctaaggtcacctccagatgagtggcagagtttgaattcaaatgccagcagtctagttccaaaacacatgtcctaaccacactctactgcctcgctccctccaaattctataattggttttcattcctgtgctaataaaactagtctcttagaaacttttggtatatgctctcatctttgattgtagtactcaggctagatatacctgtattgcatattaagttctagtatttacaaacctccccccactttttatgcaagtataatgaaacttcattaagctggaatgaacacattattctaataagggtagaactaaattttatattgttcgtgacataaaatagtcttaattggtcaaattaataagcaaaacaaaaaattaataaggtaataggagcagcatttgacctactcaagggggaaaatatagataattttagaaacacaaatccaggcttctgatatcagaggagtctttcctgatccggataataatatgtataatgcacttattgattcctgccttgcaggagtgtgtgctctagttgggaagcaattgaaataacaagaaatagtagaaaatggcacatagtcactctccagagcataggatggtgatattcaccatcatctactttgttagaatttgcagggtatattctgagcactggcaagttcttcttaggcaccatgccagctgccaccaagagggtagtgatccctgtgggcataaagaaaactgcacattttaaagctaaaaggagccttggagatgatgtaatccaactcttttatttacagatgaggatatgaagccactttcttttacagtcacaaagctagcttgcagcaaagtcctatctggaatctagctttctctttctgctctatcactaggcccaataatagatttgtagatttaatccacgcataaataccctagaacataccttattcatcaaatgcttgtttcttaaagaaatgaaagtatagataactgagcagggttaaaagactaaaacatgtgagctagccaattatactactcagtgagccccacaagagcagagattttcacgtttctgtttgttgatggaccctcagtgagtaaaccagagtcagccacaacgtggtttaattactatgtggtgtttgaatgaatgatttcttctacattttttatatgcaatgtctataagtgagtagatattatttctattttataggtgaaaaaaaaaaaagctgagtgaagttgacttgctcaaatctagacctagaaccagaactagaaaccaggcttctggtgcctaattcattatttagctgtaaaaagattgctttcataaaaaaattaattgttattctgtacagagaatacagacagatttgtcacttcagcaaaattctgaggaaatgggtacagctgcacgttatctactgtcattatttacttgctggtcttttgggtgtgagccatcatttctagtccggggcctgctatatcacactaacaacaaaaataaacggtttccccttcttactttccaaagtttccttcctttcttatctttcctctcagaattcaaactgcctggagaaacaaagtgggcaggctggggaccgtccttccattgagcgttctcacaccacttcgtgagactctgatcaactcaaactatattaaagactccaatgccttacaactgtctcctcaatttaatttcatcttttggagtttttacagcctcactatctaaagagattatacagttactaggctttgtaacttctagcactgcttcttgaatcttcatcttttaagggggttctgtgtttttctctttctacaacatcaaaatatattcttaagataatagaccttaaatgcagttatactggtctcttcacaatagcacagattgtagaagccttaagaattcacagaaaggggaaatattaaagtaattgaggggagttgaggtttcataaggaagtgcagagcatgaaaagaagaactggaagggaggcggggaagtcttgaacaaagacaggactgaatgagcaagagtggaaggcagagagcaaatacagctagttattgtggatgtttcacttttggactaagattggataggggtggatgggaattggagaaatagaactgttaccactttcaaataagtggggacttcgacatagtttggggggattgatagccaaaaaccttaggcaggaagaagggtaaactctagaaatattgcccagctggaatcctggttccaccagttattagctgcgtgaccttgggcaagttactgcaacttgctggccctcagtttccttcttggtggaatgggaataaaggttgtaactacccctataagattgttggtggaattaaaggattaatgcaggctgcccattatgtctgtaatcccagtgctttgggagacctaggcaggaggattcctggagcctaggaatttgagggatcccaggaatctgagccatgatggcaccaatgcactccagcctgggtgacagatcaagaccctgactcttaaatttttaaaaaaggggttaatgtatataaaacacttagaacagaatctgatgcaatgacacaaagtaagcactcagaaaatattagctattcctatttcagccataacaaacaggccatttattatgctagcctcacctagaggttcttgtaagggaaattccctggcccacaacttctgaaggggcaactacaggtcgcctattttgtgcaaagattctgtacattttaggcatacctgattggacaaggtgtgcaagctcaagcaataggttagccactgatctatgactttgccagtcaaggaacagtgaccttataagagacttccttttttgagaatgtcaagaaaataaggaagattagtatcaggaacagagccatgaggaagaagatgattaagctaaggaattatattgacaatacagagaaagaataggcaactgttaatagaaacaaaattatgacaagtagaaaataactgggtccaataatggtggacaataggcaagagattccatttactccagttgttgattttcaggatcttaatctactctccaactccagcctacacactccaagccatactattgtttctttttctttctccttttttttcttttctttttccttttcttttctctctctctcttccttccttccttccttccttcctttcttctttctttctttctttctttctttctttctttctttctttctttctttctttctttctttctttctttctttccttccttccttccttccttccttctttcttttctttcagacagagtctgtctctgtcacctaggctggagcgcagtggcacaatcacagctcattacaacctgacatcctgggctcaagcctcccacctcagccttccaagtagctgggactacaggcatgcatcaccacaccctgctaatgtttttattttttgtagagataggatctcactatgttgtttaggctggtctctaactcctgagctcaagtgatcctcccacctcaacctcccaaagtgttgggattacaggcatgagccactgtgcatggcccataatgctgtttctattacaataaacctcctcttgcttaagctaacataagttttgatctatttcctatggtccaaggaacgtaaataaccaaccaatgcaaacaccttagatgatgagtttgggtatccaacacttgctttagtgatccctggtacccatcaatcaattgactcatggccctccagtgcaccctccatgctgcccccacagttatcctcactcagaatgggctcccattctttttgacatatgcacagactaattttctttcaagggcaagttcaaattccactttctccatgaatacctggggactatactggacagaggtggatccaggttttgtggcatctgaagagtacaaaactttctttaataaaatgaatataaagctaggtgcctaggaaaaggcctgtgaaattgagagactttgaaacttcaacttcattcacttccctgtacatctacttctgataccaggttaagagggactttttctccatgaaattattctaccaggtatattttacaatactgtgtgtaatcacacagacctgctatataaataagctcagtcttacacctgctgcctctcactttgggaatatcatttgtgattggactgcagtattccaccccccaggctgttgggaagaaattcctgatgtctgacagatctactgtcagatttgggagggaaaacatcgatcagtatatgacactgctcctgctcatccagcatctagtgtatgccacctaatattggtagctaagccattctccacacaattgtttctaaagagagcctgctcattacacacatacatactcagacatcccaacatacatgttttgtaaaattgcttcttatttttctattagccttaaaataaagacaaacatttatttcatgggccacaagtctcctgtcatgtttccaccatcattcctctctgtctcccactccatatttgcagagctaaaaaatttactgtccatttgtggacatctatgcaagggagcagtcaataaacattaggagtagttatctctgctttttaaatttcactgttttttcattttctccttcctcattcacccttggctcagttgaagttctcggtaaagactcataaataggtgatagagttgttaattggcttaatttaatcattgcacagtgtaaacatatatcaacacatcacaacataccccataaatacagaacatatacagtgattatttgtcaattaaaaataaggtaaatcacaaatttctaaaaagaggctaaacaactaagtgaataaggagctttatgagggtgaagctttgaagaataaaaaaaggaggctccccagactgattagaagcacagtagagagaggacagccacctagagaaacagatcagagagagcctgaagggaactgtggaaatgcaaaaccatagcccagagagagacctgtcaggtgacagccagaacctaatgactccctggaatcatcagagtgctcgagagggactgcatttcatgaagtcacccaggatgtgcttgagttttttaattaatctgaaaaaaaaaacaacggaactttctatggctagaattggggatatttggaaacatccagagtcagttattgaatatcagtaccacttgattatcagttccattgaggcagggttcaaatctaccttgtttctgctctatgcccacatatcacagtgcctctcctatagtatgaactcattaaatatttagcgaatgaatggataatattttcaacaagactcaagctctttgaaatcacagactgtatcataaatgttctgtaactctaaagaacccagcacaatgcctgacactgagtgacactagttatgatttgctgtctgatttagaagctctttatatgtcaaagggagatatttttttctttaagcctggtgataaccacgcacacctggtcaaattcacatcctgccttatcttttatgtgctcccagctctataaaggtaaaataagcaaaaggaagaacaattattggtatcaaaaatacagtaatctagagactaatccttccctgaactatctttgtcacttcctgattcattgaatttggtcagtttgttccacacgtagagcctcctggctctcagaaccatgaggaaacagccatatccctggaagtagactttaaccagaggctgcttcctgaaaggtcctagtccccagggatttattgccatggaaagcctgaactggccggaagacgaacggtacacacaacctttgggttgagtatagaaaatgttctgtatggtttagctgttgtgactatctgctatgttgctaatcgacacaaatagtaacattattaaagttcattaaggctgggtgtggtggctcatgcctgtaatcccagcacctttggaggccaatatgtgtggattacctgaggtcaggggtttgagaccagcctgaccaacgtggtgaaaccctgtctctactaaaaatacaaaaattacccaagtgtggtggcacacacctgtaatcccagctacttggaaggctgaggcacaagaatcgcttgaaccagagagatggagattgcagtgagccaagatcataccactgcactccagcctgggcagtagactgagactctgcctcaaaaaaaaaaaaaaaattcattaaattaacaaaattattctaactattcaaaattgctctactaataaaacaataagggtaactctgcaaggccaaggtgggaggatcacttgaggccaggaatttgagaccagcctgggcaacacagcaagatctgtccctaccaaaaaagaaagttttaaattagtcaggtgtgctggtgtgagcctatagtcccagctactcaggaggctgaggtgggaggatgagaggatcccttgtgcccaggagttagaagatgcagtgaactatgattgtaccactgcactccagcctgaacaacacagtgagaccctgtctctagaaataaaattaaaaaaaaattttaagtcaataagcaaagcccaagaactcacatcttagttgataatttaaaggaaaaaaataagaaaaagatgtattttccaaaaacagttaagaataaagttacacaatttagaaaaattaaagagatattttagtgaaacaacaaaaatgtactctaaatcttcaaaaacttccaaatacattttcttgaattggtgataatattgtcttccatcccctccccactctcatggaaacccttccatcacgacagccctagggaaatgggagagctaatgccaacttcagcagcaggaggaaacctttgcaaggaagggcctttgccgacaaaatccttctagtgctagaagaggagacagcatagaaagaggagtaggagataacatccttacttctccattacgatggcctcagagtcaaaatccagaagcgggagaaagaacagaaacacacagagaatgaagaaatggtcacaagctctttagtacacaggctcatgaggtgtcaccgcatgcgtgtgtggacatgaaggagaaagccaattatgattccctgactctcctccagcctccctgaagtctccctggggcttatggaaggcagtggaaagctgaacaccatagagactgccatggagttgctattgttggaggccaaaagagtaagagtcatgatcaactcagtgtaccactggaggctatatgagtaaacagcaaactgtttctcataaatgcagaatgttggcgaactgacaaactgtgtatgccacccagaaggactacaggagggcagtcacaatccaggcacaagtgtttcttgtgattaggcaaatctgaagcctgttagtaataatgtgaacctgtgatcaattaagcagctgaccagtcgttacctcctcctccctgctctttctacccaataaatacaaagggctgcctttgctcgctagaagcagggagctctcttcttcccctggacccttccttaaaatagttacttttgtcttaagttttcatttctatgttcgtcactttgttcagtcttttaatgacggtctcaggcagtaacagtagtgacggtctcaagtagtagcagtggcagtctgtcacagctatgattagggctaagatgacattgtcagaggcatttgaaccagagcaactctgaaatctactgggctgcattcccagatggttaggcattctaagtcacaggatgagataggagatcagtgcaggacacaggtcataaagatcttgctgttaaaacagcttacagtaaagaagctggccaaaacccaccaaaaccaagatggcgacaagagtgatctcaggtcatcctcactgctacactcccaccagcaccatgacagtttacaaatgccacggcaacaacaggaagttaccctatatggtctaaaaaggggaggcatgaatactcagccctttgtttagcatatcatcaagagataaccataaaaatgggccacaatcgactctcggggctgctttttctatggattagccattttttattcctttactttcttaataaacttgctttcactttactctgtagactcaccctgaagtctttcttgcctgagatccaagaactgtcttttgggatctggattgggacccctttcctgtaacgccatggcagagacagcagttcctatgaggggacgagcctaaggcaatggactggaggaaggaagtggctgtgcctcaagggtcttctgtgtcactgagatgacagtggggtcaaggaagcaggaccacaaggctagaacatgttgaggaaactgttcccagatttcaccagcactgaaatcaatggtggatgccagtggctgtctagcaaccaggcaagacaacaattgattctggggatttcagggaggacccaaagggcaggatcaggacctgcttttgacaagctgcctcccttcaattacctgcattatcacaagggtatgtgagctttctccttcacacagatgccatcttggctaaggaaagggcgtgctgggagaaaccatgaaagacaacatttgcctcaaagagactgaattaacccaaaatgagaaaataatggattgataaaatatcttcaaccgcaagatcaagaacccatctcctactcttctacctcctagctcctgctccagccagcagagaccaaacatctgtaagagttttgttctttctagaaaaattttaagcagatatctttaagcacctaaaattgtattaattttacaattagtatttactataattgtattacagcctagttgtacactgtataattttcaccctggccattagcaaaaacagagactctaagagccaaacagatatcaatggccctaaacaaatatggttatggttctcccctttataaatctgtgaatgtgagccttttcttttccagtttgatgtattataaaggtgaccaggaaggaaatggaaacaatgtcaaataagaacagccattctaattccaaacaagttaagaatatatgtctaaagacaaattaagtctgacaaaacgtataagttatgttttgttgtataatcagtaataggagtcaatcaagggtctcattgcaattttatctacagttttttacaaggtaaattacaagaaatatagctcagataaaaagaaaatattaaatgcactcttctagtatattaccacatcagtaattgagaaggattaaataaaagactataataaatatggtaattgcactaagtagttccatgataaatcgattcttattctccaagtaagagctgatttgattgatctctatgcacttcagtgttctggaggatttcctagtccctgaagctgcaggtgtggtcactgtcaggggcaaaacacttaacacagctgagaagtgatttgttccctgtggtcccagctatgcataggcataaccacaaccacccaatataatcaaattaaatcccagctagtgtgacactgccataagaataatgattggatactagcagaagctgtcaagggtcttttatacatccgataaataaatccaactgactagtgaaggtcaattcaatttagcactcattgattacatatctttcatgtgtaagacactgtgctaggcattaaaagaaaactttgactcctcaccaataaaaatgttttattgttaaacagctctcattacgtagtgtaaattgtatgtagtttgtggttatgaagcgtctaaattcacaatgcattctcatttctctcagtgacaggagtatcaaaataaaaatgactaaagccccattagtcacaatatgaccatttggaatctggatcttacataaaagtgtttaaaaactcagttgtttaattttaaatatgaagtaatacagcaaattacttatcattcagcttctcttattcttaataacatagtaactgtgatcttcaggcaaaaccttgataaattctttcccataaaataacccataggaagttttaaaagtcatgcaatatgggtacataaaataaggaaccattctcagactatggcagagccttccaattgcttcctagcatccactctcctctctttctaccagagccctgattatgaggtggataccgactaaaacactgcatttccagactctctcccagttagctgtggcaacgtgaccaaattccagccgattatttgtgagcagaagtgatgagacttctaaaattctccttaaaggaaagaggcacacccttctttattccttcctccttcctactgaccagaaggcaaaataatggctggagctcgagcagctatattggattatgaggatgtaaactaagaatgacagctagaaatagctccaatctctgataaccaggaagtagccagatcagccctggactatctacatccagaatttacataaataggaaagagatacccatctgtgttcttttaatcattgttttatttattttttgtttttttctgaagctgaccaaaacctaacatagtgataaagtcatcccatcagccagaataaattctgagcagttatcaagagaaaacttaaagtaatgtgaagagaagccacacttataaaggaaaccaagagctttcattatagctagcctaaaatgaagttaattacctaaattgttcagtcaccaaggctttgggagttaacatgaggaggctggttttattgtgtatcatgcccagaagttccatgataatttcaaattgtttgcatgtaattccccccccaaaacttgtacaatattttgacattcttaaagaggagaggtgacacagtatcatactactgtgtaataaaaatctgctctgccctcctaccgggtttacaatacagatagtggcacaggaaagcgctcagaacagaaatcagaatgcttgaagcttacttaactcactacagacctggaaagttgcttaaattttataaagcttggttataaggataatgataacagcagctccattttctacgcagggaagttgggataatcaaataaaataaatgtatgtcaaagtgttattgttgttactaaaatcattttggtgctcacttatgtttcactgggagaagcactctgttttcagttttctggaataattaccttttaaaagggactcttttttgcctgcattaacttattttctctaccttctcactttcatggttctgcaggataattttatttttatgatgtctgagttttcatgagctacatgtatgcaaatatttttagctaaaacaatattattgagaatgtgtatttggctaactcataactgcttattttgaaactagctgagaagcacttggactgagactgaaaataaaaataaatttattaacaaattatagaaggctgtgcagttagaatatgtcacttgctgattgaaatccaagtgctatatgcagtaaaatttcttcaacccagaatcaagcatccagacatttcacatagcagcatttactttgatagtattggccagttatcaatggtagtaaaaatgcccctggacttacaaaatattgaagtgccttctgaattatcaaaaacatattaccagtcaatggaacctacacacacacacgcacacacacacatgcatatatattttcacatatatacatgtatttgtaaaaatatatatgtgaaaatatatacatacatgtatggatgtgtgtatatacacatcaagcttctgggcatgatatacaatacatgtatgtatgtgtacatatgtgaaaatatatatacacatacagctgggtgtggtggctcacggctgtaatgccagcactttgggaggccgagttgggcggatcacgaggtcaggagatcgagaccaacctggctaacacggtgaaaccccctctctactaaaaaatacaaaaaaaaattagccaggcgtggtggcgggcacctgtagtcccagctactcgggaggctgaggcaggagaatcacttgaacccgggagacggagcttgcagtgagctgagattgcgccactgcactccagcctgggcgacagaacgagactgtctcacacacacacacacacacacacacacacacacatatatatatatataaaatacatattatatctattatacatatgtatcaatgtataatatatatatacatatattatacatatatatacacatatatgcattttatatacatgtatgtatgtacacatataaatacatgtatgtacatgtatatatatttgagacagggtcttgttctgtttcccaggctggagggcagtggcataaccacagcctcccaagtacctggtactacaagtacacactactacacctggctaatttttatgtttgtagagatcgggtttcacagtgttgctcaggctgtgcttgaatttctgggctcaagcaattctcccacctcagcttcccaaagtgctgagattatacaggtatgagcaactgcacctggctggaactaaaatatttaactaactgatatgtaccactccacaatcatataatatggagattaatattaatggcaataaaaacactagattatctgtgtttacctggagcagaatgaaaaatgctacaattccgtttcacaaatagtgaaggtaacatttaatttcttgctcaaaagaaagcaggttatttgaatttattgttgagaactgccttctgaacgtcattcacttcataggcttccttccaatgtgcttctcattgaccttgggcttccatttgattaataataaaagtcacctaaccttaaacttcactcaattcttctctctcagacactcacacacataccattagaactcccactctccaatacaatctagaaaaacaagacactctgcaaggatatatactcagggcttggccctaccctcacacttttgacagtccaaggaaacatggagaaagaggagctggcctgtgcacattacactttggttttactgctcctttcttggaaaccctactcactctctgcccactatccccgaggctgactggtgagacatttcctctcttatcctctcctctccaaaccctcagtcttcccttatgagcctgctttctttctttaattttccactgctactttcattacactctctgagccagaatactagggtatagagaatatatgtggagtgagacagggagggaaggtttctagggagtgagcacaaggagaccctgacaccagtcctttctgggaactgcagggagatgcattccgtgcctcagtctctgaggtgggcccagaagagaattttgaaatgggctacaatagcttcaggtgtctgtcttctcttgagattcgttccctcccagcccttcgtgtctttcccaggtttttccaaagaaatcctaactctaactcatcattaaggcttaactgttctatgtcccattcctctatggccttactaagtggctagaggtaatggaaataattatttatgagatatgagagagtgacagtgatttactgtgttattactcagataatgcatttactttctaagaagggccttttgtgtccttgctcaaagaaatgaaaattcttagattataggtcttatggtggatcctataaggttaggaaagcttttggaaaccctttaaacaataataataggctatatttaattggttatactaaatatcaagcacttttctaaaagctttacacattttagctcatttgatgttcatagtaatcccagaggaaagtactaatacctttacaaatgaaaatactgagccctgaggagggtgagtaatttaccctcagtcacacagctagtaagtaaatgaactggggtttgaacccaagtagtctggctccagaatccctgctctttattcatccagatagctgtcaaacacagcatcaaggctgaagttagtctgggagtcagaaggcccgagttctagagctggctctgcctctaaggagctatgcaactttgaacaagccacttaaactctctcagttgaactgaatttgtggttgatatccttgtttttttggaagcagagcgatttctttaaatgaaatcctaattaaaagcctgatatacacaacagataaaagggagatattgagcctaggctgctgttatagcgacccacatgttgttcaaaattgaacccttcaccccttactaaagatagcgctctgttgaaccagttgaactccttttgactcaatgatctctactgtttctttcagctacaggaccctatgtaaccaattgtgtagacacacctagcagcttcatgtctcaaaatgtgctcttttctctaccatgcactcaggtggaaacagcctagtgttacagagagaaaagaggcaacacttgagcaaccaaggacatcgatttcatcattttacttgatttcctttagggctcaaccaaataaaagatactaattaaagcctcaccctacactatatatttccctctgagaagcagagatgagaaatgcagcttctaagcacttagcacagtgactaccatcttcgaagcatttgattaatgatcatccatgctaatttgaatactatagcaacagtataactaagacccaaaacatttataacaacattgccctgggtagaactttttgagattaatttcattagatacttgaaaataaattcaattaaccttgtttttcttcttcaataaaattagatatgaggtccctcaatgttaaattcccccctcttctaacaagtatatctagatatagatctggatatacttactttcttcccacttccagatattctcttatgaacctcacttctctttttctgcatagtggaacacattcatctttaaaccatttgtttttcagtattactgtcctacgtttgttacatatcccccactaagaaagcagatgtatcacagatggtgtccttgttaaagggaaaacttctagagagacagcgcaagactcctgggtctttggtttgctttataaagcgcatgtgtatacatgggacatgggtgaatatgtctgtgcgatagagcttatgacaccctaaaagctagaggaatcatgctatactcattttctgagaaattcaccaagtattgaaaagtgaactggtcttgggcagaagtctacattttgtacagttaggctaaaatgtctaaccatgttaggctctccttttgcagcagcccattaacaaaactgaggtgtaggtgaagagggttaataacaaaaagctctgtagtctctggagagctcagaagaaagattttcaggaatgactgggaggctgctcaggtgtgctttggagttttccagtctttgagatgtgttacttgcattctttgctcctcgagggcatttgcatccccactgtggttaagtatagtaataagcagaaattagaagctgaatgcaaaccgagtgagtgaaagaataagggatgcagtgaacaataagaagaattgatggagaaactgcagtctagtgatatgaacacatggcaggaagcaaaaagaatttctaaatgtgaacagatcaaaaccctgttcaacttccttgtgccccaaaaggaggtggtcagaagttttcttcaaaggctcttcgttcttggaaggaaagtgttttttcactctttatcagcctctgacttcatagctgtgttaccaaaagggctgggagcaaggatgtgggtttagaccctgcggccaaaggctgctctgctctttgccagttgctctgttcctgccaaccacagctacccttctctcttctagcctggccgctcacctctcagcctggccattctccagctagggccattgcagacatctgaattaatcaaaaactgtcttcccttcatatcacctcagaaacttaatataagaacgtaagaagtgttgcacccactaagactagtagttcattcaatttaatattctctccaatggtgacaccaagggacctttaccgggatggaaaaagaggcattgtgaatagcaagcatgccaaaagtttggatgccattatctctaatttcagtccctaattatagttaactatttacggaaacatgtagtgtatgctgtatctatcaatgtggtaagtctgtaaaccttaatttttttttttttgagacagagtttcactcttgtcgcccaggctgcagtgcagtagtgcgatcttggcccgctgcaacctccgcctcctgggttcaagtgattctcctgcctcagcctccggagtagctgggagtacaagtgtgcaccaccacgcccggctaatttttgtatttttagtagagacagggtttccccatgttggccaacatattcttgatctcctgaccttgcgatccacccccctcagcctcctaaagtgctgggattacaggcgtgagccattgcgaccagccaaaacttaatttttataaactaaaacctcttctgggacatcattgccttttttttatttgtactattttttttggtcatttaaatcaatttaataagtatttctatgtctactgtgtatctataattcaaagccttcacattcttggaagctgaaggtctggggaggagaggaagtgggagggactgggacactaagattaaaatgatgtgtctttcattcaagaaggtaaccatccagtgggggagctagaatcacccacagctcactgtaatataagtagagcagtgagaagtaatcaccgaggcataaatgaggtgtttatggatgtacaaaagagggaatcagtaattctgaatcaggcataaggaaacaactcttagggtaggtgtcatttgagctgggctttaatgaatgagcagaattttcttcattgaaattaacatttaagcaaagtaaacactagaaacagaattgtgaatgtgcataatgtgtttggggagaggattcaaaaaaggctggtatcagtgttgccagaaaaaaattggaatggtagattgggattggtttactgagagctttgaacaagttaaagcttttgggctttgtacagtgggcagtggggaagtagtaaaggacactctaagtctctgctcttgaaatagatagtctaggacactctactatctccactattcaaatgagaaaaatgagattagaaggagtaagaaactcactctaaagaaagtatgaaagtgatatttgagctgaagtttcactctagcgtccaaatactacacctagtcttagtctttctttaaaaaaattttagaattattttaattgacaagtaaaaattatagtaataacatgatgttttgatatatgtcttaatctcaatttaattatttataaaataggaataataacaacactccctagctaactaaaaatttgatcaaataaaactacagatggtaaaatgccttagaaagtacaaaatacttttataagtgttcactattaatattattttacatttatcactattcaactaatataactcctaaatatagttctggaaaggaaattagtgttatttgatgttaatattgtctataaatgattgcattcctactgggctttatatatacgtattatctcatttccttgctatcttgtgaaataggtgttgttatctccaatttatagatgagtaaacagaggctgaaagagattaaaacctactcagtcacacagctggtaagtcaagaaccatacttcaaatttatgtctttaaatccccaaatcccttccataaggctactcattgccttccttattgatgatgctataaaccttggagtttacagtggcacactgaaatgacgtcttcagggaacaattaatgatgccagaaatttcagcatttccaacaaagatgtgagtgtctggttttttgtgctttaaaagagatgtaactctttctaatcctgttaagaattaggttgaatagttaagtagtaattaggcttgacttacctaaaaaaaaaatacccattctatcctactctctgagacaaaataatgtctttaagaataattttactgttgatttaaaaaaacttccctgtttaagtaatggtattggttccttataattattttaaactttaaaatcttccctaaacatttactgaatcatttgtatctattttgtttttgtttttgagaaggagtctccctctgtcacccaggctgaagtgcagtggcgcggctcactgcaagctccgcctcgtgggttcatgccattctcctgcctcagcctcccgagtagctgggactacaggcgcccgccaccatgcccggctaatttttttgtatttttatttatttatttatttatttatttatttatttatttattgagacggagtctcgctctgtcgcgcaggctggagtgcagtggcgagatctcggctcactgcaagctccgcctcccaggttcacgccattctcctgcctcagcctccggagtaggtgggactacaggcgcccgccaccgcgcccagcctttttttgtgtttttagtagagacggggtttcaccatgttagccaggatggtctcgatctcctgacctcgtgatccgcccgccttggcctccaaaagtgctgggattgcaggcatgagccactgcgcctggcctgtttctatgttttgaagtatatttcttggctgggcgtggtagctcatgcgtgtaatcccagcactttgggaagccgaggaggacagatcaattgaggttgggagttcgagtccagactggcaaacatgataaaaccctgtctctactaaaaatacaaaaattagctgagcttggtggtgcatgcctgtaatcccagctacttgggaggctgaggcaggagaatagcttgaacctgggaggtgaaagatgcagtgagcagagattgcactactgcactccagcctgggtgacagagggagactgtctcccaaaaaataaaaataaaataagtaaataaataaagtatacgtctcttctcttggttatgaaacttaaaaatatatacataacaggttagataatattgtacaaaaatttggtgattgttattcatgatagatttattcttctgaaatatgtgtatattttacacatagcaaaaaatgatcagaatagataataagcagagtttgatcaaattcatattgttggcagactttcatattcgatgaagtcaatccaataatccaattataattgttattaatgaccaccagatattctgatttaattattggaaagtaattgctgtagctctttttaaaaaaacatttttgctgttttatgagtagttttccaaaaatgttgtaaactgataaagtgaacatagaaatcatgaaattctagctttgagattagggtcaacaacaatgcatttagtgacacataaagcagaatataagccacatctgaagaggttgaaagcagaacactaagctcagcagctatattcagacaaatctttgtcttttacaccaattccaatattgtagccatagtatgactgttttgagacatagaatcataaaatcctgagttggaagaagacttaaagaagatatttgtattccatccatctacagcaaactccctagtggttttctggtatgtgcttgaatatttgaagtgacagggaactcattattgcttaaggtcagccctgccaccttagggcacattggtttagcacctttctagattaagtcagactctttctctctgtagcttcttagtccgcccttcagggcatatgaaataaatctctatttaatgtgacactccttcatgcatttgagagaatctcaccatggttcttagatgcagtcaggtttgaagggaaatttacaaagacaaatatttgaaagaatattaatcaaaaccataacaatgattaagtttgagtggtgaagtatagggaatttttctttggtcctcgtgctttcctgtattgcttaaattttatacatgaatatatattctaattacaatgaaagaaaatgtagagcgatttacactttgggaaagctatttaagtcctaaatgcaatcagtgaaaactgagacttcgctctgaagaatgagagaatctgaaatctgaaatctgcaagtgataaacctcaatgtccccacaacctagacccacatgatagaagctcattaaaaatgtgaatatgactaaataaatcaacaaatcattcatttaattggtggtcaaaatctacttggagacacagtcatcacttgggaagtaacagctccactaagaaccaagttgttactgctgtgaatccaagtactaagaggaaaagaatcacttccatcctaattcaaattgatttaatgccccttttaattgtgtatttctcaaatacatcacagtccggaaattctctggtagttctgtttgtgactttacagctagagatgaactgaggtactcagaaataaattactgttttgcttgaatctcgatacatctatgaaaattttgcacagggaacgacgatggtgcttattatgatgacggtggataagtaccatatttaaaatctggcgtgtggctgggcacggtggctcacgcctgtaatcccagcacttcaggaggccgaggagggcggatcacgaggtcaggagatcgagaccatcgtggctaacacggtgaaaccccttctctaccaaaaaacaaaaaattagccgggcgtggtggcgggcgcctgtagtcccagctactcgggttgaattcattcaaataaatgtcaattgaccccagagatgcctgagaactgttgactattgtcacacttacattgaaatattcaaaagacaatgtacaaaataagactaaagataaacatcaagatgtacaaatttttccactttatatatctatggataagttgcattctgaattcatttagtgataataatagaattagagtttggagacgctgagattttgtttccttgaacaaaatgttttgcacagttctaatcagtctgatcagttctgtggaaatcagagagcagtcagttgaagagaaaactggtgaatgaataaaatatcaaatgcatcaaatagatttcacctgttagcagaaagggatggaaaactcagaaacagggggcaagaatttttctttctgaaagacaaaatgtgctccactcaaactgcattgtattttaccagaagaagctaaagcaaatttcaaaattaagcagggagagatgataatcagaatagtttcactgatgacaaatggtctgccctaggtcctgaattttctacagtctcttaggagttcctctgtaactaggaagcacaagtatcttctgcttttcagtaagcattctcccaaattacaagtccgagaggacgggtaaaaggaaaaataaaaaaagagacaaaagccaatagggccaaaagagatgtattcttagtaacccaaattgtgataaactcttggctttagcaaaaaccacaggcctgtgtggaagtagaagtgcagtttttctgtacaaccatctgctgccaggaaaccaatagtttctccactgcagaagtggtcctggatcaaacaaggaaggatctaaatgtttgcagtcatgtgcacacacctagattggacatatggaccttcacattttttgctgagaatcttgtttgcttaatctaatcagcactcttagaaaagctgcctcaccactgctccccaaaattatttctggtggtttgaaaatgtccagacattgataatagagtcaaagcctttcttccatggggttttaaacaaaccctcgaagataaacttgaagcttctgaaactaatcacagtagtaattatttgctcatggataacacatgattatattctaaacccaagtcaggtgtgaaccccagctttatttctcattaactgttgtgtatttggtcaagtgacttttcttccacaaaccccagtttccttatctggaaagtgctgataacacctacctgctgtcattgacatgagaatttgataacatacgaaaagtgtaggtgctcataaaatggtatctgccactatggtcattatcaccagttcaaatttctttaaaacgttgttagtgttcatgtgtccctgaaagcattctctttccatttctgggagtttggttacttaacatcctttactattaagaagctcattttaaagcagatgtggtcaaaatgagtgaataattcaagaaggatgaagacatgggatctagacaaaggactatcaatataaataaaagaggcaaaaggatgaatagcagagaaaaccagaaaaatgttagactcccaaagtgggtaaagattatcagataggtttgggcacttggaagactattaagatttagccactgttccaaagcaaacttaagcaaattcaaaacttgatgagttcgtaactctagaaaaaaagagaaatgtattcaagaaaagaaacataattacagtactactgattcctcagtgaaggatattttcattatcatgaaaatgcaaacattgaatgttgatttaatgaaagtcagttataactataatgggagaatgggtgaggagagagctaaatccagcaaaatagaaaatcagcatataatgtctataaagttgattgagtgtgagataacaatatattatttaaaattatggtgtcatatgctagaaaaaacattgaaaaaataagctgaaaggagtagccactggaaagcaggtggtctaggggtagggttagaatggggactgtgggtttcatgcatgataagcctttcagcactatttgactttttaaagagatgcacatagtattttaataaaaatttatgaaaaaacttaagaaaagaaatacacatttgaggtataacagatatctctcttgctccttcacacacacacaaataagcacaagtgtataaaaatctatgtaacttactctttgttacaagagttccttagccacaaataaatgaatatccatcatttaacaattaaaggcataggatttagcagttaggatgaagagtaaagcaaaaggaggcagaaaatcttaacaaatggaagacatggtacctgtattcaaggattttgcaatttggttgagaaaagaaatccatctcattcaggagaaagagtgggaacctgaaatttctttttggagaaaaaaagaatctatacttttgagtcttgctatttttgtctcctagagttttcctgtgagctgttttccaggactcagaagagaaaagcttatctgtgtttagctgacaagaccaccttcatgacatttccagagagaaaggagaatcatggcttttcagtgagaagataccacatagaaatatcatccccttattttacagatgaggtactaagcctaaaagaagctgtgtatttttcccaagttcacacatcctgtctgtgacaagaaccagctttctaacgtcacttgtgtgttctggtgaatgtgcgattgcccaatactaaactgggaagtctgtagtaaacatgagatgagaacaatcataattaattttctaatattgttcaattaatgaaatgaatataacaaagtaacactaaccacttgtatagcactttcaagtgtctttactgggtgcaaagcctcatacctgtaatcccagcactttgggaggctaagacaggaggaatgcttgaggccaggagtttaagaccagcctgggcaacacagtgagacctgtttctaaaaacaataaaaaataaaaaaaataagcctagtgaggtgtcgcatgcctgtagtcccagccactggggaggctgaggtgggaggatcacttaagccaggaggctgaggctgcaacgagttatgatcacaccatggcactctagccttcgggacagagtaagaccctatctcttaaaaaaaaagtctgtattttcattatctcatttaattgtaacaatcttatgctgataagaaaattcaagttgattcagagacatttaatggattgtcaagggcaaataaccagtaaataacaaatcaaataattcgaccaaggtgttctggctccttgtccaatgtagaacattttctctttcattatgacacacaaaactttagagagcatttttgtaaaatgactgtatttaaaatatactttaaaatattttaaattacatatggccaaaataaatgaattagttcagctttggattattaatagtctgaatgaatagtcacagggatattcaaaacggtcatggtgtgagaaaatctcggacagggataagagtcatgcatatctaattagagctgcccaacatttaaggcagtgattacacttcatgatatgccaatattatttctccaaaatatttcaagtaaaaacccgttttgtcccgttaattcttaaaataaaagggttgggcaaaaaatttaaatggtcaagaaatgttgaaactaacaaaggacaattgcttttcctctaaaaacagctcctcctggatctcctaagaagaagactccaactcacagaccactgctgactcattaaaatcaacttgtaatgtcatgcacatactgtgtatctgtccaattcatgcacatacatccagaatgtaggatgctttggtatcaaagagctgtttatgattgacaaatacttcaatgctctaagattccattttcatcttctttaataaggaaagacaaatgcaaaaatacatgtcattaattgctctgcatttttccctccagagaaatgcaaaccataaacatcagtaagattctactaatagctttaaaagttggcttaaaccattattaattatacatttgtaagacggtctgtgactgcatgccttgctttcttattcaaaggttcaatcaataaggtcatccctgccacttgcactctgaatggcaatgcacaaatttagtgcctatagaagtataaatagatatgtgtctacatatatatcctagtatcatgaagttacattttaaccatgtagcttgcttgtgtataggagattacatttttccagggaggtgggtagatgacatttttattgattttttaaatagctacattataaatctctcttgttgggccagcacaaggcaaaactaaaacaacatctttattgtaaggcaaatgcatctttggataacttgtaatattttttttaaatgggtctttcacttttcaacctgttttggggtgagtaacctatattgctcctctcagatcaaattgtgttatttcttatcatcacatgattgcaacttttagagaaaaatgattgcagttccttataataattctacctccagttacattgatttactgttatggacatatcgttagatagatgtcaaggaattttggcattcactgggaagtaattacattgacttagttccagttttaggtttgagtttcctaaccaaacgtggaaagctttgcagttccttaaatcatagaggctctcacagaaggatttcttaacctatgggcataaatgccgaagaggtctatagatagacttcggcaggtctgtacaatttctgacactgtgcaaaaatcctctgcaccttttgtgggagtaccacatacctatcatcaatttctcagaagggtcgttgatcctaaaataattaagaaccaatgttctttctaattaaatatcacttaaaacagcctcaattgtggatttcagaattattttctctcaatgttctttgcaaaatcagattcaaacaaccttgtatgttatattcaaagccttctttttaaaaattgcataagaatattatgcataaacactgattatccatagtcttttgtaacttggcctcagaaacttatggttaacagattaggtccctcattctaattgtatttttttatcagactttgattttcagtgtggtaggtaaacccatcttcccattttatacaaacaataggtttcagtagtgtcagttatagagatcatgacttgaactctgttatcaaaatgtatgataataactctagacctgaggaattgaagactggcatgaactcagaaagtcacaggctcatcaagagacattgcccaatatttgttctttgataaaaatcatctttcagataaaatgaagcttctgcagctttgttatacagactaaatatgcaaacatctaatttaaggaaatagtttgataaattagttttctccttcggagagaattgtctggaaatgtgtacttaaagatgtagaattataacagattttttaaaggtctttggagacaaagactcactttaggtatcactttgagagacatacaaaccctaattccttttatcaaaaagagaatagagattggaggcatcaatagaaagatgatactttctaagaaattgtgcctaatcatctgtgaataggtttatgtgattatggaagctgatcagggcctgtggtgatccaggcattgttgtagtggcagcaccacatttttgtgcagtcagacacaaactggcattctagtacctgctgcttcaggaaatgccagaacagtgcctatgtggaccaaggccccacagatggcctcacccctcaaacccttgggtacatagcacctgtttagtggccctggcccttgcttttaaggagtggttccaactgagggcaattatgtcccccatagtacatttggcaatgtctgtgaatatttttgattgtcacatcagagaggtattgctggcatctcatgagtagaagtcagggacattgggaaataacctacaatgcataggacagccctcacaacaaagaattacctgtcccatgtgtcaatagtgccaaggttgagaaaccctgccctaaagccatgccactttgatgaccctgagaggttatatagaaaggatctatgtagagccacactacccacaggaccactaaagtttagtccatttgacagatttggaaactgtaatgctttggacagagtgaagtgaaaaaatatcctacaatgtccttcctttacaggttaacacctattcctttccccaaaatgaggattaaatgccaccttctacaggaatacctcccatgttagcatcacgtttccatgtattctcatgataccatgtgcttactctaattgcagctctgattatttcctgttcccctaccaggttataaattcactgagagcttgctgtttttattaattcttgggtcttagtacctaccagagcttggcacttaataggtatgcaataaatatatgttgaaggaaagagcaagcctgcagaagtgacttaaattctccatgacaaacatccatccagaatggatttactcaaggctagtactagcaagcacactggccccaaggacatttggccccatgccctctgaggacatgaaactggggaatgtctcaccccatggcctgtaggtttaccagcatgatggtggaaatttcgggtgagccatagccatagtagtcataatgacttttaaattttatttatgtatttattttaataatcacaattgtacatattcgcagggcacagagcgatgtttcgatacatataatgtatactggtcagatgagggtaattagcacatcatcatctcaaacatttatcatttctttgtgttgggaacattcaatagcctccttctagctatttgtaactgtatattagcattaactgtagtcatcctacaggagtatagaacactggaacttatttctgttatctctcttatctagctatgatttttgtatactttaacaaaactctgcctatcctgaaatactaaagaatcaagattgtagagacaataagatctggtcctaggcctagaacccccacatgggaggaaccagggacagaattctccttggatatcttttctcacgaagaaagagggatacttttaatgagcttgactttgcagtctacatttgacagagcttctcccttcattgaagaaggaagaccaatagtgacctcaataagtacatgaacaaatagctggggatcccagtattcataaccaccaatactcagctcacaccaaaactcaggcacaagtcaattaaagggttgtactatgagcaaggacaattcttattttggctgcctgtaaattacaccaaaatccacaagaaagggaaataactaagcttacaataatttataaatgcactctgtgttaagaacaataatcttgagataataaaacaaagaaacatcatgttgaaaatcggaaaagagcaactctcatatttatattaaatcaacaataatttgttatgcacatgattatggaatataaaacaaaatgatctaatttttccagatagcatggggctgttgcattacattgtgctattatttgacaaagcacatcaaatgggatttcagcaaaatacttaacatagttataggtaaagtattcctgacgtgagttgacatcaggaagaaaacacagcgacatttcagaatattcaactttattttccattgacaaacacgacataaataacacacatttattaaatacacagactagccatgacttgaatgccagcaaaagtctaacgtacttttcatacgctcttttattttttgtctccacagtattgaagaccagcctttaaaacatactagaagatatatttaaatacactgacgataactacccataaaactttacatagaggtgataaaagagacttttccatttaatcaagtatatagagatggatgctgaggaggagaggtgaagaacactatgcttttgatactgatctttacaatatggattaaagtgccaatgatttcagctcctcctaggcacaccatgtaaatagtacttacattcatttgttacaaacagatcaaaataatcagtgcctattttaattggtttgcttaaacaggcttacactatttgtacaaaaacatttgataaggagagcaagaaggcaaagtatttttttctctttcaaggaagagttgggaaggaagagagttcagcagtcaataatggcctgagtgaacttatcatttgctttgacagacaagacccctggccactcagtagtactactgatgctcaagtgttcaaagataaatgcagtcggtcccttcctctctttgcttccagggcctggcacaaaatgatgaaggttaacaggtagaaaatggacaggttttccatcatatctttttctatgttctctgccccacccacatgagtatcctttcaaaagtagaacgttgaagtgtattagtaaatcacacgcatttccctctgcttaacattacaactttgatttctacagacatggaaaactgtatgagaaatctatatttgaattactattaaagtttaatgattggctgtttttgcctagacgtttggcttactttaattaaaggatcaaaatattctaattctaaagcatttaacaatagcattgaagagatgcacaaatgataataacttgagaagtggaatcatctccaaaaatgctcaaaaaagcatgaaaaggctgacttgtttctgatggtgatctctttccttcttatctttactcccataataaattcttcaacaaagcagacttactacacaacagattctgatctgtttcacatattaggctactggcactttaaaaatatgaagttattatctctcctcttaaaaacaatcccagcctcatcaacaggaattatgtctgttactttctttctgtgaaagaatggataagcacagtagagtcaaggggactaggagaaaacagtgtagtttcaaatgaagaaatacataatctagtagatatctgggttgcttattacatgaaactgattgatacaaagcttctgaaaataagataatttttattctcagtaaagaaaatgtgtgacataaataaatataatacatatctgattgaattatatttctagagaatcataatgcactctgcttatggtatcataatgtaatggtatatgactaaacttatataaattataacccttaaatagaatcttcattttaggaattataaaagggaatatatcaaataaaatattttccctaattcttttatcatcatcaccacctagttagtttccttacaatactgaactgatgtcagcttcttaacaaatatgtatgtgagtttaggttggttattaaattttgtaaattggctcgatcataacctatgtcatgaaacatcacagacatctgtcactttgtcagcactttgttgcaactcagaaaagtcttatggactaggccacagttgcacaattctgcacattttttagacctcagttttaacagattttgagatatgtaaacatataaaacaagcaataaacaagcagctgtgaaaatttgtcattgttgatggtttgtacttgttatacagataaaaaatagaaattttaattcttcaagttaggctttttatgtgtttgtaataataaatactctgtagtctccctgtgtcattcagctcctagaatcctgtgtattgcaggagaagcttttggggttaaattatgaaaataaatagatattatgcatgtctaaaatttcaaagaacaaaagttttctattttctttttctgagttgatctcaaccaaaagaactattagtgattgctgatgtggagaaggttgaaagctgaccaataatttggagtcaaaaagaacaaaattataaaaagcgttgaataaataaaaagcctaatctacttgaaaatccaatattagaatactgccacagagtgacccccttattaaaatactgtttgccagtttttagtttgtctgtcactcaatgccaatgtgctcacaggatctttcatagttaacttacatgaggttttgcattattttctgcaacatggtcggatatttcataaaataaagaaatgtaagtagaaatatatgtataccctatatttcagactagtttaaatctggcatgattaaacacttacatttacctaaaatatcttgggatatatacagcactaggttaacttggtaaatattgagataactcatttttgtttcttcaacttcaagatatttttaagacattcatcatacctattttatttgaaaagtaaactgctctcattaagtaacatgtgatcattcttctctgtgactcagcatagtatataaattcattgtttggaaaatcaacactacttggtaaaattgacacttgctaattttacatatatttctacatttcattcgcttacttcttccaccatggttttcttggcctttaattgtcttttaaccaatacttcaaaattcaggaattgtcataatctatacatgcatttttcctgattagacatatgtatggacaaactaagtatacatgagtgaacttgaaagccaataaaattaaacttagacacgtctttctgctgtgactacatatatcctctttctaaccaccgctctagtctctgtacatctctgaaatctaacctcaaccatcatgaaaaggctgaaatcatttgggattttcatttcttatcaggtttccccatactaacgaatgcctagataataaaactcatatgccatttacataatttctttgttttccacctccctttcaagcttgttaaaaaaaacacaaaagctgccattcatcccctcctaaaatatatcccctgggcaggaatttaatttgcagttaagaataagtgtcaggttttttgcctttctgtatttttgcagtttgatgaaaagtgatattcttgtgatagtaatgtccactatcatttggaagtatcagtctcctaaattattagtataaataaagcactgtgttgtacagcagtatgacactacacccttgaagataaattcatatttctgtaattaaataatcagaaataattcactttatcagcctgatggactgtaatggcatgaagcacttcaatcatatggtatgtgccttgccaatgtgtactgtcctggcaaacttctgctcattgattcactgaataaatatgtattagacagtttctatattccaggtgctatactagatgctggaaggaataacctaatcatgctcatgccactcaaattcacattgcctctgtgtctatctgactagaacttagggtcacaggaccaaccaagaggtaaagcctctttattatgtgatttcagtgcacttttgaaaaaaagtaggtagttttgtcttatacccaatgagatgacctacaggataatccaattctatggcatagagagattttagtatagtctatttatcaccttttccaaaatttagattagtagaaccatcattaattacataagcactctcaacagattttgtctccaaattcaatttgacatggtcatttaaaataattagccccaattgacataggctggtgtatatatcaatctgatagacatattgtacctatcaaaattaattctttaccactaaacacacacagaaatatgcagttactacaagaagtataaataaatctcaagcttttaaaaaactagaaaagcagtgcaagaaactgcaaatgaaaatcttcacaataaaaagttaatgggtttacaaaatgaatgcaccaaagaatatggcaagctttgtgtaggcataactacaggattactatgtttggtggggagacatttttaagaagtgcaattcccaaaacttaatgtagtgatctacttgtgcacaaatacgtcaagcttagctattgaggtttgtattcatgtagactgtaggaaaaacattttagtaataaatatttagatagagccactttgaggagcaggcagaagagctgtgaagggtcaatgttattaactttcttatataaataggccaaaatatggaaagtattcattgagtcttcaaaatatttatttgttttggaatcagtattggaatttaaagagtcaaagactggggaacacttttggtgaataatcaagggaaatatatattcagagtacctatagttagtgctcaaatcggtccttacatagcattctgaaaaaccacttcacgactctcataggtcagtttcatgaatcttccttaggctcatagaaatgtaaaatatattcaaaagaaagaataattagcaatttgggtagtcacaaactccatatttcaaacaaatggaattggttcttattcagataaagagtaaacctaattatcaatccaagtaaacttaaactttgttaggttaggagctaatttgctgtattgagcaatatttgaataatggtatcgatgaatattataaatacattatacatttttaactgtaattaaacttttctttaatgtaaggaggaaaaaagtgacagaaagcgagagaggcaatgaaagagaacacagcaatgtctttgaataaaaacaaactgctatcccttgtcttcaatgatgtatgtggttaaattcctcatgtattcagtgtactggaatattaactatccccgctccccaatagaccaagatcatttataaaaaatgttttcatcacataattaatcacatattcagctacgaatggcagactcaacaaaaacactagactgttattaatatattttcctttgtttgtgtttcactacttttggcacatagggattttctatgcttctaagaccatttagctttataccaaaaattccacttcaatgcataaacagtggcatgccagagatgcctaaattcacagtaaggtttagcgatatttgttaccaaaagctgtgcacatgcaagttaagtgttttctttcatgcttctgtctgtattatttcattagataatgagataggctgccctttctgtccatcattagagcagctggagacagcatttgctacctggcaaaactttcgaagaaggatctttcttaacagcaggtaaacccaaggatccaagatctggttcagtgaagccaggcgaacagctattaagaagaagttgcattctttctgcttctccgtgtgtgtcttgcagtgctcaactgatgtctgattgaagatcattttcaacatcattatctaagaaaaggggacaaataattgtttcaaagattagtaaggtcatatgcatctcctctacactgtactttgcacatagttggttttcaataaattggttgttggattgaaatgattaattcaagcaacatttatacttggataacacagtcctgaattatacaagacattcctaggtattttcccacatttgtggctatttatcatgatgtagcttttaaaacatgcatgtcttcaggctcttgattcttggaatttaagaagcttgaaaataacacatctcaaaatgagccaaagtcatgtttgttgcagaaaacaccacaagttcacccaaatgagagccaacacttcaacaataacaaaaacatcttaatcttaaatttccagtagttctaattttaaaaattactgcagaaaaagtagacgcaagaaaggaggaaatattattattattattattattattgccactagcattttcagaatccttactatttagcagacatggtgccgagttcttcatatgcatttaataaacagcataacacaggtagtattaccacttccttctggatgagccagactaataccatatgatgtacaatattatacttttctttgcccccacccaatatacactgcaatgtaaactccatgatagcaggaatttgggactattttttccccaagtgcctagatcaataggtagcagatagcagatgttcagtaagtatttgtgagagaacaaatttttatatttgaaggaatatattatacaacataaaaatgacagtatatgagttatatgtatttgtgcgagaacaaatttttatatttgaaggaatatattatacaacacacaaatgacagtatgttatataatatgtatttatatttgaattaaaaagatgttcttatgcatattaaaaatgttcaggccaggtgtggtggctcacgcctgtaatcccggcactttgggaggccgaggcaggcggatcacttgaggtcaggagttcgagaccagcctgaccaacatagagaaaccctgtctctactaaaaatacaaaattggctgggtgtgatggtgcatgcctgtaatcccagctactcaggaggctgaggcaggagaatcccttgaacccgggaggtggaggttgcagtgagccaggatcatgccattgcactccagcctgggcaacaagagcaaaactctgtctcaaaaaaaaaaaaaaaagaaaacaaattggaactatttcacctgctgtttcccagctatgcaactcctaggaatatactgtccagaattcctgcaccaagagtactgtatatgactgtttcataacagcattgttcataatagcaaaaaaagcaggaacaactcaaacatgggttcacaatcccaagcaaagaaatgagctgagtttgtaactggctcctaagtttcccattctagacctatacagctattgagtacttgacatgtagccaaagcacactgaaatgttagaatatgttgattccataatggaataataatatttctatatattgtgttaaataaacatatattattcaaattaatgtcacttgtttcttttgactttttaaaaatgcagctactagaaaactttaaattatatgtggcttgtggtttttttttgctcacagtacatttctattgaacctaatctctctctcttgaggcttacacttatctgtatgttctgccctcaggtcacataacttaaattgaattcaacatccctgagcatccaaaacatccctaaccacttaaccacaattccagtgatggcactttgatacactcaccctggatcaacatttcagagtctgtgaactcttcttttcctcatcctctgcaatgccttttgctcttgcttcactctcattcttgttcagatcttcctctcatttgaattatggtaataacagacacccagatggtacatgtacggactgaatgtttgtgcctcccttcaatttatatgtgggagccccaaccctttatgtgatggtattaggaagtgaggcctttgggaggtaattaggtttagatgaggtcatgagggtggagctcctataatgggattattatccttataagaagagggagaagaacccacaggtctctccttcagccatgtggggcacagcaagaagacagcagtctacaagccaggaaaagggccttcaccagaaactgaatctgggggcaccttgatcttagaatcttcagcttcctgaatggtgagaaataaatgtctgctgtttaagccatcaagtttacacctttgttatggcagcccaagcagactaagacagtgtttacagatatctgcccatcacaggtgcagcttccaatcccagctgtgatcaaatcctctccaactagaaaatcatcaatgtcttcccattgtccatcgaacagaaatttaactctggtattcaaagccctctacagtactgtccaaactattctttccagttttgtctcccactaattgcctatacagactccaaactctagctatagtccattggttttattctttcctccctcttggcctttattctttcttttttctacccctgcaacacttttaatcctcatcatttctacttctgagacttccaagtctttcaggactatctcagttgttcctgattattccaaaccactggcctctgaaggcctacaattgtgtgtgtgtgtgtgtgatataaccacatatttgtagtagatagacagatagacaatactagcaggcatccacatgtccctcaaaaacttggacgtatgggggaagaaaatgtgggtctctaagatttaaagtggacataacatcaacacgtaggaacccagctccaaggttactgaacttgactgcaagcaattgaacaaagtatcgacatatctgaaatcgatttgctttgggaaaaaggatacttaaccatcaggtttgagtattttctattcttgttggcaaaattgactactattgtgagataaaagatgtaattgtctatattagtttgaagtaagtaaatatttgattcttttaattccccatcttctgtgtctttttccactaagctgataatgactggtcccagtgttgataagtcaacaggaaaagagagctgagtcataggatttctggtattgccaattctgctcatgtatactcaattttatttcaaaaatacaattatataacaaaaaagcaggtagagcaggttaagcagacagacaagagagagaggaaataatacacgaaaattcttacaagactgtgtgacactggtatccagccattttcccttttgtcttatttagtcacagtttttattcttaaacgaatccctggcaaaggggatgggaatttccagttttggcttataaggcaaactcatgctctggggcttgactcatattttgttttttgagacagtgtctcactccgtcaccaaggcttgggtgcagtggcacaatcatagctcactgtagtcctgaactcctgggctcaaatgatcctcctgcctcagcctcccgagatgctgggattacaggtatatgccaccacactcaattaatatttttattttttgtagtgacggggtctcactatgttaactaggctgatctcaaacttctggcttcaagcaatcctcttgtgtaatttctttcacaggaatttttccaaatgatttatccaataaaagcaaatagtagctatacaataaataaatgttcagaggagcattatatatgccagcaagaaattgcagacacatacatctctaacatcaggtgtaaagcttaataaaacaataattcacaaatagtatatataagtattaagtgaaaaaacagaatataagatactttatatataaagttttgttgttatattatttaaaataggcagacttgtggaaggcaatggaattactgctatttaacaataatttacttttaaacaatataatttaattttaaaattgtatgtacacaggccaggtgtggtggctcatgcctgtaatcccagcactttgggaggtcgaggcagatggatcccctgaacccagcagttcgagaccagcctgggcaacatggtgaaaccctgtctctattaaaaacacaaaaattagccgggcatgatggtgtgtgcctgtaatcctagctacttgggaggctgaagcaggagaatcacttgaacctaggaggcagatgttgcagtgagccaagatagcaccactgcactccagcctggatgacagagtgagacttgggctcaaaaaaaaaaaaattgtatgtatataaaaacatttcaaatgatgttaatgaaagtcttttatttaaagaaagcagatggttattattcccttctttggtaaatatggacaattatacaccgaatttacttaaaataaatatatttacatcaatatattctgatgctggctggcttatcatcctatgagctgaatgctaccccccatcatagaaggcagaataatgcccctcctgccacacacaaagatatccatttctcggtccctggaatctgtgaatacgttaccacacaagacaaaaaggactctgcagatgtgattaaggtaaaggacccagacgtgaggagataatcctagattacctgcgtggacccaatgtaaaaacaagtgtcctaaaaaatcagagaacttttcccagctgtggccagagggagagatgactatagaagaatggtcagagatacacagtatctctggctttgaaggtggaggaagggatccaggaggtaaggaatgaggatgacctcctctaaaaactgaaaaaggcaaagaaacacttttctctcagagacttaaaaagtaatgcagccctgtagcacctttactttagcccagtgagatccatcagacttctaacctacagaacagagaaatgtgtgttgctcttaagccactgatatggtctagctctgtgtccccgcccaaatctcatgtcaaattctaatcctcagtgttggagaaggggcttggtgggaggtgactggatcatgggggcagacttcccccttgctgttcttataatagtgagtgacttctcatgagatatgcttgtttaaaagtgtgtaacactttcctctctgctctctttcctgctccaccatgtgaagatgtgtctgcttccccttcaccttccaccatgatcacaagtttcttgaggcctccccagccatgcttcctgtacagccagcagaacctgtgcttttgagacagtcttgctctgttccccaggctggaatgcagtggtgcaatcttggctcactgcaaccttcacttcctgtgttcaagccattcttgtgcctcagactcccaagtagctgggatcacaggcacgtgccaccaggcctggctaatttatgtatttttagtagagatggggtttcaccatattggccaggctggtctcaaactcctgggctcagggaatccacccgtctcgaccttccaaagtgctgggattacaggcgtgagtcaccaccacctggccccaggtagttctttacagcaagtctcaggtggactaatacagccaccaagattacaataatttgctacagcagcagtagaaaacaaatatgcccacacactgagctctcaaccaatgttaagaggaatagaaggaatgagcttgaaaacgattttttcattctcatagataaaatagcctaggaagcttctttaaatttttttactttcctaggaaacttaaaaataaatgaataaagtaaaagtaaacttcattctaactcctgtcccaattatctcaatttctaaatttacaacatgcaaaaccgaatgcctgttattctagtggcatcagtcaatgtgtttgactaaaagttataaaattaatattttcaactcagttggctttatgaaaaaaagcttattaatccctttcccctctttttataaactattagaaaagttttgcttatctttttcagtcctttaccccacccaatagttaaatatatttgaccacttactatcctccagaaagtgttctgggcctcgtctagaattatctaaaaactcacttaaattatgtttttattttctctataaaataaagaattggatttctctaactttttgtgatcaggaaaattcacaaaattacttattaaaatgatacgtcagtcattttacacagtcctccttgattatttgaaaattaatttttgtgaggctaataatttaaaattattgttatgaggcaaatataggtttcatatgccttacattgtttagtacactgtaatttcctattgagaatgcaatgattctgaaattataaaatcagccagtagctggcacatgaggagagacattagctttccccagaaatcatgagatgtgcaatatagagataattggaattagaagcagtgagcatgctactgccatttccaaatggcagcagagatgaaactggggctccaaattcttcatccaattttgaacataaattcaaattagcatccatctgttgagtctttatatttaagccataattataatttctgtgtatgtgtttgcaaatatctttcagactgtttagactttgagagaaaaccttaggcatgaatatggtagaattaattattcctattagtccaattctgtgtcatacaagggagagggaccaaagaaaaagcaggatgctcagctaacagagaggctgtttactggttttagcaaacacacatataccctgcactatttctcctttcaaacagcctcatataacaaatgatctggtcaagggagtcgtgagaccaattctagctgaacggagctgcagctgttctgtcagccccttccctgggttccacgtgactctcccaggccctctagcagagctctcccttggttatcagcagtaatagagagcttctttatgcacttgagataactgggaacacaactacatcagtgacctctaaattcgccatccctgtctactgtcaagtacaattaccttgttccatcctaaaggaaaaaaatgatttaccctttccccagtgataacgttcttttaagtgttcaaagcattaatcagggaggctgtctttaatattctatccttggattttattctattgcagcaggatttataatcacacacttaaaaatctttagtacttcacttcttaatttaaaaatgccttgggttgtaggccacacatatctattaaagatgataaatgaggaaacccagaaaaattaatttatgggggaggaaataaattggttagctgcccttaggctcaattctggggtgtttctgcatttccagtttattcctaatgcaagtgtttaagagaagtttcctcacaagccaatttttatctgcgatgttttgttttccgtaattctctgttgttaggttatgggagaataacctgctctactggaaattcccccctataatttgataagtgtatttcatcataatacactaaaaccagtctgggccctttaaactagttaattatgtaatttgaaggatttgcatgggaagaagcttcactgtggattaagaaacaattgtagtctctccaatctggttacaacagttctccagttgtcaaatcatctctggatcctagactactgtttcaaaagctttccctgccttatttaaactgaaaacattacaaataaacagctcataaacattaaaaaaattagtagaatttgtgccatttcgtcattactactacgtaattttataagattttttaaaacaacaatggattaagaatcaagtaaattatattgctagttttgccatcatttacaactttagaaaagtcatttatctctgaactttattaaatttattagtaagcagtggggctggactggatggcctctgcatacacctctacagtttttttttgatgatttttggggcaaagctggaaaatgaaaggatttcatttggcaaataattaaaacctacaggaaataggtgtgaaacaaaagtcaaaattcctcttcaaaaaaaaactccaaggggcaaatggaggaaagagaaaaattacaaagttagaagacagtgtatgagaacaagggactagattcatgaagctttggtgtatgttagcagagtgtgtgtgtgtgtgtgtgtgtgtgtgtgtgtgtgtagtggggtgggggtatttttattaaaagaaatagcagattctggcaaacatactgaccaagagttaaagaacttccataagtctgactcaattctgcttctagtttggagactagttacctaattttggttcttaacttcttccttctctaaaacatgattcacacacacttactgtgtatcgtctccaactagcagagcagttgcaaaaattaaaatgtgataagaataattaataccttcaatttatatagcatacctcttcccatgcctcaggcactcacactattgcagatgcttccaaaaaaaaatgtcttgacattcacaaacagaacaaaaaaatgcttaggggaatacgacaaagaaataaatgaattgtgtctatattgcttgaatttcttgctaataaagtagttttagaaaactcacctcaaatttgcactttaaaaatgtttagtaatgcagaatcattattcagttactggatatggaaaatcaaaattataaagaagccagcagcccgctaccacattatttgctacataaaaatttccctttcaagtagtataaattgtaaattctgtatgacttggctcagaatagctcaagacgtatgtctagataaatgtttatctttctattagaacagtcacacaatgtcaatatctaagtaagtattcaaattctggctgaaagggggaaggcaaaatctattctatcaaaggattcatttcttggattatggatgatggattagctgggtgacacacaagttagaagagttatctttactatatttcaaacacctatatttcagatgtcaaaagaaagtctagataatatgtcattgtcaaggcttaaagtacattaatccttaaaaatgcttagatttcagagttttttcctcccaaaatatagtttcatttaaaccccaaatgttcaattttactctcatccattcagaaaatcggagtgttcgtgacaattaaaaacaactaaacacttaaaggaaaaaaatcagagatgtgaattaattgtgtgtgcagagatagtcacctcaatataaaaatagaaagttagaaaaacctagatgactgacaatagagcactgcttaaactatggaccatccttcatatgcataatttatatctattctaatgctgacatttaaaatcatgctgttgaatattagtaacatgaagaatatttagtaacatgaagaaatgttcagaatgtgaaaagtgaaaataaatgttgcacagtataatccaaattttaaaaaataactgtgcttatttatagtaaaatatgctagaagtagttttctctgggtgagaattatggcaatatctattttcttctctgtatgttttccccaaattctttacaatacacatgctattttttacactttaaaaagcattacatttagagtagctggtgacttagctataaacaatcatctatccatgtattggtaaagtgttagtgttgcaatcctagaactataatgtggtcattttaggatgaattcttaagaggtcaatgtgtgcataatttaacaagaggtaagcagtctgacactctgtatgttcaaaacatttagcttgatcaacaaattaattatggcttactaaatttagtgataaattaagtggcctcagtgatggacttgatggacaatacagacatgacatacaaaagaatcccttcctgtgacatagtgggtacacaatgcagggtgatgaatatggttctaatctgatatgatacattcttattaaactttgcagtatgtcaaaatgacactgccttttaaatctattaagacttcatctcacaggagaatccaaaatagatgcatcttatattcaggatggacactgggtgaatatgagcagattgaggtgtccttaaatgtatgctcaccaatcctaattcattctctagtcagtgctctctctctctcttacacacacacacaaacacacatatacacaggcacacacacacacatacacacacaaatgaacagaatctgtttagggggcttcccaccttcttgccaccaacttcagcatctgcagccatccattctttccttcctcttatttgactggaagaggtgtcctgtctatctaaggcacaccctctgtctagcccctggatcttatccatcctgaatttcagagaccatatactctcaattgttcctgtcctcttttatagttaacttctcccacttttggcagtttcccagtcacattttaacatgtccaaatttttgccaccttgagaaaataaaacctgtgtggaattctcacctacctacatatagactgctccagaagttacagccaaatttcccaaaagaggtgtctaccctccttacctttaaacttattccaaaacctgctgcagcctgacctctgtgttcacaaatcctcagacaaggctgttcccaaggccaccaacaaggttgcagaatcaacgccacagtcttacttgtctgtaacatcagacctaattgaatgtagctgtctcttgaaacattctcttccctaatattcgagtcaccatttgttctgattttattactaattttcctgctacctttctgggtattcctctgcagtcccctttatatgctcctgtttctcgctgtctcaaaatatgttagcatttctgaattgtatcttagagagcctcctcttcttactgtgaataaactgactatgtgtggtctttcatctcaatggcttcaaaccccatttatgtgctataggccataccttttctctgagctccaaatggattagtttagctgctattgcacggctttgtttgaatgtcttacatcaaattcaacattttcaaaatgaaaattcttatctttttcctcaaaggtgtttctacattaatcttccctatcacagtaaatccccatctctaaaacagaaacctgggagttacccttgattcatttctctgtgtgtctttctctacgtctctctgtctctctccacattccaccacattcaccatattcctcacatccaatcaatcacggagtctccaactaacctcttatggttttttttttaatctatcacttctctcatttacacccccaattgaccataaactgaggtctccatcgtctcttgtctgaactatcacaatcatcaatgacatgatttgttggcctccatctggcctggcccatgctgctgcttaaaaaagatgcttgtaaaatgaaattttaatcttgttattccactttgcaaagtccttcatttatacacattgccctgagtataaagtccaaacacttaaattcaaagctcctctttacttggtgagtacctgttgtgttctctagcctaagttctcaccattttttaccctcatgcatcagtattccaattatcttgaacttcttgcaggtctttaaaagtgacagttctttcttgcttttgaggcattacaaatgtggatctttaagtcttaaaactctcatcctctttttctttacttgaaaaattctgacttatttcgtgcgtggtcttgaaacatcaatttatttgatatttctcttgacaaaagcaagccttaatacaatcttcatatggattcccataattctctacttctctacattttatcttgctgcttgtttttaattgttggtctctctcaataatcgaaaattgttacaagagtagggatcaattctatcctatattctaggtatatcacagcaagggccaagcccagtagattaataaagtttttgaattaacaaataagtgaatgagagcaagggtatagtgcatcctgcccatttgggggtacagattctagagttttgatgtaatggacaaatctaccgacattctatccttttctttctttttttttttttttttttttgcctcagcctctcgagtagctgggattacaggtgcccgccaccgtgcatagctaatttttgtatttttagtagagatggggtttcaccgtgttgaccaggctggtcttgaactactgatctcaggtgatccacctgcctcaacctcccagtgtgctgggattccagtcatgagccaccgtgcccggctgaaaaaaatacttgattcttttatttatttatttatttatttatttatttatttatttatttatttttattatactttaagttttagggtgcatatgcacaacgtgcaggtttgttacgtgtatacatgtgccatgttggtgtgctgcacccattaactcgtcatttaacattaggcatatctcctaatgctatccctcccccctcccccaccccacaatgagaacacatggccacaggaaggggaacatcattcaatccttttcaagattccaggcccttccttccttccttccttccttccttccttctttccttcctttttttccttccttccttccttcttattataattagccaggataacagcttcaaactaggtgctaatggactataagcacatcttcttatcattcatgattttaagtggaacgttctggtgttcagatgacagccagtagtaaccctgaggctggtaagttggggttatagaatgaaaggagaaccaagtatttaaaataaaatatattgaatctataagaggatattctattaactgtatatctaataacatttatttaaaatatagcccaaggaaaaaaagaagatattatgcatatcaacacagtctttaatgaggatatcatcaaatttctaatacttagtgtcaaaagtccttttattactgtaagtgttatatatgattctagcactccttgcttatagaagttttgcccaaaaatataacaccatatcttatgcttaacaactgaagacgaataataacaaaacagcaactaatgcttatataatacttactataagagactatgcttgcctgtgaggtgagtgagttgcaggaatgtcttcaatgctgctactgggtagccccaagaggagagaaagtcaccagaaatatttggttgcaactttttcccttcacaagagccaagcagtaaaattgtgggttaaacccagttaacatggctctctttggaaaggttgaggcattgaaggccaaacttcctgtcatgattaggaaatcacagactgttcttaatgttaaagcgaaagcaatgctattgtgtgatactttcagctcctcaagttgtgaatctggcattgtgtgattactccccccttgcttatactgtaataaatatttaaaataccccccagaatctgagataacacatcagtaacagtttaatttagcacttgcaaaattccctccccaggttaggcttgtactcagtattggcatcaggaacttcctaacattatattcattcattttccttttcccaacacaaaacacacccctggctaaatttaccagctttctttacagctaactcttgtcctgttgactgtaaataggaactgagtaatactcacagtccctgacctatataagtgctatgtaagtactacttgctgttttgttattatttgaatgttatgtattacaaacggaagcaacacataggtggcagctgaaaaccagcaagtgccatgcgatatttatattactcattgtaaactttagtttccgaaacttctgaaaaaaatgtttcttttgtttttcaggaaatcggactttaaaaactcacttaaataatggttagtacttacaattttataccaggtttgaaggaagtttgaataagacacaacttgtatgcaatgcaggaaaatggaaaattataatgtgttcatcttccgtgtttacccccttaggctgcttttgtctcttctattgatttatttggattaatactatattattactaatattatattatttagattaatactatattattatttactttgctgtgggactttggtcatggacatggctgttggacatggcttcaaaaatatgttactattataatgtttctaagaataaattagatagacggtaaaaatggacccccatcttttattattaatatcccaattttggataactttttctctgtattctgggttggtccaacagcaaagtaaataataagaacaagaaggaagcaaacatgaggaagaaacctgttcctaccatgactcaaatgcctaactcctatgaggatcacaggctcccaggctcctgtaaaaagataaacagatcccaacaccattgactccctctctccttaacgtgtgaacccagtgagagcaattcttactgtactacttaccttctagggaggaccttaaacaagtaataataaaacagttcctacaactatcatagggaaaatgcttttggtgaattcatctaaaatcctatatttgatgtaagtttcttttgttattttttttaagagacggggtttctctgtcaccgaggctggagtgcagtaatgccatcataatttactcactgtagcctcaaattcctgggttcaagggttcctccctagtagctagtactacaggcatgtgccaccatgccgggttaatttttttctttttaaatttttgtagagacaggcatctccctacattgctcaggctagtcttgaactcctagcctcaagtgattctcctgctttggcctctcaaagcactgaaattaaaaacaaaagattttatgcaacctcaccaaggcgaagtagatattttcaggaatggttttgcaggaattggcaaatagatctattgagacttggaactatccggttccccaacccatttaaccagaacaggtctgttttcatctatttctctaaagagatgtattgacatagtccccccggttaaaacaattggaaaatcatcagtctaatgcagtactatccaagagaaatgtaattcaagccacaaatctgcagcacatgtatgcttttgcattttctagtagccagattttttttaaaaaagtaaaaagaaacattttgaattttaattcacccaatatatctgaaatgttacatcagcatgtagtgaacataaaaattattaatgcaatattttactttttacctttttgtatttaatcttaaaactctgctgtgtagtttacatttaaagtatctcaatttggattaatcacatttcaagaggcaaataaccatatgtggctagtggctactatgctactatgctgtatagatgaaagtttagtgctttattctttttgagggttttccacctttattctgtcaattaaactgtgtaggtatcatcactgcagtgtccactattggtcacctacccagggtccattcatccatctcccctgctcatggacatagttattttcactggatcctatgtgcttcagggctgaccccatccctagctacaggaatgtgccggggttagggatgatcatgtgaccccatactagctaatgagatccaacagtttcctcgtttttaagagaaagtcatagaaaaacacagcttctctctcctgctagaagttaaccaggaagcacgtactacagctaccacttgcggggaacaagccgtaggatgaagccaagactgtactgcgaaagagagatgcggcaaactttggtcctagatgacgatgctgagctttcggattaaccaactctgaaggctgccctaattttggatttcagttatgttttttattcccaaaccactacattacatcatctctaataatgactgagggcaacataaatatagtgacactctggagcaacttttgaagcattatgttttttcctttgttttttattttttactatgtttccctattgtcgccgaaattcctcatgtttaattgttatccccagggcacctttccaaacatccctttcattttttccgtctttaaacaccaggcattagagcaactgttttcttgtgctccttcccattgcttccaattaacttctctcttccattataaaaacaatgttgtctctcttacagttgtctaccctaaaggtatgtttaaatcttctctagaatttttattactaacaacaaagtggagacaataaaagtaaagaataaagaaaaatatgcactattatcttaaatactaacaacttttactgtattaataatacccatgattcattagattcaagttggattagtggctttagaatgaaaaagatttgagtttgattcactcaacactatttatcatctgtggccttaaagcaagttgcttactcaacaagtgaaaaagtaaaataaaataaaacaaaaaacaggaactgatgtcacctacatttcaagatttatgtgaagattaaaaaaccatctaatgtatgcaaaactcttaaagctaggatttataccttgatcttcttattcctattctagtgtccttttcacttaattacacttcccttcttcattcatttcacaatcatttattgcgtgatttctttgggccaggaagatttattgaaaaacaaggcaagatctctgcttttaagcagtttataatttaaactgaatcagacaaatagagggagaccataaagcttagtggttaattacataggcaataaaatcagacaaatctggatttgaccccaagaaagttactttacatctcaaaaccagtttcctcttctgaaaacgaagatgacagtatcccctcaagttgtcatcaatagaacaaaatgaaattatatctgtgaaatgcaatgtgcataaattataaaataagcatttgtctattgtggccaatcatcctcattgccataattataactgtgcataattaagtataaaggtatgcacaggcactatggagtaaagaggaggggcacttaaatcagtttctatggccgggcgtgatggctcacacctgtaatcccagtactttggcaggcctaggcaggaggatcacttgaggtcaggaattcgagactagcctggccaacatggtgaaaccccatctgtactaaacatacaaaaattagctgggtgtgttggtgcacacctgtaatcccagttgctccggaggctgaggcaggagaatcacttgaacctgggaggtggaggttgcactgagccgagatcacgctactgcactccagcctgggtgacagagtgagactccatctcaaataataataataataataataataataataataacaaaataagtaaataaataaataagtttctaggttcagagaaacccctgtctgccaaaacagcagatgctttgtaggtatttgagacaaagtccacatttctgagtgtgaaattgtgtgaatcattataagagctgcaaactgatttttatcactgaaggtaaggatgctggggtagggatggaaaaaaatggtacagtggtaaatgtggccaaatccaagatcttgaggattaaactaaggaatctgaagccttttaatctgggtgagaggctactatagtaacatgcctgaattccatgttagagagtcaccgtggtcacactgaggttctctaaggctctttctcttttccctaattataagaaaaaagatgaaagcaggtttgcaagaatcccaattgcactgtatcatactggaggctttagaactgtcaaaacaaagtttctaattttgactgtagtcaaacactttcccaccaagcaaaaagaattcaatatacagttttatttgttttataaatagtttagtgaaaagaataatatatgtgacttgtactagctgaaaaatgtttgcctagtaaaactttatcactggatgtgaatgttctaagcctaaaagacacacagaagtaaataaaattgatgccacacctttacaaaaaacacttcctaaattgccggtatcgtggtgaatggaatcatttaacaagttactgtcagacaagtgaaaactcctgtcaccttctacgggatttttcagaatatgctccctagatactcaagctcctacaaaggtcaatcagttgatgaatcaatagctattctacaggaaatctccatcaccataattatctgacccagacaatttcagtgattttttttttactattctcaatcaatttgttcttttttgtacaatattttcaacgaagtgatttgaaaatatttttataaactaataagagagaaaaacgtgacacatagcattatagtgtacaaaagcctaagatctactaattactaggaatatgattagagaaagttataaaatcttttctgtcttattatttgcaactgaaacatgggaatgaaaggtaacaaactcaaaaattgttgtgaagattaaattaggtaatatatggaaagggtaattgtcaagtatgtacctgcacataacaggcattcagtaaatagaagtccttttattttttgtggctctcttcagtttgcgctccaccagtctcactgctaccccaatttcccaacagataggtggcaggaaaacacacacacacacacacacacacacacacacacacacaaacgtgcacacacgcacatgtgcacaaggcttcaaaagtatgttactattataatgtttctacgaataaattggatagatggtaaaaatgaacccccaccttttattattaatatcccaattctggataaccgtttctctgtattctgggtgggagagaaatcccagcacatatgtcataaaccaagtgctggaggtgcctgagccttcatcctttgttatagcataggggtaaataacccaagctacagcagtcaggctggcaacagaagtttgaattttacaagcataacacaaagaagaagggggtttttagacattggattcatcacagaggcatgcagcaaacatttttccagcaggactttggctgtgcagcctgaagttcatcatcaagaacatcctgggtcttgcctgttttccaaacctgacctgccagatttctctggactctgtgagctcctgaaatccttctacatatgctctttgcacttggagtcacagttggttgtttgcaacccagaaccatgtctaaggaggagggtagaattctgaagtcagaagatattccatgcttcctgatattgatctgtagcaaaatttaattagaaatagatgctagagaaaagaattttaaaatgttccctaatgtcttttatagagcaaaagctaatattaagaaatttgcttttggatccaggcaaatccctagtctattcttggagaaaattactaccattaaataaattcaaaagtctgccacccagcatgttggccgttagcacagctactgatttataaagaaaaagctggttgccagaataacataaaacccagactacaactcatcctttatggaaaaatcaagaaagaacttcttttttcttctctagtcatctcactatggtgttaatggagtattcgtgagattttcgtcttataaggccacctctcattatactcttacttctggaaaattctctgagcctgaatctggaaaattctctgagcctgaatctttcctcatagcctagaaaactcatactagtctttgaaaatgcaactttgtcatctatgactgtttcttgtgtttataaaacaaaacaatagaaaaaatctatgatgtctaaacagtgcttcaagatgatgtattcagtaaaatattgtattattataaaagcaaaattaaaacctcacatgtagaccacaaatataaacttattaacttgaagctttgaaaaaagaacacaagacctagccaaagagctgcaaagctatggcttaggctggttccttaggagcagagcctgaagtggggattctgatacatagcaagaagctgaagttagagtctcagaaagagacagtgctggcttccatcttctataaggccacctccactcttcacactcctgcaatttatgtgaatcaagcaactccccctacctttttatatttatttatttgcttaagctagtttgcattagttttcgatcatttgcagccaaacaatcctgattttaaaagtagggagtattaatttgagaactgctctccttttaggagaaaaagaggccaacagtaaccagaacccgtttagaaagaacaatgacaacaaaaagtttcttctgagacctagcctggaaatcagcatgctccagatcttctggggatcacgaatcttatgacattctattattttataagcaaattttggtaacttctgtgtctctgtgtgactgttctgattcatgtctcagaaaaaaggaaataacatctattagatcaaatttacctcctaattctctcttcctagttgtgtaagcttagagcagtcacttccttcttggggagccaaatggaaagccatatgtagatagctggccacctcaaaaccaaaggcctggagaggaagagagaggtcctatttcttgtcagagtcataggacagggattagagaaatttcaaaatgtctggcaaactgtctccaaaacactatgtcaatatgggtacttcactccaatcccagttgtcaccgcctcttacctggatgacttcaacagccttctacctggtgtccctgttcccacacatacctttctgcaatccagctccacatagctgccagaaggatgcttcaggctttattctggcacactgcttcattttcttaatggtatttatcacaatcactagacttctagtttatttattgcctctctccttccactagaatgctaattccctgagagcatgaaactagcctaattcactgccatatttccagcacctagaactgtgcctgacacattgtatggactcaataaacaaatactgattgcatgcatggataaatgaattctgaatggttctcagctttgtttctttttttgaaaattaaagatggaaaatgctgctgcttttttttttgagtcaatttcaagtttctccaggaaatcgtcttaaagacaacacattccttgaggacaagggtcacgtcattgtagcactaccttacacacaatcagtattcaataagtgtctgctaaataaattataaatcatggctcctccttctgccgtggtcaaggtaattttttgttatttttctgcttaaaaacttagtagaactcctcattacctaataatataatgctgcattagtaatactactctgtatagttattggtatagtatttttatctttaaaaattaaaaaaacctttaaaaataaaagatgtctttaagtaaatttagtattgttatgatgtgtctgtatctggattctttatctggccagcattttgataggatttctttgtaatttggtggaggtaatattagttttatcttattttattttgagtgagaagaatcttattttaaaactcatttatgtgagttatattaataactacaaaacaatgatttatactagcagggaaaaactgttaaagtttttaaacctaatattttaatctaacatttttatcgctaaattttcttttaatgtgttccttttgtcatttattgattttcctggatttgacataacaggtattttataagatgatatatatgctaccttttgttcacataaattgaaatagctaagtccctttatgtttgccatatttaccaaagtacctggcacaaaatgcaccagaatctagggcagtcattttatgtaaatgcacatgagtttacattgctaatataattgttgatccacttataacttgtgcaataaagtatgtatgcagtgactgagttgtcagtaaaaaatgtaacctctttgtgataaaacataatagtaaaataaaaataaatgtagtattgctctaactaatccaagagctagtattagcaccgaagggtggaagcaaaagggaggacagattctgactcagtcaatataagggaaatgaatttttctaatacaaagaacagctcaagatgaattggggtattctaaggcatcatggcatggaggaaacatggacaaatgaattctaaatggttctcagctttgtttctttattgaaaatttattggcctttcaatcccagcctgtctacttaatagctttgctaccttgaacaaatcactcaactcctctcagctttagttttctcatcataataactttggcgacaaaaatgcctatctcatagggttattgcaagaaattttaaaaaaagtatgtgtgagaaagagcctggcacaatcttggctctaagaaaattcctagagttcttgaaaggtaaaaaatttcctattattaagggtgttcaacaaagtgtaaacaaagctggaacaatttcactaagaatattctagaaagatatcaaatattagatgagttgttttcctaaacgaggtttgtgaattcaggttttataatgcacactctcttattttacaaatatagaacagtatagaaaatcaatacaaattgcccaaaatgaaatacaaattctcattcctaatcttaagcaatctacttatgtgtttctccctttcccttcagtctctatttgactatatctatagtttttgacattctcaaatgtacttctacaaaaacagatctgcttaccattcccagcacatctggttcaatattttccgtggtgcatctgcacagatccactgctgcttcccctctctcaccgattctaggccaagctacttcccactcctcttttaaagcaacatttaaggaagaaggcttttctttatattaatgtctctacatctccatctgtcctcagtactcgagggctctgatgctctacccatctaatccattaggcaaccttaagtggtcttaaaacatgaagcagatcaaatcattcccctacagctttcagttgtttttcattgtacttgtggtagaaatctaaactcccaaacaaaaatgacaaggttgtgaattatctggccctgcctccctccctagctggccttgcaggcaatctcttttttactcactctaatccatccatctggccttctttcagttcctccaatgcttccagtgtattcctgcactgacaccttcacatactgctctttcttccttgaggtcttatcttgtaagactcgtcataaatgacctttttcccagagatgccctccctaatcccaatgcatcagtaggagatcttccttgacactctctcaaattacctttctcttgccttcataaagtgctcgtttttgatgtataaaaaggtatgccagcatccatctgcacttctctggtcaagtgggcagaacaaattacattggagcagaagtttcagaagaattacttattctggtaaatttggaatcattagctttacacaggggaaattgtgtggtataccaaaggaaaacccacacaacactctgtggtcacttgggaagaggtagatggtgcttaaggggcccagggacttctggtcaaagaggagatcaagaaactgaacctcttctctcaagatttgaagccaaaaaacttggagcagagtggatttggccacattcactacagggaaaagacatacaagccttaaaagaaaacttagagaaagggaaaaactgggtatggtggtgcacaactaatagtacaactatgcagaggctgaggctggaggatcacttgagcccaatagttcaaggctgcagtgagctatgatcacaccactgtactatagcctgggtgacagagcaagaccctatctcaaaataaaataaattaattaaaaataaaaaataaaagaaaggggcccggcacagtggctcacacctgtaatcccagccctttgggaggccgaggtgggcggatcacaaggtcaggagatcgagaccatcctggctaacacggtgaaaccccgtctctaccaaaaatacaaaaactagccgggtgtggtggtgggctcctgtagtcccagctattggggaggctgaggcaggagaatggcatgaacccaggaggcggagcttgcagtgagccgagatcgtgctactgtactccagcctgggtgacagaacgagactttgtctcaaaaaaaaaaaagaaagggaaagacacatttctcaggagataatctgagtaccacccagagcctaatgatcccagaagtaaggctgattctagagcagcatgtggcctgaggtcagcagccctttgagtccatgtactcactctggcagtgtttgtgctcggagaattgcagctgagcattacagctggagtcacaggtgtgaattaatgtgctccctaattatggagtccaagcacagacccagtacagttggggccaagcgtgttccattagggccatcatgctgcactggaccagccgtgtcctgcccacatgaggccaatctcatgtgtgatagtaagggcaaccacagtaagacctatccgactagttacattggcttattggaacgactgattatctactgtctgtctaccttagtagactgaaagctatgtgaaggaagatagcattccatttggcttaccatcgaggctaccacgtagagctgcacagattgcatactgctcaactccaaagattgtcattgtcttacaatataatgtgaatagcactctctcgagcaacgtaactgctcaacctttatagctaaatgaatccgtgctgaccaccactgtattaccagagtgatgagagtggcaggcacataacaagctctcaataaatatttatagaatcgctggataaaagaatgtgtgatctattttgtccatttgcatacatttctatgctttttcctaataagtttttacgtattttcccccatatatctgaaatagtatgtccaatagggacgatttaatctatttagagctacaggaagtgagaactgaaaggaggattagagtcgttaatcgttttatcttaccggttagaaaaggaaagtccggcaagataaagtgacttagatcacatggcaaggccgtgaccagatccaggtctcttgccatccagtgccttgttctctctgtggcactcacttgcttctttaataactttcttctgttcttcttatgaagcagagaggagtcctcacaagtcgggggtcacttaatcactgatgctactctgtggctgaggagctggctgttgaggcattcttctatttggggaaatatgaaagtgtgtgatctgccaggagctctgacccaaataaggttgttggtagcaagatgttaccagtgaaatttcatacatcaaacagcaattagtgctccactttactgtcttgtgaatttctcagaatgaatcttatcttttacaatcactctttcatcattttcaacattaatcacacacttcttttttccaaatttttatgaatcacaacagcagcatattctcaaccatagaaaatgacatttattatgtgttcagaaagagagacaaaaagatatacaaatcaaatttactctcaggatataacaaaaaattagtggaaagtatatgttttaaattacacttaatatttggggaccaattattgcttgaaataaacaggcttccagttccaacatggccttttgtttttgtattaccaagagtttttaaacagtaatggtatctggtggagaatttatcttgtatctatattgcacaacttttgcctaaattagtaggcattttcttttttctaaaaataaagtgtgaatactcaagcctcctcttccatttctgctaccatttttcattttagatcgatgatccttcaaatatctatcataaaattagttcactaaaataatatttggattttaagtaagcacccacataagtcactgaaatgtcctccctataaatgtggtcccagagaatatctggaaaggccactggatagaaaaataacacattgtgctatttgcaggccacaaataatattaatgtgttgtcaggacctggtcaaactgtatgaagcagtttacaactctatgattcacacactttggtctgacttaaggcttgtgtaaattcaattctgggctgtcagtcagcagcacaggttctgttcagtcccaacatttctaattgcctgtgaaaagatgaagacaactgagggagagactctctcaagaagtttgcagaatgacttgatcctagacaacagttagatgcacaattagttcaactcaagattccattgagaataggtttgtgcacatataggataacaggaagacgaccctgactggaaagagctcacatgagaggctgtgggtgctagcaagacccacatttaactccaacacagaggaatgactgttcaggtggggaggggaactgttcactgcagataagtcctccccttctcagggccatcgagcagaaaagagcattccagacctgtgacagaggtcttcaggacacaaggtactagctcttccctcaggtgtaagggaaaggggaaatgggatcagtgtgttttggagttagagagctaactagaagctgtaaaagggaacagattacagggctgagagaatgcagaggagggatggtggcagggggagggaaggagggatgaattacaataccttataaaaatttaggcaccctgtaatcccagcactttgggaggctgaggtggatggatcatgaggtcaggagatagagaccatactggctaatgcagtgaaaccctgtctctactaaaaatagaaaaaattagccgggtgtggtggtgggcgcctgtagtcccagctactcgggaggctgaggcaggagaatggcatgaacccgggaggcagagcttgcagtgagcggagattgcgccactgcactccagcctgggtgacagagcgagactctgtctcaaaaaaaaaaaaaaaaaaaaagaaaaaaagaaagaaaaattaggcacagttggtttaccatttttctttctgtttctgaaagttgcattctccaccacattttttccccaatgaactataactaatcaagctgtgaaacactacttgcctcctttctccagtttgctaggagaaaggtctatctcaacacaagagtcaacactactatccagtaaaacatcacagtggtattcctcatatggaaggaatgttcccagcttgctaaaaggactcagtaataaagtattttcatagtactgtatactaccccattattttcacatatgttaatcttgttggttttcattataacactgtgaaatgagctgggtaggcatttttgtttcagaaagaaagagagagagagaaagaaagaaagagagggagggagggaagaaagaaagaaagaaggaaagaaagaaagaaagaaaaaaaagaaagagaaagagagaaagaaaaaaagaaagaaaagagagaggaggagagggaagggaagggaagggaaaggaaaggaaaggaagggaagggttcataaagttatcaagtgaattgtctaaggccaaaagtaattgcttatttacatggggccagaccctgtcttctgatttggttgctcaagtattcagtcaaggccagcgcggtggctcgtgcctgtaatgccacagcactttgggaggcagaggcgagaggatcacaggaggacaggagtttgagaccaaactgcccaacatggtgaaatcccgtctctagtaaaaaaaaaatacaaaaattagcagggcatgtggtggtgcatgcctgtaaccccagctactcgggaggctgaggcacgagaatcacttgaacccaggaggcagaagttgcagtgagcccgagatcatgccaatgcactccagcctaggcaacagcgagactttgtctcaaaagaaaaaaaaaagtattcagtcaataaacacgtattgggcagaccttatgtggcaagcaattatgatagttcctaggaaaaaataatgtgcaagacacacactgtacttgaccttagcagaactaaaagaacagaaagacaataaaccaatgtctccaatgaagtgtgactcagactgtgaaagggaaatgcggggtatcatgagatcagggcacccaatcacggcctagagaggatgaaggaaggcttcgctagaaaatggcttctaacttgagatcttagccaatccaagagaggtgggtgcttggcagatattgctgaatggctgaggggtaaagtggcaatgaaaaatggagaaagaagtgctctgtgtaaagagagcagggtgcaggaattcacagagagttcccatgttgtatgtatctcagtcatatgctgcccaactgtcatttctgtataagaatcaattacagatgttcctcaacttaaaacagggttacgtctgggtaaactcactgtcagttgaaaatattgttaagttgaatatattgtaagatcaaagatgcgtttaatacgtttaatacacctaacatactgaacatcatagcttagccttgcctatcttaaacatgctcagaacacttacattagcctacaggtgggcaaaatcatctggcaacacagtccactgtggagtattggttgcttaccttgtgtttgcgtggctgactgggagctgtgcatgcatcaccaaagagtatcatactgcatatcactagcccaatagaagatcgccattccaaattccaagtacagtttctactgaatgtgcattcctttcacaccatcatgaagttgaaaaagcataggtcagagactgtctttactatgtttacagtaaaatgttgccatatacttaggggacaagatataagaggaacccccccaaaatgaggctccttcattggttaccatctttatgaaagttggaagtttctagggaaaaggaggactagagagattgtctaatgattctcaagaagcacagctggcaggagttgaaatacaaacttccttcctgtctttttgtaaagcaattggaaaaaatgggagagtaagaatttgacatgttacagttgtagatcttagtgttgtgaggcatgaatgagataaatgtggaacactggcaggttgcaaaaatgttacgcagatgtacagcgttttaggggggacttccctgcatttctgtcctgcaatgcaagggcagaaccaaaaactgaaacttagcacccagtatccctcacctaccacccctctgcaccctcagatgaatcatagtctgttacagatgcctgtggtgcatattcctgagtgttagtcccagaaaactaaacctatggaaacttttataatttagttgttgaccttcacagcttgttcaaaagagaagggccagtgactcacaattatattacaacttcagaccatgtgaatttcttcaaagatgatggcttaagaagtgtttaattcttggctctttctgataaactcaaaagagtgaagtcctcatcttgtcattcagggactaaccatctaaatttgttttcttgaacatttttaaaacatcattcccattgatctagtgtgcaccctttgttctcattgggctgggttttgggacacacttgctctcagtcatgaagtcatgaaatgaggttatgccaattcatcttcctggaaatctcctctggcaaattcagactgacttttttctgagagccaaaggcattaattacatcctatcttgtattataattctttaaatatttcactcataaatgtggaaattctgcttttctgaacagattataacattaatcagttttataatcatagaatattttgttgaccttcacacctttttcaaaagagaaaaattatagaatatttttcctacaatgtggattcatatgtttaatcactttctctgaagcaacatcctgaatatggcagaaagttgaggcagaagagattagcaattgaataatacttttatatgctataaaacaacattatttctgaaaataattcatcatacatatctaccacatgtggcatattaaaggcaaatttcgcttgtcaaaatacatcagtgactccttaactaaaatgaaaaaaaatcacaactacattgtgaaatatcttcttgaactgaaacatctctgtatttgtggatactgagcagggaattcagtggttcaagattaaaggcaaaagtttctaaggctgcttttatccagttccaagattgatgatgagaaactgtttgttgctcatacctcacttttcatgatgttcatagctggctttgtatttactgtttttgagatagcttacagtattagccacattctacctgtttgggagtgccaagttataaaagtacaaaatgtactcatagcttcctttgaacaaaatcctaaggttattcccatttctggaaatttagctatcaggtcaaacaactgagctatggtgagcatcattcataaaatataaaacataaaataatgataaaaatcaaatagattgcattgctggatgaactggctgattgcaacagaatgacaatgtgatgccttacataagcagtaactaaaaactgtaggtcatctatcatggtgacataatttcccactgtactctcttaatttcacattttatattgtattttgcaaaatttctgagaaaaagaaaaaggaaacaaagcttttgtttaaggatacataaacctctatttaagtatttatgtagtgtgaacttgtagctgttgggacattttcttattatggtgtttctgtactaccaagttttcctgcagtaacaactgaatatttattatagtcatgatagtcttccaggatatactcagggtcctttcaagtaagaagtttggacaattagaatagtatcctacacccaacttaacgaatgctagcaggaaacctatattacactcatagttagaaaaaacagcgttaatctctcattttaacactaatatgctgaaaattcaattcactaaattctagtgtttttattcttataattctctattaagaaagcagctttgccagtttcttttctttgtagtaattccaactttgtacagtaaatctttttgaagatatttggagttttttttttgttttttgttttttttttagagggagtcctgctctgtcacccgtgctggagtgcagtggcgtgatctcggctcacagcaacctctgtctccctagcctaagtaattctcctgcatcagcctcccgagtaactgagattacaggcgcatgccaccatgccccgctaatttttgtatttttagtagaggcggggtttggccatgttggaatgctggtctcgaactgctgacctcaaatgatccactcacctcggcctcccaaagtgctgggattacaggcgtgagccactgcgcccagccgatggaaccattttctttaaaaagttctcatttctcctaggccgggcacggtggctcatgcctgtaatcccagcactttgggtggccgaggtgggcggatcacctcaggtcaggagttcgagaccagcctggccaacatggtgaaaccccatctctactaaaaatacaaaaattagccaggtgtggtggcgggcgcctgtaatcctagtgactccaaaggctgaggcagtagaatcacttgcacctgggaggtggaggctgcagagagctgagatctcaccactgcactccagcctggagtttttttttttgagacagagtctcaaaaaaaaaaaaaattctcctttttgatatgatcacatgtttaatttattttgtttaatgtttttataattgaattaataaagtacccagtaaaatgctataaatcaataagtattatccaaatgaaaataaattgaaattaagtaagactagtttcaaatgcagtctttcttgaaagagtgagtttggccatcctaaattacagttttcaagattgatctactttctttctgaggccaccatacttttggtactagaattaaagtgtctaaatcaaaaacacactacatggcttcgctttgacttaaaaacaaaatgcacaaacaataaattataagtctgattaactgtatgggtattttgttcaattgatttaactgcattttttttccctaggatataaatcatgtgatacagcaaactcaaagatgtgggactcaaatgacacttgtgaaaaactgataccctgtttgcctttaaagttatattaattaccacactttagtaaagtgtttactatttagaactctttcttccttcctagttggccacctgtacactccattcctcagccataaaagtaaatactgtatatctaaaactggtgctggttttgataagccatagtgatgacatcagcctgagttccaactcctggaataaagaactgtgaccatacagcgacttgtgggcagttaggtctcagcataacactccttgtcccctcatgtcactgatttggagccaaggtttgtgctccaatctaccaaaccaggttaaagaaattacatttctattttcaaatgcaagggatttaaaagtatacatggcgcacaaaaaactcaacgtacttaatgcctaatgccactgaactgtacacataataatggttaaaatactgaattgtatgtaatatattttaccataattaggaaagaaaaaaaactgcgttcacgtgtttcaaaggttttccacaactgtataatacatatagttggttatacctttgtaacagtgaccatatcgctctttctgcaacatctattaacccagacaccccagggcctaagtaagcatccattcttcaggaattagtaaacagcacttacacacggacatttctagctaaaagtaacacagacaaaaaaacctcaaaaatatcacgtaagggcaggtgttaggcaaagagcctctgcaaacatcccttgctcctctgcattgctctggtgtgaggagctaggacatggagaaacctctacctcctatctcaggattagcgaaccctgcttgagtgctacaagggtaagtaaatgctggcctgaagaagctgctgagcttccggatcccactgactgtcgttcgggcacttcctagagggtcaagcaccatggcgaaaggctgaggaggcaactcgtatctttcattctcctgcctcatcaagaatgaaccttgaaggcacccataggtcgcgcagtctttcagaagctgcaggagggctgtgactgtatggggttgcagactgaaaatcttattaacgtgaaagaggaatttgaaattaaaaaaaaaaaacccggccgggcgcggtggctcacgcttgtaatcccagcactttgggaggccgaggcgggtggatcacgaggtcaggagatcgagaccacggtgaaaccccgtctctactaaaaataaaaaaaaaaaattagccgggcgtggtggcgggcgcctgtagtcccagctactcggagaggctgaggcaggagaatggcgtgaacccgggaggcggagcttgcagtgagccgaggctgcgccactgtactccagcctgggtgacagagcgagactccgtctcaaaaaaaaaaaaaaaaaaaaaccccacaatatcaggctacagttatcatagcaattctgcttttaatgcactcaggacaaacttctagctctgcatatatgtcatttcaatgacacatcctgtctcctacccgactagaatgtgagcagccctgtgatctctatgtgctcataaacagtgcctaatgcgaatcctggctcttggaaggcgctcagctagtaagtgaggagctcagctctgaagctgtaaccaagaccgcgcgggcaggaggaaaggacacttcagcgctctgcggttgcaaacacacccctgcgggtgctgccacttagcaaagtcttaggttcccgcttactcgcacacgcatcctgacttcccccaaccctggaactacctaccaggagcggagaccagcagaccgacagcacgcacatgatccccataagctgaatggccgtctcggtcgtgatgcggccccactgggcactggactgagatgccgtggccttggcccggcagcgggacaccagggccttaatggtggccaggttgcaggaaaaggtgactgtcagcgccaagagccccaggaaggcaaaggcagaggcgaagaaaaggttgccccagttatgcgaagagctagtcccgttgccccctcgcccggtgctgatgaagcaccacgtcccgggccactggacggtgtactggcccacgcccagcaccggcagcagggcgaaggcgagcacggccagccacacgccgagcagcacagcgcgggtggcacgcgtcttcatgtggctcgcataccagtgcggcgccctgatggccagcgcccgctcgacggccatggcgctggcgatgaacaacgaggagagcccgaaaacagtcatggtcagcccgaaaaaggtgcagagccgccccgacgggtcgatgtgctcccaacgctgcttggacaggtacacgacgatgacgaccggggtggtgagaagctgcccgaccaggtcggtgagcgccagccagccgatgcacagcaggaaggacttcttgcgcttgctctcccggcgccggtagctgcgcgacacgagcagcatggccagtgcgttgcccacgaaaccagtgagcagcatggtgatcgggaaggccacggacaccgatccgcaatcctcgccagaccctggagggcgcgtgaggttgccccgcgcctcggcggaacgctcgggcgcccacatgcctgtgtaggagtggttgaggcgggtgcagaagggggcatcccctccgtagccccgggtctccttcatgttggcttcgaggtgaggaggggatggcgtccagagagccgcagcgggagggggcagacgcggcgcgggcggcggcggaggtcggcgtttaccgcggctggggctgggctgccccccatggtgcggggcgcagccgccgccctactccgctgctgggaccgcggccgcggcggcgccagggctcactggcccgggagggagccacgccttcctctctgggaaacctctggt

SEQ ID NO: 1476 - DNA, 195456 bp, Homo sapiens; identical to SEQ ID NO: 1470

SEQ ID NO: 1477 - DNA, 195456 bp, Homo sapiens; identical to SEQ ID NO: 1470

SEQ ID NO: 1478 - DNA, 195456 bp, Homo sapiens; identical to SEQ ID NO: 1470

SEQ ID NO: 1479 - DNA, 19738 bp, Homo sapiens
ggggcggggcgtctcgggcgaggagaggaggtgaccccgcgaaaggtaagcggcggcttcggtggtgttgagtggctgggcgccggcctggaggggccagggcggccgcaccatcacgctcccgtctctgcccttcccagctgccctgccggtctccctcccagggagggagcgtcctctcggatagcccaaatctttgcctctccgtggactccctgtacccgcaccccaagtcggtgaagctctctggccccacagagcccatttcccgtactcaccttgcgggctccagtttgttcggtgcttcatccatggacacccccaccccgagaactctctcgtttcctgcagtttcttagtgtcttggctcaccagactcataggggaacatggtggtgttttgaggagacgccgcttttcttttgtcatagtgcggacactcgtgctttttcagccctgcaacacaatgtgtagaacttaacggaatgaagttttcttttggaggcttccaatgcgtctgtctttgagtaagccttcggcaccgaacagtagtccatgacattgggggaagccagatgagactcagattgtcagtactcaggctgtcgccagcaaagcctttccccttttttcagagacagtactacatccaagaggtggaaagatacttttgttttgttttgtttatttatttatttgttattattataagttttagggtacatgtgcacaatgtgcaggttagttacatatgtatacatgtgccatgctggtgcgatgcacccaccaactggacatctaacattaggtatatctcccaatgctatccctcccccctccccccaccccacaacagacctcagagtgtgatgttccccttcctgtgtccatgtgttcccattgttcaattcccacctatgagtgagaatatgtgatgtttgcttttttgttcttgcgatagtttactgagaatgatgatttccaatttcatccatgtccctacaaaggacatgaactcatcattttttatggctgcatagtattacatggtgtatatgtgccacattttcttaatccagtctatcattgttggacatttgggttggttccaggtctttgctattgtgaataatgccgcaataaacatacgtgtgcttgtgtctttacagcagcatgatttatagtcctttgggtatatacccagtaatgggatggctgggtcaaatggtatttctagttctagatccctgaggaatcgccacactgacttccacaatggttgtactggtttacaggccaccaacagtgtaaaagtgttcctgtttctccacagcctctccagcacctgttgtttcctgactttttaatgattgccattctaactgctgtgagatggtatctcattgtggttttgatttgcatttctctgatggccagtgatggtgagcattttttcatgtgtgttttggctgcataaatgtcttcttttgagaagtgtctgttcatgtccttcgcccactttttgatggggttctttgtttttgtcttgtaaatttgcttgagttgattgtagattctggatattagccctttgtcagatgaataggttgtgaaaattttctcccattttgtaggttgcctgttcactctgatggtagtttcttttgctgtgcagaagctctttaattagatcctatttgtcaattttggctttggttgctattgcttttggtgttttagacatgaagtccttgcccatgcctatgtcctgaatggtaatgcttaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctattccattgatctatatctctgttttggtaccagtaccatgctgttttggttactgtagccttgtagtatactttgaagtcaggtagtgtgatacctccagctttgttcttttggcttaggattgacttggcgatgtgggctcttttttggttccatatgaactttaaagtagctttttccaattctatgaagaaagacattggtagcttgatggggatggcattgaatctgtaaattaccttgggcagtatggccattttcacaatgttgattcttcctacgcatgagcatggaatgttcatccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgttgctggtgtataagaatgcttgtgatttttgtacattgattttgtatcctgagactttgctgaagttgcttatcagcttaaggagatgttgggctgagacaatggggttttctaggtatacagtcatgtcatctgcaaacacggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttattgaattttgtcaaaggcctgtctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattccgtttgccagtattttattgaggatttttgcatcaatgttcatcaaggatattggtctaaaattctcttttttggttgtgtctctgcccggctttcatatcaggatgatgctggcctcataaaatgagttagggaggattccctctttttctattgattggaatagtttcagaaggaatggtaccagttcctccttgtacctctgttagaattcggctgtgaagccatctgctcctggactctttttggttggtaagctattgattattgccacaatttcagctcctgttattggtctattaagagattcaacttcttcctagtttagtcttgggagagtgtatgtgtcgaggaacttatccatttcttctagattttctagtttatttgcatagagctgtttgtagtattctctgatggtagtttgtatttctgtgggatcggtggtgatatcccttttatcattttttattgcgtctatttgattcttctctctttttatctttattagtcttgctagcggtctatcaattttgttgatccgttcaaaaaaccagctcctggattcattaattttttgaagggtttttaatgtctctatttcctttagttgtgctctgattttggttatttcttgccttctgctagcttttgaatgtgtttgctcttgcttttctagttctcttaattgtgatgttagggtgtcaattttggatctttcctgctttatcttgtgggcatttagggctataaatttccctctacatgctgctttgaatgcatcccagagattctggtattttgtgtctttgttctcgttggtttcaaagaacatctttatttctgccttcagttcgttatgtacccagtagtcattcaggagcaggttgttcagtttccatgtagttgagtggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatttgtgggagtttaagtctctttgtaggtcactcaggacttgctttatgaatctgggtgctcctgtattgggtgcatatatatttaggatagttagctcttcttgttgaattgatccctttaccattatgtaatggccttctttgtgtcttttgatctttgttggttaaaagtctgttttatcagagactaggattgcaacccctgcttttttttgttttccatttgcttggtagatgttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaaggtaatattgttatgtgtgaatttgatcctgtcattatgttagctcgttattttgctcgttagttgatacagtttcttcctagtctcaatggtctttacattttggcaatggatggtacaggttgttcctttccatgtttagtgcttccttcaggagctcttttagggcaggcctgctggtcacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccaagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgcttgtttctttttattcttttttctctaaacttcccttctcgcttcatttcattcacttcatcttccatcactgataccctttcttccagttgatcgcatcagctcctgaggcttctgcattcttcacgtagttcttgagccttggttttcagctccatcagctcctttaagcacttctcagtattggttattctagttatacattcttctaaacttttttcaaagttttcaacttctttgcctttggtttgaatttcctcccgtagctcggaataatttgatcgtgtgaagccttctctcagctcgtcaaagtcattctccgtccaactttgttccgttgctcgtgaggaactgcgttcctttggaggaggagaggcactctgctttttagagtttccagtttttctgctctgttttttccccatctttgtggttttatctactttttgtctttgttgatggtgatgtacagatgggtttttggtgtggatgtcctttctgtttgttagttttccttctaacagacaggaccgtaagcttcaggtctgttggagtacccggccgtgtgaggtatcagtctgcccctgctggaggctgcctcccagttaggctgctcgggggtcaggggtcagggacccacttgaggaggcagtctgcctgttctcagatctccagctgcgtgctgggagaaccactgctctcttcaaagctgtcagacagggacatttaagtctgcagaggatactgctgtctttttgtttgtctgtgccctgcccccagaggtggagcctacagaggcaggcaggcctccttgagctgtggtgggctccacccagttcgagcttcccagctgctttgtttacctaagcaagcctgggcaatggcgggcgcccctcccccagcctcactgccgccttgcagtttgatctcagactgctgtgctagcaatcagccagactccgtgggcgtaggaccctccgaaccacgtgcgggatataatctcgtggtgcgccattttttaagcccgtcggaaaagcgcaggattcgggtgggagtgacccgattttccatgtgccgtctgtcacccttttctttgactaggagagggaactccctgaccccttgcacttcccgagtgaggcaatgcctcgccctgcttcggctctcacatggtgcgcgcacccacttacctgcgcccagtgtctggcactccctagtgagatgaacccggtacctcgactggaaatgcagaaatcacccatcttctgcgttgctcactctgggagctgtagaccggagctgttcctattcagccatcttggctcctcccctcttgttttgtttttagacagagtttcgctctgtcgcccaggctggagtgcagtggcacgatctcggctcactgcaaccttcacctcctgggttcaggcgattattctgcctcagcctcccgaggagctgggattacaggcccgcaccaccacacccagctaatttttgtatttttagtagagacggggtttcaccatattggctacgctagtttcaaactcctgacctcaagtgatcctgacctcaagcaatctacccgcttcggcctcccagagtgctgggattgcaggcgtgagccaccctgcccggcaggaaagatacttttttagaaagtatgttttaccttaaaaacaacatatatataatcaatttttaaaacttaagtgattataattttttttcttaaatattgtaatatacatgcaaaggccttttatcaattcaagagtaagatggggtgaggtggtgaaatattggtgggctggtaattgggagacctaggtgatcgcaccctcctggtaaggacatctccttgggtctgggtttctcagaaaggggtttagaagggggagttagactaaatggtgagtatgaaagtagctaccattcattgaacatctgcatcttttaaaatgtgtcatcttaattaatgcacacatttagtacctatctatgcaatagatagtattgctccttttataaaggtagaaactgagaatcagagttgtcacttaaagacacacagcttataagtagcaaagtgagaatctgaggttatgctatgtttcccctcaagccatgaagtcctctgattctatcccaaacttgtttaaactaatttaaattatttttaaggttttctgccccaaagttcaagttagtttcttaagtattaagataatgtggcatgtgaaactataaaaaagtgtattatactttcattaaaatattttgcccattttataattctctgtcttttaaaggaaatgctttcattattaataaggttcctgctcgttaacattttatgattctggtcattttgttttgtcttctattgaggtgcttatttctaaaatgtatgtttgaagattaagtgtttccctcaaagtaattcttatattctttatatcttagtctaatttgcatgtacaatatattaataggtagtcaagtattctggaataactccctgagcaagaattttgctaaagaagggaaaatcattcaaaaatgactagtcctgactctcggtgtaggaccatctgtacagcctctcacattgtgtgttattaatttcaggggcttactattcttacactttgagatgtaaatgactctcatggagttgggtaaacgggcagtcctttatctttgcttcttcctttttccattgcacgcttccgtcacaggaggatggacagaagaaaaaggtaaagaacattttaccagagagaaacaaatgaagcaaataccccttagtttagaccttttttacaggcacctgtgaaatgttctactctcctctatttttttttttaagaaaagataaataacagtttcttaatcatgcatggaaaagggaacaagaagtgggtgatggaaaaatgaagaagaaataagagtggggcagattgcacagccaggggtgcctgattaattattttgcaggtaggcccgcacacaaattaatcacaaaattacttagccaagagcagtgtaatgccaggttcccagcatccttgctaatctatgtgtatgtatgttttatgtcattactgttttaacacagtaaatgaggtttttaaatgcagcttaaaaataaatagatcctcaaagtgataataactagagattggtcaatatcatatgtaagtaaatgagtgacagctgcagtggaaacaaaaagtaagagaagaaggtggagaaactagtgggaagactaagaaagttctgatggaagtgtgctggacattaactggttttgtcttaggtgagtggtaatgtcagagtaagttattgccatgccttgactttatgattagttctgcagcttttaaaattgaaacttgtattagttttgtacttgaaaacagctagtcaacttaaacttcaggattaaaagtttacttgttaaaatacagatttgttttccccaaaacaatttatacatgtgtgaagaaatgactaaggttttgcattctacctgttttatttattcctggcacatcttgaatttattcgtcagccatacttgtacagctctgtgggctggcatgtgaacaaatacagaagaattttctcgtatgtagaaaagattttgtttttgtttttgttgttgtttttaaaatagttatatataacaaattcttggctgctaagaccctttctggtctcagtaatctgaattttttttaacaaagtatagatggttgttaaaaagtcttagtttgatagatggtgtaaataagttcatggaattttgggagaattgttgtatcatcagtgactgtggctcataaaggagaagcagcaataaaactgagctgttttatcccacttctaataaaagaatgataaataatagaaaatgttactctcatactttccagaaagtgtcagtaacagtggaaattgtggtatattaaatcttttaaaaatatacatgtgagtttccagtcaaaatattctgtcatttctagcagagtttaacataaacagtgaattattaaggtaaatgtgagtgtctgggagttgcaatataacaaatactaccctgattattttattgattcattataaaggaaatataggttctgctaaggaaaaaaggagatcaagcaatcttacaaataaaattaagtcatcacaattagtgttagaatgctatataactatatagttttttacagacatatttcatataggttgaatttcataacactcagcatcactgcatccatttaattttaaaatactgacatttttgttagttgtaactagtctctctctttctctttctcctcctctcctccccccccatatatgtatatatatatatataaatgacagcagatcccttctgaatagattaatgccctccctgaggggatgattaactcactccacacctgaagtccaaaattatatacagtatataattttatataccccaggagtggagtaataataatatataatgtaaattgtatattacattattgtttaatatataatttattatgttaataaattacatataattaatatataattatatgtaacataattttatataattttggacatcaggtgtggagtgagttcatcctcctcaattcctggcacattatcatccacacaaagtatatgtaataaactatgctctgaggacccttctgtgctctgcaatatgaacttctatacccatcttttccatcaccttggaaaaatgctgtttatgtcagtttctggttacaatgacttttacctttgtatatttgctttttcaggcctttgtagtatttttatctaatgcctcagtttcatgtagtggcacactctgaggctgagattcagccctaataacatggccatgggctattttcttcctaatgttccttataggtttggctgttgacagactataatactgcttccactttaatgactgcttcattttgcattttcttttcctatcttagcccatttgtgttgctataaaggaatactgaggctgggcaatttatgaagaaaagaagtttatttggttcatggttctgcaggctgtacaggaagcatggtgtcagcctctgtttctggtgaggggctcaggttgcctccactcatggtggaaggtgatggtgatctggcatgtgcagagatcacatggtaagagaggaagcaagaaagagaggggaggtgctaggctctttttaacaaccagctctccaggggactaatagagtgagaactcacttgctccccacgctccccgaggaagggtattaatctattcatgagggatccacccccatgacccaaacacctcccactaggcctcacctccgacattggaggtcagatttcaacgtgaggtttgggagacaaatacccaaactatagcacccacgtttatagtcaaacaagtttttagcacagggagaaacatcactgacacctgttataggcacctggtggccaacatttgttacttaaattctaaatacctttataaacaccatcgtggctaagagaagaaaaatgaaacaccagcagttctcattagaagaaaaaaatggtagtagtggaagcagtagattgctgccacaacaaaggagaaatagcaaaggaatttaacaccactaccccaacattgttcacatttttgaaagattgagccaagattgaagagaaagtttaaaaagggattctgggactaaagcaaaagtgaatgtgaggtcccttttatcactgtttttgcatgatatcaggttcatgcaagaaatgggcatgtaactgtgctgtagaaagcattggatttttgccaaccttaggaattgtgttagtctcttcttgcgtcattataaagaagtacctgatgctaggtaatttataaagcaaagaggtttaattggctcacggttcagcaggctgtacaggaagcatggtgccagcatctgcccctggtgagggcttcaggaagctttcagttgtggtggaagattaagtggaagcaggcatgtcacatggtgagacaggaagcaagagggaggggaagaagtgtcacacttaaacaaccagatctcacatgaactcatagagtaagaactcgctcattactacaaggatggcaccaagccattcatgagggatctgctcccatgatccaaatgcctcccaccaggctccaccttcaacactggggattacaattcagcttgagatttagaggggacaaacatccagagcttatcaggcatggtgagtttcaagcaagtgcgggctgcccgaacaaactttgggcatattctggaattgtttcacaagttgcctgtagtgaagaaaacactgtttcagtagagaaaattattaacttacatgcaggagaaatttaaaaacaagaacaaaaattgctggttacagcttcagtggcttgtttgtttgtttgtttgtttgtttgtttttggatacagggtccagctgtatccaaacaggatacagcctgttgcccaggctggtctcagactcctgggttcaagcagtccttctacctcttcctcccaaaatagtgggattacaggtgtgagccaccccgcccagcctgaatggtgttttaagtgctgatgaaacaggtgttcttgttaccttatcatatgcttcatgccaaaggtagactttgcaaaggaaataaacagattgatgattggtgtttctactgtaatgcattttggaacaattgtctttggcaagtcagctaactctcagtgcttcagaaatgttcctccgtgattaccaagccaatacacatgcctgaataatgagagatgtgttactgaatagctgataaagattgacaagggaatgcaaggagcaatacacagtatgctcttgccagtagacaattggtctgcccacaacatactcctacacttggatcatgtaggggttgagtttttcccattgaactacacagccattctgcagccattggatcagggtacagttggcacagtgacagctcacttctgaaagcagttggaacaactctttctaaatgtagagcatgaagagaaaaatggagaaaagcaacatgagtaagccattgacatgattgcagagacttggtgatctataaagttatctgtaatcatgaaatgttagcaaaacacaggcatgattcctgtggaatcccctgaggtcctcctgtaagaagactgcaactaaatgtggtatttgaaccaatctagcactcaactgctgctgtcattgatgtctcaaaccagtttaattttgaagactgtgtggctacagatagcaatttaactatttcccaagttaccaaatcctgaagttgctacaggagtgctaactgatgtaaaaattgaaccagaaagccgtggtgatagcgatgaagaaggcaacaatgataatcatgatatgcatgaggaataagtgatggaaccagcaacagtgaacatttctgaagcctttgcaagtatagaaagtgcttagaacgttcctttttcttcaagcagatgttcctcttgaggtgcatacccaattaaatgatatagatgaacattcagcgactactgcaacacaaagtattttgaaaagccaagttcctagttttctccttaactacgaagttgtgaaaatattgattttataaagtctataaaatagtaagcttaatgaatacttatactggccaggtgtggtataagtatacaggcatgggatcatgcctgtaatcccagcactttgggaggcagaagcaggtttgctttgttgccaggagtttgagaccagcctgggcaacatggcgagaccccgtccctaccaaaaaaaaaaaaaaaaaaaaaaaaagccaggtgtggtgcatgcctgtagtcctagctacctgggaggttgaggtgggaggatcacttgagcccaggtgtttgaggctgcaggctgcagtgagctatgatcacgccactgcacgtgcattccagtctaggcaatcgagtaagaagactgtctcaaaaaaaaaatacttgtgcaaacaaagccccaatgtgtgtttaagtatgaatgtttggctcttaacttttattttataacatttactgtacagcgattgcagcatttcccccaaataattttactatattgtcatttatgtccatctttggaagctttctttctctacctcccctctttcaaccctcacctcccatcccagcattagatggcagagaggataaaataagcttttgcctaataatacctagaagagaaaaatactcccaaagtgctgacatttcagctaggaaaacaagaagacaaaagacacacttggatttaataggatagatttacagtagctaagataaaaaaggatattcagattaaggagatagcagggcataacctacccagaaagttgctgattggcaatggaagagtaagtacaaacagctccttatccttactgcttgggaaaatgagttcgtgtgtgggctagtggaggaagacagaggagcagtgggggaaactggccaggagtgaatctgtaggagaagataatgagcaaaggaatgctggtcattctctcaggttggtgttatggaggggctgttgaaaggtgaggaggagtgaaagcaaggaactaaggaaaggaacggataacctactggcctcacctactcatagtcttggttgcatatgatacgacgtgactcagagcaacaaacaattctccagtcttctataaaagcaggaaaacaacctttgcccaccacttttattttgagatgaaaattaaaataatgaacaaaattaacaaattaaagttaaagcaccatttacaaagtacattatacaaagtaataagataactgacaatcacatttggtatgtatctgggttggaattcaaagaaggaatttaagaattactttttaaagaaatttatcagagaagcacaattatgaagggaaaaaatatattattttgtttttagataataaatcatcattgatcaagatgtcttcagcacctgagcctccaacattcaaaaaggaaccacccaaagagaaagagtttcaaagcccagggctcagaggggtgcgcacaacaaccttatttcgtgctgtgaatccagagctcttcattaaacctgtaagaaatacatccaggataagactttgtgtttaatccaaccagactgtcagaaagttctaattttcttgtatttgattttatcatggaaattttatgttgacaagtaagacctctctgtgaataaaagcaggtggaaggacgattgtaaatgctgtttcacatataaatacacatataaaagtaaatattttaagggcatttgagagttataatgaaaaatggttgccctttattggattggcttctcaaactatctaaagtactattttaatagttgcattaatttgaagacaacttttgttgtttgatcaggtactattaggtaaataagaccttccatttaagcaaggaaaccaaaatgaaaatctgaccattcttaacatactgcaattctaccctgtaggtaatatttttatctaagcaatattacagatactttgtgaaaaattccaaaacatttgatttgatgatattcatttatttattagaggttctgtcacctaggctgtagtgcagtggtacagtcagctcactgcagcttcaaacccctgggctcaagggatccttgtacctcagcctcctgagtggctgggactacaggtgcacgcctttatgcctggctcatttttaaaattttttgtagagatggtgtgtcagtatattgcccaaactggttttgaactcctggccttaagcgattctcccacctcagcctcccaaattgttgtgattacaggcatgagccaccacgcctggctgagtttatttttaaataaatgtagattctattttaaaataaatgtaaaatcaaattaaaataaaatatgataaatatttaagtgtgttgaatctgattagaattttagtaacatagttatcaatgtaaacttttaaagttaaatagatcaacttaatcagatcattaaatcaaggtaaaatattttaaaagctttgaactaatgtgttcttttaattgctaaaagcatttcaagaattgtaaatttaaactgctctgagtctgtgtcctttcttaggtgttcatctaagtgaaaaagtttgacccttattttgaaatagaagtgtcacctaaaggaagaaactgaggcaaattaatataggtagggagtttatttgggccaaggttgaggactgcagcctgggaaacacttcagagtaaccttgggaagcactctggagagcaaaagagaggctggagtttttaagaaaaaagatgaatcaggagagggggcaagtacaaaagttgcttttcagtaattttcattggtttgcagaaatgacattgattagtaattatacattgttgaactacagagtatgagttataatgtctagtggagggcattgtaaggttaatatatagctattggttgtgtcagtccagagcccacataacaagggcttcaaaattattacttagctcaagacatgactactgtctcattccaatgcctctctgggcctgataatttaaagggggctcacattccacagttaaagagtttcttttatttctcagtagtggtacagcaggtatggtgacagaagcagaaactgttatttatatcactactgtgcatttacattgacctaagaaagaccaactcgttgagtgtgaacatgcaaagaaaagggtctgaggtacagtttcaggagtaacaaagttaatagacaaaatacttttctggagttgtgaacatctttcctgtatttaaaagcttttttttttttttttttttgactgggcatcatgactcatgtctgcaatcccagtactttgggaggctgaggtagagggatctcttgaggccaggagttcaacatactgagactctatctctacaaaaaaatttaaaattagtctggccacagtggctcacaccaaggtgggcggatcacttgaagtcaggagtttgaaaccagctggccaacatggtgaaaccctgtatttattaaaaatacaaaaaaattagccaggcatggtgtgcacaactgtagtcccagcttgggaggctgaggcaggaaaatcgcttgagcccaggagtttgagactgcagtgagctatgattgcaccactgcactccagcctgggcaacagaatgaaatcctgtctcttaacaacaacaacaaaacacagcgtgtgtgtgtgtgtgtgtgtgtgtgtgtgtgtgtgtgtgtgtgtgtgaaatcctgtctcttaacctcttaacaacaacaaaacacagcgtgtgtgtgtgtgtgtgtgtgtttgtgtgtgtgtgtgtgtgtgtgtgtgttttaacctgaaagcatcactttgcctcttagggtcttggattgtccaagagtaaatcaaggttaacagcataatagctgttcccatcactaaatttcttgaggtaatggagtagtttcccagagaagagtgtatacatcatcatcatttctgtgcctattatataaaaggttttttgccagttattcatgacttgggcaagaagaatagcatgtctagttcattcctcacttcctaataaaatgaactaatttgaagtttgcaaatggagagacttgggcccaggacccaggaagttaagcagctcctccacttcacccagataacattgaaaactccgggtgctgaccagttttcctgccccactcctttcccagctgtcaccttcctgagagtagaggtctgagatgtccagggtgtagatgggagaaagcctggagaggagaagcaagagtcttctataatctctagataatcagtagcttagctaattgaataaagaactgaataaatgattttaattgaaatattgccatggtaatgctagtgttgtaataaagatgtggcatgtcaggaggaaagtgcaaccgatatttgggtctcctcaaattgttagtcttactaaagctttataatttttttttctttgacagaacaaacctgtaatggctttcggattggtaactctttcactttgcgtggcatatattggttatctacatgcaatacaagagaataaaaaggacctctatgaagctattgatagtgaggggcacagttatatgaggcggaaaacatccaaatgggattagtagtgctggttagtgcagatggacctttattaaaggttctgaaatcttcaaatgaaagaccttgtgagtgtacagtatcatgtttcttgttctagaacatgctaatgaagagagaagatagcagttgcaaccagacaactgtcgtaaattttgtcctttcacagctgcagccattatctcattctttttccacagagtgagcgtcataatatttttctttccttacctcttataaaagtgccatgagaatggaagttgtttttgttaattattaaattctgtataataaaagtacccatgctgttaaatttgcatgatgttttaaatattttaagatgaattatgccggtgcagctgtcgtgaaagtttacttgtgttttgctacttgcaaaggaaatgttcatgttctccctggcatagaacctatatttttaaagaaagataaatagaaattttaaggcctgaagtcaatattaaaaatatgagatatgagaaactgagttggctctgacaagtagtttttatagtgtcacaaatggttcatatatttcagtttccattttagctatttttgggacagaattttattttaatggaaaagatccttccactcagctactaaaataaggattaagaatatcccagagtaattggagtttttctttaaaaaaaaaaaaaaagtatgttttactgaggtatgatgattttgactacaactaaatgttatctattttagtgtttatgttaattaatgttaattaattttgtttatgttaatttgtgttaattaatgttactgtaatgttataaacataagaccaagtgttcttatagttatttaaaaactacaactactcaatggataaggaatagataaggtctccttattgtaccttttttttcttttgaagtttatatgccagcaggcctttttgtttttttccttttcagaatgtttcttattctctgaagcatcagcattttgaagtgtcttttatggaagtggggacagaaatgggggtaaaaatgagtgtaaacaaagcctagccctacggtcagtacccactggaggtgagaagcagaatggccttggttgtcctggcacctggcccaggggcctaggacagaggtcaaggctaggcccctgtgtctggccagattctgccttatagaattcaaatctttcttacaagggttctggacccgtttcatttctagatatatacctaattctccaaatcattgtcattgggcctcagtagtaaatcttacctctgaagtcttgcttcagtcgctattaatattaccaagtaataataacagcacaggcagagtttatcataatgttatttttaatttgtcatactttattatggttttgtaaggtacatgaaaatgtaattatgtgtgatttgtaggtattaaagaacttagctaattgaatttacatgaaactaaataaaatctttactactgagccccaaatatgtatttgctatgcctgtctgtataatgtacttcatatagtttaaaatgcacttcagtgatacaaaatcccttttaaagactcttttgtttttgttttccctgtgtattttggctatcacaaaactagggttcttctgtttttaacttatgcatttaatgacacattgccatcttttagaattttttactattcaacagaataagctgatgtttggtggcagaggagttattagttgcgtgaactgtcaagagattgcagtgcaggagggcaacagaaactgtacaaggtgcagacttgagtcatgtaagatctatgtgaatgaaccaaagtaactagagtcagtcaagcacaaagctgtgaaaagtagtgtgtggaaagaatcatactgaattttaggaacaagtacctgactatgatactttttacagagtgactacaagttgtaggacagtctttgtgtgtgctgagtgtcaacagctgcctgcctatgtgttgatgttttcatcctttctttgttgaatgagggtataaccatcaaaaataaaatacctttcaaatagtc

SEQ ID NO: 1480 - DNA, 19738 bp, Homo sapiens; identical to SEQ ID NO: 1479

SEQ ID NO: 1481 - DNA, 46300 bp, Homo sapiens
gcattgtgaaatacccttatttttattctgaagaaatgtacatatgttaaagtactaaatccaaagagaacatatctgtgaattgctaagaaaatatagaaaagtaaagaaagttctagtcttcaaaacaagtgataaacttttaaaacatttttgcaccactgtaacaacatagtacacattttactatctgtcctagagggagatatactagtaaattataggcgaactatgacttacagtatagtacatagtgaattcctgattatgaaaggttcaacaatatgaatatttacaaagtatttcaatgttcttttggttaaatagaagtcttaagtaattatcaagtgggcacattctttttctgtggcctccacttcctatcaatgtgttgccttctgggggacctgctttcctttctgactctagagtgaccctttcggatgtctgctggttcaggcttaagtgggatacctcccagtaatatttctacttgatttggagaccactgaaatgatagctttcctccctctcctctaatccacttatatccaaggatccctgaatcggcaagaggcctgggctctgtggccttttccctaggcgggaccttcctgttgaatgttcctctgtgtgtccccagctggctgctatcctatcccacagtttttccctgcagagattgagtaggacagggagtggggccttggctgccactttggaaagattgccagttccttcatttcagctcggaggccatcacatttgcctaaagtgtcactttttatattttccagttcattgtgcaccaattgtaatgagatagttagaaaaaacagaaaactgacacagggtttctttttttttttttttccctgaaaaatctaagctcttaaaagaatcctgttagatttcttcagactaatttgcaattacctattctaaaacaactaatgttatccacatactggagaaccctacaacaaaacaatgagacctctgtctagagctcataactgaaagcatattgacaatgtaaaaaaattcctcccaaatgatactaaggctgatgtgctttgtcttccaactcagcttaggccttgctgaggagggatgcaggttttctttgtttaaccctcttgtgtgtcacagagtagctttgcttcaggtagagggagtgtgtttatggccaagtgtgaagattctggagtaggggaggggtccctctcctaccacattcaacatatctgaggctgtggcactcacacactgaggacttgaggtttttttaaatatttttggagacagcacttaataaagcacttgagaaccaaaaaactcagttcaatgaaattcaacacaatacacaagcatgaggtgatgaccaagaagaggatgaagatcgtcttctcagtgggtttggagatgaagcagtccacagtgttgggacaaggcttcaaatcacactttataaggtagggaacactaaagccatcatatagcttataaaataaaacaaggaagccaatttcaaaaccagttttaacaatgaggctgataagataagcgtaccataggcccccatccattgtacctgggctgacatagagtttctttctgtgccttttctctctaccctcatgataggctacatgtaaaaccaccagaagtgaaggtgtggagaccattatcagttgtaaggcccaaagtctgacttgggaaatggggaagaagtcatcaaaacacacatttttgcaaccgggctgtctactgttgcactcaaactctttctgctcatctttccacacgtgctctgctgccaccatgtagaccagcaaacggaagacaaacacgacagccagccaaatccatccagtcccagtggagtatttatttactccactcaggagatctctgaggaacatccaactcatgacttaggctcaaaagaaggcaagactctgcaaaataagacaatttcatcaggatccatttatttctattctacagatcgtttctactatttgagggattatgtaagataaattacaatttctgcattataacaactctggtggtttagggctctctaagaatcccgaaggatatgctgtcttacatacaaggagatgatacaactggcccatggacataattaatcccatgtccactttaatttgagatttggttggtcatctaccccaccgcccactaccccattttcaaacaattctgtggttggcaaaatctttctagtttattgcttccctctaaagatggatgggtcatgttactgatatgaagagaattagacatgaatatcaaggtgatcctggtatcttgagatgtccttcacataccagattgttgacgctatagtctctactcactttctctaattcgttaatgcccttcccagtccttaaggtttattacctgcccctgcttcttcttggttcccatatcccatatcagcagctcagcttgccaccaatttgataatgaaaagtgaagctccccaatacaaatttccttaaactctgctccttcaccctccagactgacatattcataccaaatttaccttctttacccagtttggaaagagagtctccctcttcttaccccaaaataatcattcacgctctatatcccattcttgatctatcagttttctgtgttttgtattctgtggtcttcaatctcccgtctcctttctctcagtatacaaatatgcttaagtgttgtccatttttagtgggggagagggagaatcttcatagcttatcttgttgacagtctttcttcctttattcctcatttctacttcctcaactgttatttactcctcaactcattgagtctagtttttctgctcatcattgtacttaacgtttatgctaaagttagcactgtcatgcaactgccaaatcttctggacacttggattttatgtaattttcctgtgacatttgacactgttgcctgtgcttgcattcctgaaacttcttcagacttgagttctataccactctaccctctcttcttgtttcacgcctcctgattctttcatcttcgtttttgttgtccacctcttaagaattctgtcctttgctcttttcttactctttatgctctccctagaaaatctcactcatccccatggattcgacttctgctttcaccttcctgactctccctaaacctacacagctccctgcctcatgatgatcatctaaatgtcccacaagaattctgaacttgatacatctacaactgaatttattcttttccttgcccttcaacttcattcttattgaatggcatcaccaacacccaagcgcctgtcagaaatctcatattcatcctagactcctctctcatgacctttttaattgcccacaaagttcttcagattcctcctaaatgcatctcaaatccatctccaggtcactgctgaaatctctgtcactcctacaactctcattaggttctatttccagtctcattatctccttccctccccttctagtacatccacgatgctatttaattctcttaaacttcttcgcatctcttgctcttttctcaataaaagctaataagaatctgaagagccttctttttcatttcggtgacattttctttctggcactgactgcttccatcttatcattgaacttcgtgggatgggcctgattcattgtttgttgggtccatgatatgctcagaactctgttctgtgcttttgagttgatctctcaaaaccactctgaaaggtggtttttgtttttgtttttgttttgtctttgtttgccttatgatggtggtggttttattcttgcaaatgaaaaggcagactcagaaatgaagacactttctcaaggtcacaaagtaagatgcagagcagggctcaagtctaatttccattaactgacagcaaggtttctcaacacttgcaccatacacattttgggctgattaattctttgtttcagcagctgtcctgtgcattgtaggaagtttagtagcatctctggctcctagcagctagaaaccagtagccaaccctgtcccctaccatttgtgacaacaaaaaatgtctccatatattttcaaatgtcccctggagagagaagacaaaatcttcccagttgagagccactgctttaactttctaccataacctgtagatatgggctagagctccaggcctgccatgaatttactttataatttctcaggtgaaaactttgccttttcaggtcctgtttcctatagtacaataattaatacttcttgttttctgcatagactcagccaaaagagaatcatggaaatggtggtgtgagtggaaacggggagttaagaaaactgagatgttccaacagcacacatgttgggagcataatacatgttctcttacagaggaagcaatatagagcaagcccacattccagagccctgagaaggcaaatgaaggctaagaggtattttcagggaaaacaaagctacatgtacacaatgccctattcagcagggaataaatacttcaatgtccttggttttcagaacacaaacaaaattgtattaaataaaaaggattcttaagcctaccggaaaggttaatgtctttatgaattattaaaacaaagccccaaagattaaaaaggaaaaaatatgtttccctatgacatgtatcattgggcgtttgtctgtattactcaagaggatatttatgtaatcttactaaacatttgaaagtaccttgttgggcattttagaggtaggaggaaggtaagagactgtgttgctaaaagaaaggcaacaaaaaaaaagtgactgatctttgaatataatcagaggatgatggcatcaaatgtcataattatgacttttattttataaatgtccatcctatttttttaaaaaaattttttttcagatggagtgttgctctgttgcccaggctagagtgcagtggtgcaatttcagctcactacaacctccgcctcccgggttcaagcgattctcctgcctcagcctcccaagtagctgggattgcaggtgcccaccaccacggctggctaatttttgtatttctagtagagacggagtttcaccatattgactaggctggtctcgaattcctgaccttgcgatccgcccacctcagcctcccgaagtgctgggattacaggcatgagccaccgtgcctggcccctattttcaaaggatggaaagacaatggcattcttattctttacaataagaatatacaaaattaaatctgaaaaaaataaacctaataaacactatgaaatcagagacctatcactctttcatatgtatatatttggttcttgtaacaattggagaaagctgtttatagaataatgtttacaaagcaagccaattaacggacatctggaaggttaccatgtcggaaaatcatatagtgaatccttttaaatctttcttgcctctacatatatgtcaatgactcccaaattatgtatctccagtgtggacctctcatctctgactttcagctgccttcttatcatctccaataggatgtcatctcataaacttaaaatattcaaaagtgaaatcttgccagtactttcttcactttatgaagcaccatccaaagcactgatccttctcagtgttctctgcttcagtaaactgcaccaccatccgcccaagtgttgaagccagaaacttggaagtcattcttcatccttctctttgcctcaaaccccacatccaatctacattcaaggccaaagtttttacctttgaaatacataccaaaacttttcactcttttcatctgcgcttccaccactctaatccatgccaccttcatctcctgcctggaacaccataatagcttcctatctgtcactctgtttctcattcttgccctctccaacccattatccattcagattaacttttaaaatggagactgtatattctcatttctctgccctaccatggttttctgttgcattgagggtaggggaaaaaaggccaaacacttatctggacaacaatagcctgtgtagtggtgcccatgcctgcatctccaaccttgtcttgcacatctccaaaggatactggattccagacatgctttccttccttcagtttctcctttagacactacatccattctgttcctccttcctgcaatactctggtccccttaacctgaatcagagtggctttccctgaccccactaatctaaattaggtcttccttggtattcttgttcattatgttggctttttttccctcatgccacttataagttgtaatcatatacttgttttcgtgattaatatctgtacagaccacatgttctttaagagaaggaactagagttgccagatgaagcaaaaatgtagaatgcacaggaaattttgaatttcagatactacacataacaattgattctcattacgccaatttaccaagcaagcttctgagtaataatttttttcatgctgaaattgtttatgctgtgcaaggaagtcctcctgaaattagatacaagagttccagttcctggagatgcattttatagatcaggtctctgggcttggctcatgtggatgaatcccttagaatagattgagtaaacaatgtgcctgactttctgaacttttggaaatgagtgccagttctgactgtggtgacactgttgaaacccctgttgagcagcccacttgttcttctcttattgcaggatgagctttgccacaccagcaacttcttgcccaacactggaggctttaacttcctgcgaggttcaggcaatgtcaagctggcctctgggaggaagacaggcaaggctacctgcataaatactgtccaaaaagcccttgcactgctgggagccagagagctgcttcgtcattccccaaaagtgctggtttgaaacttgtgttcgaggagcactggatttccaattgccttgcagactgccagcgacactccctgaaaaatccttcagccttcatacacagctcctttcacctcttagtaacaaaatgctcatccttgggcacttgaccatttatgcagcatttcacagcatctcatccaatgcttacctccatcctcagtagtaagcaggatgtatggtacaaccttcattttagtgatggaagaactgaaaaactcaaagaggtgggatactcatccaacactcccaataagtcagtagcaaatccagcagtagaagaacccaagttctgcctggctagtttctactctcccctgagtgctggattctctggtacattcataactctgttctgccttgcacacaaatcatctaacccctgaagaaaagcatttcctcccaggggcatctttccatctctgagtcctgttgtgcctgctgacactagcaaactctcattccccatctgaatgaggcatttttatttttgaagatggcctatttggaaaatccctaaaacagtgtttcccaaacccaggatctgtggcccactgagggtttgttgttatattcttaagtgtctacaagaagtttatatgtacgttcatattcctaagcttttaaaaaacaaacagaaaagcaaaaaagctgaatgaccagctcatatttaaggactgccagaggatttcagcatttctgcactcatatttatgagcattctgcaaactacacagcactcaggcccaatccagtccaccacctgttttgtaaataacactttttgagactcagccacgcctaaatgtttactgttgtcgatggctgctttcatgctagaactgcagtgtggagtagttgcgacagagacagtatggccctcaaaacctaaaatatttactatctcgccctttgcacaaaacatttacatagtacttaaaatcataatggaaccaagtaccagaactttaattattttagcctatgagaaacaacacataacgggtatgctcaagagaaagccaaataaatgaagccacgatgggtagatgtacagcaggaatgaagcctgctagtagtttgattggagacgagtggtagacgacaaacaagccattacctggcccacagaacaagtgagcctagcttcaaagaatcaggcttctatagtcagtagctggttctctcaatgagcagtgatttagtttcagcaacatgatgtcttttgtctgttaaactttaattattttaattgtactcgttttgtaatgttcaatttttattttgtaaatatagatgcataagagccataaatctacaagtagttttaggtttgatacatgtaaataattgtatattaaaaaaataatataaaaaacacttcgacactaggaatccatgaaatactgagtagaaagaacagtacccacataggccaacacatgtgcatacacaccacttgcaaggtttttaaatttcctgtataagcattgtcatttttagagaatcccctattaaaaacagtgctaaagttgccctccatccacacagaaaatgtccctagaagatcctggactgctcctctgttccccctcgtcctgctcattcacatcagccctcacactttttgctcaggcctggcattctttcttggctacaccctctgaaagctctagagtcaaccacacattccacataggcaaccttacttcgtggcagcttatccagaaagagcacatgtgatgcggcacaaaactgaatggcagtatgatgaggtttgcaataatttggataacttctcttactggaactttttaaaaagtaatgactacccacttacaagaaatgcaattttcccattaaatagacaaaactacaagaaatgcaattttcccattaaatagacaaaactacaagaaatgcaattttcccattaaatagacaaaacctatcataagagaaataagcttaacttacctctttacacagatgtggagattaataagagatccagtcagttactcatttgatttaaaaaagcatgagttggttatattgtttccctgagagcaaactagtgctttaagcccagtggtttccaaggtagtgtaagccaaacaggtgtaacctgatcatttgttttggcacataacttagatgagaattcctgggtttctgctgttttcaatatgtattgaaagagaactgaaactggaaaaaatccaaaatcgctcatatacacgcagttcattgaatattactttgtataaaaccttgctatcatctacacaaagaagctggaacaatgagagtgtgtttcatctctttaaatgattttccaacattttatcaaaagctacttaccaaaattcaatgagcaaaataacaatttaagttaatttatctttgatgagcttaatttaacttcacttcataagtcctattcttggaaatccagaaagtaaaagggcatagttttcattttcatatttttaataaatgtaatgtatactattataaaaaaagctaatagtacagcagtagagagaagtaaaaatcactttcccaaccccagaaatcattgataacagacattttctatgtatataaaaaacagatgagagagagagagggagtgatttaaagtactttatccttttatggaaccatttctaggcatgagatcatctaaaattaaagatatgtagaaatgaaaacaaaattatttcctgctagaatgagaatagcttaggaagagaattttacagttggaaatgttttagatggtatgaaatttaacaccttcattccttcattttagagatgagaaaacataaccagagagtggcctgctttaggtctcagagccagcatgaaaagtatagaaaggagctagagatgaaacccatgtctcagagctctttccttcacattgtgatgtccacatccacaaaccatgtgagtttcagcacaggttctctctggttgctcttcatattcacaacccttggttattccatatatccatatatgcaatccaaaaatccaaagaagaatgtagtttattttattttattttttattttttattttttgagacggagtctcgctctgttgctaggctagagtgcagtggcgcgatcttggctcactgcaacctccccttcgcgggttcaagcaattctcctgactcagcttcccgagtagtggggactacaggcacgcgccaccacgcccagctaatttttttatttttagtagagacagggtttcacctgttgaccaggatggtctccatctcttcacctcgtgatctgcccgcctcggcctcccaaagtgttgggatcacaggcatgagccaccgcacccagcctacagtttatttttttaatcatcaatttatattattagttatgttactgggcaattactggataaattaccagataaatccaataaagcagatattgctttgttttctgggtttttgttttgtttttgtttttgttttttttttacagagatcccaggatcccagaatatcgatccagttcccagttcccaaagggtttccatcgtgataagatcccaaagtcttgtctctggaattgtttgtccctttcagtttccactcctttgtttattactggcactcaccagactttatccatgaccttaaagcatcacctgtttgtgctaagacaccttctgctagcagcagcggggctgaggacgtttgttgttgccacaaccttgaaggtgactgtactgaagccccaggcactgatgattcagaggatcccagccttctaaaaatgtcagcactaacccaaacaaaggtagcatgcaagaatccagtatgacagaggtgtaattttccagacaaagatccctccagtatcttgcagtatctcacacagaagctggaagacggagaaattaccaggggctggggttgatcagaagaggttctatggagagcaggttacaagttggatctttatggaaagagaggcattaacatgggcatattatggacacagtgcctctgctacacttttgacaaagggatttaattcttccacctccatctttggtttgggagaaacaaatataataatgaccacagaaagagtggagcattgtaatagaaaataacaccatattgaagtcaaaaggctaaggataaagcgaaataagaaaggcagaactggagaaatgggatgaatactataagcctcattcttctctgccccttttggatttcaattttaatagttgcctcttcagtgtgaatatgtgacgctgcaagataatcagaaagtgcacagcccagagcagacaaaggcagtgtaagccagagcctttgaatgactggtgtgtccccctcaatgaaccacacaagggtggaggctgcaggaaaacacatctgagtgatcactctatcgagaaagaccacagagttgtgttgaatgcagatgccctatgagaagaacatggtcaaggttctaagcattagcaccagagctggctgcagtgatggaggtataagcactattatgcattgggaaccatcacacatgtagaactgtgctttaaacttgacctttatttctcagcagtatccctcccaagagaagccaggggttctggtcttttttgcactggttagaggcagttggagcactgtgttttgttctggcctgaatagggcctttgacaaactcaagtaggtctaaaagacagtgaccagggtgatgaggacatccctaactatgtcatagaaagaaggattgtagcaacttgagatgtttagcctggagaggcaaggtacgggggagttacttatcagaatttggtgtcatttctaattccaggtttgtttgtttttttccccacaatacatatccagcccatagactctgagttcaaacaaactgggcttggaatcctggacttatttcttacttaacttcgtagccttgctcaagatgcttgacttctctgaacttccatttccttgtctcaaaatgggaaaagcattccttgcttcacagtgtttttataatggttaaatgaaacaacagctgctcaatagatgacagctatcattatctttgtaagcaacactgacctttggttgtataatttcctggccaaaaaaaaaaatggcataagaaatgagagaagtatgcatagattttggggaaaaaaacaactaccttttgtactgggcagcaaaacacttgtggggagggctgcctccacatctcagaacaactactttttggtacaatttggaaacataagatacctacatgaagaaggaagtgcctggcaattctcagttataccagtagtaggagattatttgtagcatctagagcaacttcaggaatgcaataatcattacttagtaatgattgacatttgtgacatcaaatctgtcaaatgacaagtgtttttgaggtttcctgttcagggaagaatggggtgaagggctctgtgccttcagctgctgcctcttctggtgccataggtagttcatccatcttctgcctgatgtaggaaagaatggaggggaaatactctgtgggtacagaatatctgaggggcatagaaatggtcacattttagcaccatttctatatctgaagtgagttttcaacctttttcaaatgaaaatgtgagtcttgatctcttgattttaatcacagttcattgctgcctggcaatctagtggcatgaaggacgttgccccacaccatggctgaccgtcagcagagccaccgctctggtcccagccagataccctgtctcctcccagaaattgaagggctcatattttcaatatttgcacttaaagcattaaatatgttctaagcaatttccatgtccaagaaatgttttgagatcttatttttcctaagaaagaagaactcacatattacctaacatcaatttagctaccactgcctcagacctttcagggtttgacagggctttaagttgatgatggcatgtgcctccagccctaattagttttctggttgttgagtcaacaaatgaaaagccatatttcactcttcagcgttttgtggatcttaagaaaacaagtgtgcagtatcagaaaacatttagagccaactaatgtatttgctgtatatacagtacaatagtgactatagtcaggtgacagataaatctaggattttatcttgctccttccttatttgaatttgcttaagaaaaactgtgtgtgcacagggatgttaatgcaggtgttgggaaacaaacaaaaaattgatctccaccaacttttgccaaataaacaattcttaaccactttcacacatacccccaagaagaatcctattttaagagttaaattttatatagagacataaacacaggcaatagaatcctattctagaaaatttatataaatccttatactttaaatgtaccctgtagattaatatatgaaacataaatatggacataagtaatgatctcccatctagagtgattggaatagactcattgcaactatatcttcattatgtcctcaggaattgttgccctaattatctggcaataatgtgaaggtattgggtaacagcgtctgacaggtaataggtatttaatgaatgttagttcaatttaaggttaaagaggaaaagtataaataatattacaagtgtgttggactgaagacttggagggaaagagagaaaggatttggggaataactattactcttttgttcctcctcttgggaagtcctattgacatgagactattaggggaagggggttgatgtggtactgaatctctccaagatcgtatgtatgaatttatataaagggaaaagacctagccatcttttcttggtctatgattatttcagagccgacattctaaattagccaactctttgcaggggctgatctttaataatatttaaatacaaggtagatttaccctgaagctaatgaagtttaagcttcatggcccctgtcaggccctgggaagggcctgggcagtatgttctcatagtaacatgtttctgtaaaatctgcaaatacattttaaccataatcagtcaaaacagctgtctctttctactgtaatttttccttcattgcacttcccctcctgttagatagagttggagtggccacaggacccaacgaagggtttgggtaagctaatttgggcttagttttgatttagtgaggtgtatttatgtggttcacattcaatcatatttacagttaatttatggctatgtgttatggtataggggtagcttccaagaatcatactacctcccactgtgctgactcacccaatgttgtaaccaaaggagcagagatcaatgtctcattgcaatttggatgtgtccagtgatacccagcatcaaaagaatgtgagtttggaagagaaatatatcaaggcagattttagtctgtggaaaaatcttccaaatatggagaaacttaatggaagttttccacaaattgatcattcccagtgtaaatattattagtaaaaagtaatcagaaaaaagaatataaaattaaaaattgttaataataaaaagcacattttaaacaactacactagagaaatgactgaattatctttgttgattctctagagaaaatttaaccaagttactgtcacatgaaaaggcaattgaatatacagaaaataaaagctccttaaggaatttagtctagtagattatagaaacatttctaggcttccacaaatgattacagtgtcatgaggcaggagcttctagtaggatgagcactgagttagtggtgctcctcactccacctggacaggcagggtcagggcaaatgaggagactgggtttgaggacttaaagattttgtagaaacagttcacttgaccctagaatgcagggccatctttctctttggttttcttatgatgatcctccagagaagggcttgtcttggacaaggcaaggagataaagagtgtttgaacaactctgtcaccagaattaaagaggtttgatcaatcaaaagtaagtaaaagtgttctggtccttgaaagcaggtattggctggagtcagagacagaatcaaagggaatggagggctctcctcctattggctatgacagatttgtggccaatcaatcctctagctgagaacaactagaatggctaatataactaaaaaacaaaacaaagttaaattgtctgaaggcatcagagagccaccagtgtaactggggattgtggaaccaagatcactgagagaaagaaaattcactgaagccaacccaacattcaccttctctatttcccttaggttttcactgatatagaagcagcacaggccaagaagtggagaaccaagaggaaagtgaatactgtcaggttgaggactgaagttgagctattggcatatcttggtgctagtgagttaaaattagtcttcagtgtttgccaacgtaaagaagtcctggtacataccccagaatttcagtaaggcaaataagaaatgaaagggctgaaatccaactctaaatcacatggagtccttatctgatgaagatgatatgttcctactctgtgtctcagaagctaaaaacaaaacaaaacaaaaaaatacttctcaagaggaaaacagcattatctagaaagaactaacttctatagtgtaaaatgcataatttcagccatttaatcaaaaccatggaaatgggctcgcccctcactcgccactgacgacctgtctcaccgcacccacgcctcgctgccatccgacagaaatgcttcaattacccacagtcttgccagatgagaccggtgtccagggtactagccccttatctcacaggattttgccaaagatgtaaaatttggtgcagattcccaagccttactgcttcagggtgtagactttttagcagatgctgtagctgttacaatagggccaaaaacaatgattgatcaactggggaagttctaaagtaacaaaagatggtgtgactgttccaaagtcaattgatgtaaaggataaacataaaaatattggagttaaacttgttcaagatgttgctaataacacaaatgaagaagctggggaggccatcaccagtgctattgtactgccatgctcttttgccaagaaaggctttgaaaagattagcaaaagtgctaatcctgtggaaatcagaagtgtgatgttagctgttgatgttataattgctgaacttaagaagctgtctgaaccatgacaacccctggagaaattgctcaggttgctacgatttctgcaaatggagacaaagaaattgtcaacatcatttctgatgcaaataaatttggaagaaagggtgtcctcacagtaaaggatggaaaaacactgaatgatgaattagaaattattaaaggcataaagtttgattgaggctatatttctccatactttattaatacgtcaaaaggttagaaatgtgaattccaggatgcctatgttgtattgaatgaaatgaaaatttctagtgtccagaccactgtacctgctctttaaattgccaatcctcactgtaagtccttggtcataattgctgaagatattgatagagaagctcgaagtacattcatttttaataggctaaaagttggtcttcagatcatagcagtcaaagctccagattttggtgacaacagaaagaaccaacgtgaagatacagctattgctactggtggtctggtgtttagtgaagaggggttagccctaaattttgaagctatttagcctcgtaacttagaaaaagttggagaggtcattttgaccaaatatgatgctatgcttttaaaaggaaaatgtttttccttttaaggctcaaattgaaaaatatattcaagaaatcgttgagcagttagatgttacaactagtgaatatgaaaaggaaaaactgaatgtatgtctggcaaaactttcagatggagtagcagtgctgaaggctggtgggacaagtgatgtcaaagtgaatgaatgaaagacagagttacagatgcccttaatgctgtaagagctgctgttgaagaaggcattgctctgggagggggttgtgccttgctccagtgcacttgagccttggattcattaactccagctaatgaagatttaaaaattcgtacagaagttattaaaagaacactcaaaaatcctgcagtgactattgttaagaatgcaggtgttgaaggatttttgatagttgagaaaattatgcaaagttcctaagaagttggtgatgatgctatgttatgaatatggtggaaaaaggaaaaattgacccaacaaacattgtgagaactgctttattgggcgctgctggggtgcactctgttaactaaatcataagctgtaattacagaaatttctaaagggaagaaccctggaatgggtgcagtgggtggaatgggaggtgagatgttcttattcctagaatagtgctttattaatgaactgtgacaggaagctcaaggcagtgttcctcaccaataacttcagagaagtcagttggagaaaatggctgaaggctgatgtttaagaaaatcactataaccatcagttactggtttcagttgacaatatataatgggttactgctgccattgtccatgcctacaaataatttattttgtatttttgtataaaaggacatttgtgcattcctgatattgggtgcaaccaccatgtaccaatgtacttctttcaacttaaatcacagaggtatttttactactattctataagtcagaattttagtgcttactatcaccagatgaaaagttaagcagcctttctgtagagaataagaattgtgtacaaactaggaaaatatccaattatgtgacaactttgtgtagtaaaaatttgtttaagctaaaaaaataaacagactgacaagcatccagatactgatgttagttaatacggactttaaaatagctattaatgtattcaagaaaataaatgacaagatggaaaatttcatcagaggatgaaaatacatttaaaaaatcaattagaggggcggttccaatatggctgaataggaacagctccagtctacagctcccagcatgagcgacagagaagacgggtgatttctgcatttccaactgaggtaccgagttcagctcactggggcttgtcggacagtgggtgcaggacagtgggtgcagcccaccaagtgtgagccaaagcagggtgaggcatcgcctcacccgggaagcacaaggggtcagggaattccctttcctagccaagggaagctgtgacagacggcacctggaaaatcgggtcactcccagcctaatactgcgcttttccaacggtcttagcaaacagcacaccaggagattatatcctgcacatggctcagagagtcccacacccacggagcctcactcattgctagcacagcagtctgagattaaactgtaaggcagcagcgagggtgggggatgggcgcccgccattgctgaggcttgagtaggtaaacaaagtggccgggaagctctatctgggtggagcccactgcagctcaaggaggcctgcctgcctgtatagactccccctctggaggggaaggtcatagctgaacaaaaggcagcagaaacctctgcagacttaaatgtccctgtctgacagctttgaagagagtaatcgttctcccagcacagtttgagatctgagaacggacagactgcttcctcaagtgggaccctgaccccggagtagcctaactgggaggcatcccccagtaggggcagactgacacctcacatggccgggtacccctctgagacgaagcttccagaggaatgatcaggcagcaacatttgctgttcagcaatactcgctgttctgcagcctccgctgctgatacccaggcaaacagggtcaggagtggatctccagcaaacaccaacagacctgcacctgagggtcctaactgtcagaaggaaaactaacaaacacaaaggacatccacaccaaaaccccatctgtacgtcaaaatcatcaaagaccaaaggtagataaaaccacaaagatggggaaaaaacagagcagaaaagagaaaattctaaaaatcagagcacctctccccctccaaaggaatgcagctcctcaccagcaatgcaacaaagctggatggagagtgactttgacgagttgagagaagaaggcttcagacgatcaaacttctccaagctaaaggaggaagttcgaatgcatcgcaaagaagctaaaagccttgaaaaaaaattagatgaatggctaactagaataaccagtgtagagaagtccttaaatgacctcatggagctgaaaaccatggcacgagaactacataaccaatgcacaagcttcagtagccaattccatcaactggaagaaagggtatcagtgattgaagatcaaatgaatgaaatgaagcgagaagagaagtttagagaaaaaacagtaaaaagaaatgaacaaagcctccaagaaatatgggactatgtgaaaagaccaaatccatgtctgattggtatacctcaaagtgacggggagaatggaaccaagttggaaaacactctgcaggatattatgcaggagaacttccccaacctagcaaggcaggccaacattcaaattcaggaaatacagagaatgccacaaagatactcctcgagaagagcaactccaagacacataattgtcagattcaccaaagttgaaatgaaggaaaaaatgttaagggcagccagagagaaaggttgggttacctacaaagggaagcccatcagactaacagcggatctcttggcagaaactctacaagccagaagagagtgggggccaatattcaccattcttaaagaaaagaattttcaacccagaatttcgtgtccagccaaactaagcttcataagtgaaggagaaataaaatcctttacagacaagcaaatgctgagagatttgtcaccaccaggcctgctctacaagagctcctgaagaagcactaaacatggaaaggaacaaccagtaccagccactgcaaaaacatgccaaattgtaaagaccatcaaggctaggaagaaactgcatcaacttatgagcaaaataaccagctaacatcataatgacaggatcaaattcacacataacaatattaaccttaaatgtaaatgggctaaatgctccaattaaaagacacagactggcaaattggataaagagtcaagacccatcagtgtgctgtattcaggagacccatctcacatgcagagacacacatacgctcaaaataaagggatggaggaagatctaccaagcaaatggaaagcaaaaaaaagaaggggttacaatcctagtctctgataaaacagactttaaaccaacaaagatcaaaagagacaaagaaggccattacataaaggtaaagggatcaattcaacaagaagagctaactatcctaaatatatatgcacctaatacaggagcaccaagattcataaagcaagcccttagagacctacaaagagacttagacttccacacaatgataatgggagactaacaccacactgtcaatattacacagatcaatgagacagaaaattaacaaggatatccaggaactgaactcagctctgcaccaagcagacctaatagacatctacagaactctccaccccaaatcaacagaatataccttcttctcagcactacgttgcacttattccaaaattgacctcatagttggaagtaaagcactcttcagcaaatgtaaaagaatagaaattgtaacaaactgtttctcagaccacagcacaatcaaactagaactcaggattaagaaactcactcaaaaccacacaactacatggaaactgaacaacctgcccctgaatgactacagggtacataatgaaatgaaggcagaaataaagatgttctttgaaacccataagaacaaagacacaacataccagaatctctgggacacatttaaagcagtgtgtatagggaaatttatagcactaaatgcccacaagagaaagcaggaaagatccaaaattgacaccctaacatcacaattgaaagaactagagaagcaagagcaaacacattcaaaagctagcagaagacaagaaataacgaagatcagaggagaactgaaggagacagagacacaaaaaaaacccttcaaaaaatcaatgaatccaggagctggttttttgaaaagatcaacaaaattgatagaccgctagcaagattaacaaagaagaaaagagaagaatcaaatgacgcaatataaaatgataaaggggatatcaccaccgatcccacagaaatacaaactaccatcagaaaatactataaacacctctatacaaataaactagaaaatctagaagaaatggataaatttctggacacatacaccctcccaagactaaaccaggaagaagttgaatccctgaatagaccaataacaggctctgaaattgaggcaataattaatagactaccaaccaaaaaaagtccaggaccagatgtattcacagccaaattctaccagaggtacaaggaggagttggtaccattccttctgaaactattccaatcaatagaaaaagagggaatcctccctaactcattttatgaggccagccccatcctgataccaaagcctggcagagacacaacaaaaaaagagaattttagaccaatatccctgatgaacatcaatgcaaaaatcctcaataaaatactagcaaaccaaatccagcagcacatcaaaaagcttatcaacgatgatcaagtgggcttcatccctggtttgcaaggctggttcaacatatgcaaatcaatgaacgtaatccagcatataaacagaaccaaagacaaaaaccatacgattatctcaatagatgcagaaaaggcctttgagaaaattcaacagcccttcatgctaaaaactctcaataaattaggtattgattggacgtatctcaaaataataagagctatttctgacaaacccacagccaatatcttactgaatgggcaaaaactggaagcattccctttgaaaactggcataagataggtttgccctctctcaccactcctattcaacatagtgttggaagttctcaccagggcaatcaggcaggagaaagaaataaagggtattcaattaggaaaagaggaagtcaaattgtccctgtttgcagatgacatgattgtatatctagaaaaccccattgtctcagcccaaaatctccttaagctgataagcaatttcagcaaagtctcaggatacaaaatcaatgtgcaaaaatcacaagcattcttatacaccaataacagacaaacatagagccaaatcatgagtgaattcccattcacaattgcctcaaagagaataaaatacctaggaatccaacttacaagggatgtgaaggacctcttcaaggagaactacaaaccactgctcaaggaaataaaagaggatacaaacaaatggaagaacatcccgtgctcatggataggaagaatcaatattatgaaaatggccatactgcccaaggtaatttatagattcaatgccatccccatcaagctgccaatgacattcttcacagaattggaaaaagctactttaaagttcatatggaaccaaaaaagagccagcattgccaagtcaatcctaagccaaaagaacaaagctggaggcatcacactacctgacttcaaactatactacaaggctacggtaaccaaaacagcatggtactggtaccaaaacagagatatagaccaatggaaaagaacagagccctcagaaataataccacacatctacaaccatctgatctttgacaaatctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctcattaaactaaagagcttctgcacagcaaaagaaactaccgtcagagtgaataggcaacctacaaaatgggagaaaatttccacaacctactcatctgacaaagggctaatatccagaatctacaatgaactccaacaaatttataagaaaaaaaacaaccccatcaaaaagtgggcgaaggacatgaacagacacttctcagaagaagacatttatgcagccaaaaaacacatgaaaaaatgctcaccatctctggccatcagagaaatgcaaatcaaaaccacaatgagataccatctcacaccagttagaatggccatcattaaaaagtcaggaaacaacaggtgctggagaggctgtggagaaataggaacacttttacactgttgatgggaccgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcagcactatttacaatagcaaagacttggaaccaaccctaatgtccaacaatgatagactggattaagaaaatgtggcacatatacaccatggaatattatgcagccataaaaaatgatgagttcatgtcctttatagggacatggatgaattggaaatcatcattctcagtgaactatcgcaagaacaagaaaccaaacgctgcatattctcactcataggtgggaattgaacaatgggaacacatggacacaggaaggggaacatcacactctggggtctgttgtagggtggggagagtggggagggatagctttaggagacatacctaatgctaaatgacgagttaatgggtgcagcacaccagcatggcacatgtatacatatgtaactaacctgcacattgtgcacatgtaccctaaaacttaaagtataataataaaatttaaaaaaaaatttttagccaaaaaaaaaaaactattaaaaaaaagatggattaaagacttaaatgttagaccaaaaaccataaaaaccctagaagaaaacataggcaataccattcaggacataggcatgggcaaggacttcatgtctaaaacaccaaaagtaatggcaacaaaagccaaaattgacaaatgagatctaattaaactaaagagcttctgcacagcaaaagaaactaccatcagagtgaacaggcaacctacagaatgggagacaatttttgcaatctagtcatctgacaaagggctaatatccagaatctacaaggaactccaacaaatttacaagaaaaaaacaagcaaccccatcaaaaagtgggcaaaagatatgaacagacacttcttaaaagaagacatttatgcagccaacagacacatgaaaaaatgctcatcatcactggacatcagagaaatacaaatcaaaaccacagtgagataccatctcacaccagttagaatggccatcattaaaaaatcaggaaacaacaggtgctggagaggctgtggagaaataggaacacttttacactgttggtgggtctgtaaactggttcaaccactgtggaagacagtgtggcgattcctcaaggatctagaactagaaataccatttgacccagccatcccattactgggtatatacccaaaggattatacatcatgctgctataaggacacaggcacacgtatgtttattgcagcactattcacaataacaaagacttggaaccaacccaaatgtccttcaatgatagactggattaagaaaatgtggcacatatacactatggaatactatgtagccataaaaaatgatgagttcatgtcctttgtagggacatggatgaagctggaaaccatcattctcagcaaactatcacagggagaaaaaaccaaacaccgcatgttctcacttataggtgggaattgaacaatgagaacacttggacacaggaaggggaacatcacccaccggggcctgacatggggtcgggggaggggggagggatagcattaggagatatacctaatgtaaatgacaagttaatgggtgcagcacaccaacatggcacatgtatacatatgtaacaaacctgcatattctgcacgtgtaccctagaacttaaagtataataaaaaaatcaattacagattctaattaatatcccgtaactgaaattaagactgcaaaagatagctttaacagcagattaactgaaaaaagatttattaatctggaaaacaaatcagtagaaaatgtcacttgaagcattgagagaaaataagatgaatatgtatttaacaaaaaagaaaaagacatttggggcataatgaaaagtttaaaatataaatcctcagagtccaaaatgagagaaaagagaaaatagggagaaataattttgattattggccaagaattttctcaatcatgcaaaaattatcatgacatatattcaagaatctttatgaatcccaaggaggattaacacaaaggaaaacttactgaggcatatcgtgataagactactgaaaaccagagacagagaagaccttaaaggcaaccagataaaaaaaaatgcatgacttttaaagaaacaaaataataaaaataaaggattccagaaaaacaatgtaatgacatatatgacgtgctgaaagaaaagaattgcaatctaaatttacccaattaaaataatcttatagggaacacatctccatctccttttcctgacaaaaaaagacaaagatattatgaatcatctgtaatgaatactggaagtgtccctctggctgggctgaattccctttcttgcatgtttccgattggcatggacagtcagggagagatgtgggaggtttggaagagaagccacagccttggcggctgacacacgttgttgctgtcacactgattcaccttgttggtgtgaagcagcagctgggcctgcaattgctctacattctcctggatcctccttcatcttccctgactcatgggccaggtacgtgtttagctttgtaatgaagggcacaggcttctgcaggatacccttgtcaccaaggtcagaggcaacaagacaaatgtttcagttcttccttatggatttccagcttgtgcttttgagttccagccttccagagtcttccctgcctgactgcctgcatcgtggacttcccactccagcatcacacatggagacaacggcctcacagagactgttcaaccagctcccacaattgcacagtccaattctctgaaagctcagaaacagacccacacatacacagtctcttccgtggtgagcaggtatatgcaacctaccccaaaggccaagggagctgaaaggctgaaggaagaggctgacaaaaccagtttctcagaaagaaaatattgattttttttcttctgttttgagatgtattgatcagagaagaaaaaagaaaatatttaatagggacttaaaaacagaaaccatgtttctggtggctgtaagacagtgaatccctgcatccaccctctagaaagtatcctttctataggaagcttttgtggtaagacatacagctgctcatatctcagactttcttgctgaaacttgtgactactggagaggtcagagaagcagctttatgaggggttgtctgtgctatgagcattgtttaaagaccttgctgcagaacaccttggtatgcaagagtcaaacattggtcatcatggtaattttgcatcaagatggatcactctttcatgcaacaggctggtttcctatatagtccttaatcttttatggtgatgctgcagtgtaatgggggagaaaatggtcttttcaataaacaatgctgggccaattggaaatccatatggaaaaaaaattcatcttgattgctaactcacacgatacacaaaatacaactgtagaaggatggtagatgtaatcaagaaagataaaataataaagtttctagattttagaatataacaaagaagaatatcttcattaccagggtgtaggaaaagatttcttagatatgatatgaaaagcactaatcataaggcctaataaattgaatttcagtgtttcgaggaattgataacttgaatttcattaaaattaagaacttgttaatcagaagacaccatcaagagagtaaaaaggcaatcagaggatgggagaagatatttgcaatacatgtatctgacaagaaaactatatccagcacctatacagaattcataaaaattaataagaaaacataaacaagtgtgggaggggggtgagggatgaaagactacacattgggtaccatgtacactgcttgggtgatgggagcaccaaaatctcagaaatcaccattgcagaacttagccatgtaatgaaaagccacctgttcccccaaaacatattgaaataaaaaaaaataaaccaaatattcatacaaatcaacaagaaaaattgagaagctcaatcaaagccaaaaaacaggtactttgtaaaaaaggataccccaatggaaaataagcatataaatggatactaatcgccaaaatattgaaccttaaccaaaacatcttaacttaaacacactttgtataagaattaactcaaaatgaatcatctatctagatgtaaaacatattatattactataaaactttcagaagaaaacacagaaacaaatcttcacaaactggggataggcagagttcttagagatgattccaaaagcaggagccaaaagagaaaataaggaataaacttcttgtaagtctatctttatttccaaataaaaagtttaaaaataagcatatgaaaagagaataattataaccatcaaggaaatacaaattaaaccacaatgtgctaccactacacagccaccagaatggctaataccaaaaagactgacactattaagtattgctgagaagatatggaaacaaacttgcattcacttctgctgggagtataaattggtgcaatcactttgaaaaactattgaatctattaaaattgaacatatggttaccaatgacttagcaattccaatcccaaatatatacatatgtgcatcaaaatacaataatgttcacaacagcactattcataatagcctcaaactggaaatacccaaatgcccatcaacattagaatgggtagatacattgggaaatattcatattgtcaacctcctcacaaagaccaccagaaaaacctgttgaccaagcaaagcttacacagtcttagtgtctctaaaaagagaaatcacagaggaatatatacagggtttgggattctggattcatgaggttaaggcaggtatttcaaggtggggaattgataggaatgtgtgaagttcatgacacagtattttaggactggtggacacagtaaggtgacagtctggagatgagttttatgaagagcaaactattgtcctgattaagtgagctgtttacctcagtaagcaaactgattgtataaattggtttgcagaatttgctgatacaaacagtatagtactttattgttctgcaatcacatttttcctggcaagaatttcttggggaataaaagcaataatattgacacaggtggtctcagctctcagtcccatagttaagttcaggctgatgcaggtacccttgattcttaatactatggaatattagacatcaatgggaatgaataatgaactaataaatgcatcagtatgaagaattgtaaagcctaaaactaaaaaagaactagtatgtggtgatagaaataaaaaagtcagttcccaggggagggagtggatagtgagtgggaggagacataagggattctaggatgctggtgatattccagttcttattttggatgttggttacctgagtatgttcacttgtgaaaatccatcaagcagtagacttagaatttgtatgcttttctattcatatgttatacttcaattaaacaaaaagtttacttaaaaactggaggtggtcgggccgggtgcagtggctcacacctgtaatcccagcactttgggaggctgaggtggatggatcacgaggtcaagagttcaagaccagcctggccaagatggtgaaaccccgtctctactaaaaatacaaaaattagccaggcatgttggcaggcacctgtaatcccagttactcaggaggctgaggcaaagaattgcttgaactcgcgaggcggaggttgcagtgagccgagatgacaccactgcactctagcctgggcaacagagtgagactctgtctacaaaaaaaaaaacaaaaaaaaaactggaggtggtcaaggcaaagctctaagtttagcaccagtttatgccttaagtatgttgttgaaaataaatgcaacaacagtattaaagaacattttaacaaaagaagagaatctcttacaagtatacaagccaattatcccttttgccttgattcacccagtttccgttattacatacctgctgccactttgccttattttatcagacattcatggggaaatggcagaacactctttacccgcctccctattcaaattgtattgatcaaagctctactttcttcaggaagaaaacgtgtaatatatgatgtttatgagccatggctgaaagagacagggcattcctagttgcttggaatgagtggtagaggtttagtgatctgaaacagaaataaggtgagcatcttgttcagattagaaaaacccaaaagtcctgttaccatgtgagactgtcctctcctggagatttcagtcttttcactgtgcattttaaacaacttctatcattaatcaagaaaagcacttagcttgtcactgggttatcttaatttggcacattcacagctctgctgtgaataaaacaatgacggtaatctacaaataatcctgcctgtgtgtcatctattgtataacaacttctaaatgatttgaggaaaacctcacaagttttcaaatgtatcaaggaacaggagaagaaaggggataaaaagatagacaaaaataaaagagaaggaattcttcctactacttattgaacttaagacttttcagttttatttgaggcattatgggacacccttttaggactattacagtaaaggactttattatagctaatgcatgtaagtaactcaattatttgctttatgccctaaaaggatggagttaaaaatagagttttaatcttcccaaaatctctgtatttcttgtaagtcttgtgaagtaccttctcaggataaatgtcactgtattcaaataaaattgccccattcctaatccataaagatttattattaattccaatcatattcaaatctcaaccatctgaaatggttgttatgtctgttgtgttggaggcttcactaggtcagaaatataaatcttcagagaattcttttgagttaaaatatcacacgtctctctccccaaagtagaaactatgtaataaaaagcaattatgacttatttggcaaatggaaaaggaaagaaatcaccttatcatgtaggtcagcgtttctgaaagtggggtttgaggagcagcagcagcacctcagaactttttaaaaacggaaattcccaggcccactccagactacagaatcagaggctctgagaatgggatcttgtaatctgtgttttaacaagatcctccaggtgattctaatgcatgctcaagtttgagaactcctcatgcaggataatgctgaggggatgtggatgttttggaccaattgacaagtcttcagaagcactaagaaatcttgtgagttcatctgttaagctctgggacatctcccctaaatagctatacatttcataaggtactgctttttatatctacattaaagttgttttatttcacaggcactgtatggtaagcagcaatttctagtacaacctaaatgtttccatgcttttctagtatctgggtaaatataaggccattagaacattgatactggcatttcactgacttatttgcttctccctggaaactttaggaccttagccctccctacccaagggtgtggctagttacaaaagatctgcaacaaagcctcacacgggcccctctctatctcagagggctccccttttttccctcctttctgggaagtaggtttgggcaagggtagaaaagtaagaagaagggtgagtttaggggtttctttgtgtttttatttcagttatgggatgaagtttatgaagaaataagagacctgtgcctcagcaccttgagacaagttgtttctgtaaccctgggtgctgtgggaagaagctacggaattttttaggacatggatagaggctgtaggcccatcctgaccagttccactctcttccacttagccctctttgactttatctcactcccaccttcattctgggcaagtggcccctcagggtctatggattcaaagcaatgcattggttacttcacttcaccatggcaccccacctccttacttaacatctccctagtctactcaacattctttcaattaatatttctggaactctttaatatatctgggaatccagctgtaagcaaaacttaacgcatttaggaatggagcttgcatggagctccatggaactttcctggggcatccacgccttcacagaactgacattctaatggagaagagaaacaataaagaaataaatcatatgatgtcaggaaataataaactttttttaggtaactcaggaatctctcttgtgcactcagagacgatagctctctcatgtgtactcagagcaaagataggcccagctatctttccactctggccccctcatttaattagccaccattggaagaaagcatctcttttccacaaaaatgtggcaaaagcaccactcagtggaaaagagttgttttctggatgctgcttttcaggagcatattccccgccgaccccttgtgtgaagtgggcgtctgctgatttcatcttcctagcatctgtttcccaacccaactggtggggaactgcacctccacaattatgataatgtgaccttaaccctggcctgtccagcaatgatatctttcctcctgtccaaagcaatttgtcctgaaaaagggcacaaacccaaacaaggccaaaagagttgttccatgagatttgatatatgggtgatagggaaggcttcctttccacttggatgtattttaacaggatagaaacctggagctgccagcagggatgtgcccaatatatgaaatgagtgtatttaagaaacagaatagaggccaggtacggtggctcacacctgtaatcccagaacgttgggtggccaaggcgggtggatcacctgaggtcaggagttcaagaccagcctggccaacatggcaaaaccccatctctactaaacataccaaaaaaaattagcagggcatagtggggtgtgcctgtagttactattgcttgggaggctgaggcatgagaatcacttgaacctgggaggtggaggttgcagtgagccaagatcacaccactgcactctagcctgggcagcagagtaagactctatctcaaaaaaaaaaaaaaaaaaaaagaaagaaagaaagaaacagaatggagacatgagacaagacattcctgttgacatgtttggatgtcccatatctcactgctgaaatctgttccctccatagacttcccattacatatggtaacataactccttttgaacttgagttagtttcagtcaagtttctgtcatttgcaactgaaataacaggtgtgtgctgagtcttcaagaccctatattcaacaaattctctcttcagcttcttcctgatcaccatccctttaggggatcagatttgttttcagttggccaaggaacaagaaaacttgctgttctcaatttcttctgtatacatgagctgatgcgcagatatcttccctcccacttaagcaagaaggaaatgatcgcctttcctatcaactcctatgctagtcactagatattttgaatgggtgggggtagaagttgctggatccatgtgcccaatctctgcaagagctcaggattgtcctgctctagtcccctcctcataaaattatttctgtttcttagccttttctttttcttgcatagctccagttcttctccaaaagtcagctcccagagaatacaattcctacacaccaagcagggctgagctatgggagtgatgcctcccctgattatccttgtgaaggataagtaggagtgaggcaaagggcaggtgtaggaaagagtgttccatcaggaagtgtgaagccaaacagtgacatgattagatgtatattttagaaaggaggacaacagcttgtaggggagcttggctggtggcaaagccactggggcattaatcttcttaatcatcttgactcctttggctttcaaaacactccacttttgatcttcctcactctgttttgaccatttcttctcaaacccttttgtggtctcctgctgtactcattccctaaacgtggatgcatctgagccttcctggactggccccatctgtttctccagtgtcatttctctcatgttccattttattatccattctttagcaataagaaacacaccgcaccacactatatggcttcatgctttgaggtttgtgttcattctgtctcctctgacctgaaacatcctttctaacttctttgccttgcttatcactttgattgtgattctgggctcagtcatcagccacataccatcctctgtgttatatccaggccaaacaacatataattctctgtgcttccatagaatcttgtgcaaatcactttatattgaaagtatctggctgggcgtggtggctcatgcctgtaatctcagcactttgggaggctgaggtggatggatcagtttagatcaggagttcaagaccagcctggccaacagggtgagaccctgtctctactaaaaatacaaaaaaaaaaaaaattagccgggcatgatggcacacgcctataactccagatactcaggaggctgaggtacaagaattgcttgagcctgggaggcagagattgcagtgagttaagattgcggcactgtactctagcctgggcgacaaagcaagaccctgtctcaaacaaacaaacaaacaacaagaaattatctgttttaatttgtctccctcactaatctttaatcttttcctttttttttttttgagacggagtttcgctcttgttgcccaagctggagtgcaatggcgtgatctcagctcactgcaacctccgcctcccgggttcaagcaattctcctgcctcagcctcccaagtagctgggattacgggcacgcgccaccatgcccagttaattttttgtatttttagtagaaatggggtttcatcattttagccaggctggtcttgaactcctgacctcaggtgatctgcccgcctcagcctcccaaagtgctgggattacaggcgtgagccatggtggccagcctccctcactaatctttaagagttttaagggcaaagattatgtcttaatcatctttgaattcctggtgcccaggaaagcatgtggcacactgaatgcaccaaaaattttcctgctaacctgagcctaactacactgataataaacttatgcttttttcaaaagaagaacagttagaattaaaatgttttcatctcatatcacttttaaggtactttaagactttaaataatatagaataaattattattatttctaatatttcaaaatgtgagagaagtaaatacaaaatgacctgacatgaaaagtattaaaaacagttctgctaaaattatatggaagaaaaagagtaatgaattgtgatcctctaataatatcagttccccattctatttttttttttttttactaatttatatatcacaccatttgatagatttcattttcttcccaggtcagacattcctgtgatgccagacagctatacagttttcaaaaatagcaagatgtttgtccttcttacaagcaccactagaaaacagactgctccttaagctatcaggcaaatactctttgatcccagggaatttacaatggagggcatattatcagtttctattggcaccataattctgcacaacaacgaactgaacctcaatgtggcaaacaaaaatacacatatttaagttcatgaatctgcagagttcagctgatctgggcaggcttgactgacctcactcaaggcttgcacacctgtctggtcaatctacagtggcttcagttggaatgactaggatgacttggctttgctctgtatgtttttcatctccagcaggctagctggagtatgtttaccagttcaggtgtttttccagcttattttgtgtgacatttgctaatatcatattagcaaaaataaatcacaagggtgaccccccagagtcagagtgggagagcatggataaaggtggggacacagggaggggtgaagaattaggaagattttttcaaattaccaaaacgtgtaattttttcatttgtcagctaataattcattcaagggagtcagatatccttggctcacattgatcatatcaactactttggcttggctttctggtaggaaaagaaataagtgccagcatttatgttattattttttaaaaaaagacctggctttgacaaaataccagtaatgtatgatttttattaaatattgtcaaccaactattcttgcctgaattttaaaaagcgctagtggcatcagtggtcccttgagaaggctcccagaccaccagtgttgttcccagagcacactttgggaaccccagattaaaatagatatcattggtccctttgaatgtgttttcatacagattaatctttgctttatgcaatcccatcaaatacaaaatctcctggaaatattattaaatattgatggccctgctcaaaatgaagattacaaaagccgaatcagattggcatcactcttcaaagtaatttcttaaaagcagcataaaatggaatgaattataaacaaaaatgactaaacacgtcctatcattcacattgtattcatatccatgaaatgggcaaggccttcaggcttttctctgttatctttacctacagcttgtgctcttttcttacacatgcttatgtttcttgtattctttcatctgatcactttctattgatcatgacagtaaaagtactttgtttccatagtgatatttgacatgttacagatcactgagaaccctaagggataagaaaaaagtttgggtctgcttaggatgcaacataataatattttatagccttccaattgtttttagctactgcagtaacagctttttaattgaaatttaacttattttgtcagaagattgccttgtaataccagttgtcaatgaacttttaaaaattaaacctcaagccaggtatatacctaaaagaaaggaaatcaacacatcaaaaagatatctgctctcccatgtttactgcagcactattcacaataacccaatttagatgcaatctaagtgtccatcgacagataaatggataaagaaaatgtggtacatatacacaacagagtactattcagccataaaaaacaatttgcaaccacatagatggaaccggaggacattattttcagtgaaataagccaggcacaggaagacaaactttgcatgttctcacttatttgtgggagatacaaattaaaacaaaagaactcatgaaaatagagtagaatgatggttaccagaggctgggaagggtagtggggatggggggagtgggaaatggggatttttagcgggtacaaaagtatagtcagataaaatgaataagatctagtatttgatagcacaacacggtgactacagtcagcaatagttgattgtacatttaaaaataactaagggtataattggaatgtttgtaacataaatgataaatcctcgatgtggtggataccccatttaccctgatgtgattattattcattgtatgcttgtaccaaaatatctcatgtaccccataaatacatacacataaatattaaaaatttttaaaaattaaacctcaaatcaaatgtgaagttaatttggcttgggagaaaaagttttaaattcgaaacatatttaccaaagctttacataaacccatgccaaaatattggtaccttctattccaactattctgttcattttaatataacttgtgtaaaccagaaagtctatgagataggtctcaatcaatttagaggtttatttcaccaatgttaaggaccatggcctgtgacacagcctcaggcagtcctgagaacatgtgcccaaggtggtcgggctacagcttgattttatacattttagagaaatggaagttacaggcaaagacatgtatcaatacatgtaaggtatacattggtttggcccatctcaaagcagcgtgggggtgggcttccaggtcaaagatgaattcaaagatttttcacattttcaattagttgaaagagttaagctctgcctgaagatgtgaagccagctggagttaaggtaagcgggggtgttgtggcagccaaggttctccttatgtagataaagcctccgggtagctggcttcaaagaatagatgtgaatgtctcttatcagaccttaaaagatgtcagactctctggaaaagacctagtaaggggccaggcacagtggctcacgcctgtaatcccagcactttgggaggccgaggtgggtggattgcctgaggtcaggagttcgagaccagcctgaccaatatggtgaaactctgtctctattaaaaatgcaaaaattagctaggcttggtggcatacacctgtagtcccagctactcgggaggatgaggcaggagaattgcttgaacccaggaggtggaggttgcagtgagccgagatcatgccactgcactccagcctgggtgacagagtgacactccgacactccatctcaaaaaaaaaaaaaaaaaagatctagtaagggaaagagattttctatagaatgtaagttttccccaacaagagacagctttgcgaggccatttcaaaatagtcaaataaatatattttggggtaacatatttttatttctttcaggtcccactatgtgtcacgtgatgttattccagagtcaggttggaattttcttattgctacagtatattttaccagtcttacgatctccgttttaatgttaatgctggtcagttgtgtctaacctccaacgggaggaaggtataatgaggcatatccaaccgcccaccccttcccatcagggcctgaactcatttttcagggtttttttgagattaccttggccaagacagaggtccattcctttcaggggtgggttggtgatggtggtgcttagaattttatttttggtttttgtattagtctcttctcacactgctagaaagaaccacctgaggctgggtaacttataaagaaaagaggtttcattagctcacagttccacaggctgtacaggaggtatggctccagaggcctcaggaaacttacaatcatggtggaagaggaaacaagcacgtcttaccgtggtgcaggagagagagagaaagagagagagtgtgaagggggaagtgctacactcttataaacaaacatcttctgagaactccatcatgggaatggcaagggggaagtcggccccatgattcagtgacctctcaccaggcccctccttcaacacaagggggctattattccatatgagatttgggtggggacacagagccaaaccacatcagttttcacgtgtatcccaacaaacttaaacatcagcaaagtatgtgcaaaccagcatccctatatctattcttgtctcaactgcacctgcatacatcctgcatcttggactctcaaggccctaacgtaatggcagagtattaactctacacttaaatgactgttcccctaaagtaggggtaggaagaaatcagatctagctttctttcccaaatcagaatgctttccactttcatgaaataaacatacttctaggagatgtctccttttatttatacaaacatacacaccgaactggaacgtaatttgaagttgggaggtggaaaactaaaggtcaaaaagggaagaaagcaaaaacgtcccttgcacacttcagcccgcagaccccaaggaggggcgcgaggtcctcagaaccggaaaggctagcactggatgggtccccgcagccccgcgccgctgcgccgcagcctccggaagacaggggacgctgtggcgccgggcggggcgccctccgccgctctctctagcaggcggggcggcgaagcggggcggggcgtctcgggcgaggagaggaggtgaccccgcgaaaggtaagcggcggcttcggtggtgttgagtggctgggcgccggcctggaggggccagggcggccgcaccatcacgctcccgtctctgcccttcccagctgccctgccggtctccctcccagggagggagcgtcctctcggatagcccaaatctttgcctctccgtggactccctgtacccgcaccccaagtcggtgaagctctctggccccacagagcccatttcccgtactcaccttgcgggctccagtttgttcggtgcttcatccatggacacccccaccccgagaactctctcgtttcctgcagtttcttagtgtcttggctcaccagactcataggggaacatggtggtgttttgaggagacgccgcttttcttttgtcatagtgcggacactcgtgctttttcagccctgcaacacaatgtgtagaacttaacggaatgaagttttcttttggaggcttccaatgcgtctgtctttgagtaagccttcggcaccgaacagtagtccatgacattgggggaagccagatgagactcagattgtcagtactcaggctgtcgccagcaaagcctttccccttttttcagagacagtactacatccaagaggtggaaagatacttttgttttgttttgtttatttatttatttgttattattataagttttagggtacatgtgcacaatgtgcaggttagttacatatgtatacatgtgccatgctggtgcgatgcacccaccaactggacatctaacattaggtatatctcccaatgctatccctcccccctccccccaccccacaacagacctcagagtgtgatgttccccttcctgtgtccatgtgttcccattgttcaattcccacctatgagtgagaatatgtgatgtttgcttttttgttcttgcgatagtttactgagaatgatgatttccaatttcatccatgtccctacaaaggacatgaactcatcattttttatggctgcatagtattacatggtgtatatgtgccacattttcttaatccagtctatcattgttggacatttgggttggttccaggtctttgctattgtgaataatgccgcaataaacatacgtgtgcttgtgtctttacagcagcatgatttatagtcctttgggtatatacccagtaatgggatggctgggtcaaatggtatttctagttctagatccctgaggaatcgccacactgacttccacaatggttgtactggtttacaggccaccaacagtgtaaaagtgttcctgtttctccacagcctctccagcacctgttgtttcctgactttttaatgattgccattctaactgctgtgagatggtatctcattgtggttttgatttgcatttctctgatggccagtgatggtgagcattttttcatgtgtgttttggctgcataaatgtcttcttttgagaagtgtctgttcatgtccttcgcccactttttgatggggttctttgtttttgtcttgtaaatttgcttgagttgattgtagattctggatattagccctttgtcagatgaataggttgtgaaaattttctcccattttgtaggttgcctgttcactctgatggtagtttcttttgctgtgcagaagctctttaattagatcctatttgtcaattttggctttggttgctattgcttttggtgttttagacatgaagtccttgcccatgcctatgtcctgaatggtaatgcttaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctattccattgatctatatctctgttttggtaccagtaccatgctgttttggttactgtagccttgtagtatactttgaagtcaggtagtgtgatacctccagctttgttcttttggcttaggattgacttggcgatgtgggctcttttttggttccatatgaactttaaagtagctttttccaattctatgaagaaagacattggtagcttgatggggatggcattgaatctgtaaattaccttgggcagtatggccattttcacaatgttgattcttcctacgcatgagcatggaatgttcatccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgttgctggtgtataagaatgcttgtgatttttgtacattgattttgtatcctgagactttgctgaagttgcttatcagcttaaggagatgttgggctgagacaatggggttttctaggtatacagtcatgtcatctgcaaacacggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttattgaattttgtcaaaggcctgtctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattccgtttgccagtattttattgaggatttttgcatcaatgttcatcaaggatattggtctaaaattctcttttttggttgtgtctctgcccggctttcatatcaggatgatgctggcctcataaaatgagttagggaggattccctctttttctattgattggaatagtttcagaaggaatggtaccagttcctccttgtacctctgttagaattcggctgtgaagccatctgctcctggactctttttggttggtaagctattgattattgccacaatttcagctcctgttattggtctattaagagattcaacttcttcctagtttagtcttgggagagtgtatgtgtcgaggaacttatccatttcttctagattttctagtttatttgcatagagctgtttgtagtattctctgatggtagtttgtatttctgtgggatcggtggtgatatcccttttatcattttttattgcgtctatttgattcttctctctttttatctttattagtcttgctagcggtctatcaattttgttgatccgttcaaaaaaccagctcctggattcattaattttttgaagggtttttaatgtctctatttcctttagttgtgctctgattttggttatttcttgccttctgctagcttttgaatgtgtttgctcttgcttttctagttctcttaattgtgatgttagggtgtcaattttggatctttcctgctttatcttgtgggcatttagggctataaatttccctctacatgctgctttgaatgcatcccagagattctggtattttgtgtctttgttctcgttggtttcaaagaacatctttatttctgccttcagttcgttatgtacccagtagtcattcaggagcaggttgttcagtttccatgtagttgagtggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatttgtgggagtttaagtctctttgtaggtcactcaggacttgctttatgaatctgggtgctcctgtattgggtgcatatatatttaggatagttagctcttcttgttgaattgatccctttaccattatgtaatggccttctttgtgtcttttgatctttgttggttaaaagtctgttttatcagagactaggattgcaacccctgcttttttttgttttccatttgcttggtagatgttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaaggtaatattgttatgtgtgaatttgatcctgtcattatgttagctcgttattttgctcgttagttgatacagtttcttcctagtctcaatggtctttacattttggcaatggatggtacaggttgttcctttccatgtttagtgcttccttcaggagctcttttagggcaggcctgctggtcacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccaagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgcttgtttctttttattcttttttctctaaacttcccttctcgcttcatttcattcacttcatcttccatcactgataccctttcttccagttgatcgcatcagctcctgaggcttctgcattcttcacgtagttcttgagccttggttttcagctccatcagctcctttaagcacttctcagtattggttattctagttatacattcttctaaacttttttcaaagttttcaacttctttgcctttggtttgaatttcctcccgtagctcggaataatttgatcgtgtgaagccttctctcagctcgtcaaagtcattctccgtccaactttgttccgttgctcgtgaggaactgcgttcctttggaggaggagaggcactctgctttttagagtttccagtttttctgctctgttttttccccatctttgtggttttatctactttttgtctttgttgatggtgatgtacagatgggtttttggtgtggatgtcctttctgtttgttagttttccttctaacagacaggaccgtaagcttcaggtctgttggagtacccggccgtgtgaggtatcagtctgcccctgctggaggctgcctcccagttaggctgctcgggggtcaggggtcagggacccacttgaggaggcagtctgcctgttctcagatctccagctgcgtgctgggagaaccactgctctcttcaaagctgtcagacagggacatttaagtctgcagaggatactgctgtctttttgtttgtctgtgccctgcccccagaggtggagcctacagaggcaggcaggcctccttgagctgtggtgggctccacccagttcgagcttcccagctgctttgtttacctaagcaagcctgggcaatggcgggcgcccctcccccagcctcactgccgccttgcagtttgatctcagactgctgtgctagcaatcagccagactccgtgggcgtaggaccctccgaaccacgtgcgggatataatctcgtggtgcgccattttttaagcccgtcggaaaagcgcaggattcgggtgggagtgacccgattttccatgtgccgtctgtcacccttttctttgactaggagagggaactccctgaccccttgcacttcccgagtgaggcaatgcctcgccctgcttcggctctcacatggtgcgcgcacccacttacctgcgcccagtgtctggcactccctagtgagatgaacccggtacctcgactggaaatgcagaaatcacccatcttctgcgttgctcactctgggagctgtagaccggagctgttcctattcagccatcttggctcctcccc

SEQ ID NO: 1482 - DNA, 240039 bp, Homo sapiens
ttcctccctctcagggctgcgcgcccaggtctgcgccgcgctccgcctccagccgcgcgcagacttgcgcacgcgtcgtgagagcgaccgcctccgtctctcgctgggctcgctagggctgcgcgttgggccagcgggggcgccgcagctgaagccgccccggagccggtgaaccgaattacctcgagggaggggcgtggggaaggcggcgggaggaggagcgcacgggccggctgccgtgcccaccacggctgaggaacatggttttcgagtcggtggtcgtggacgtgttgaaccggttcttgggggactatgtggtggacttggacacgtcccagctctctctgggcatctggaaaggtaaggaggccgccgccgccgctccccggcctctcgtgcttcccggccgtctcgctgcccgagcggcgtcctgcgttctcggggcttcgagcaccttgctcgccgggtgcagccacctgccgccgcccgcctgtgggtcaagttacgtaaagccgggcggcagttccctggcctccgccctcgagttgtttatattttgggggaaaggagagggtcatgagtgcgggatgaaaaggtctatattttccgagcggagcggacttgccgtgggctccgtgggtctggcgttcaagtcccggcgaggggccgttctctacccctggccccgcacggtccggctttagccgcgcggggcgaggaggcgagacgacgccttcctgggctgggtcccatccctgtcctttgcccccctgggtttatgacgaaggccccagaaatcccccgcgtgttgcatgctgcctcgcacgtgaaggcagggcgctgtgaccggggacgcccgcttccttgcttccccagcctcaattcctggcttcacccgtggtgctttctgctctcccccttccggccctaggacccggacgccggctctctctcgcctgggttcggcggataacaaaaaggaaactcaagtgcaaagtaactcaaacagttgcttgtgtggttgcagttaacagcctgacctaggaatgtgtaacattttcaagactttaggatatgtgggtcagagtgaattgccgaattttaaagaaaaaccagggcgtgcggtgcaacgtctcagacctgcaaaagaccgggctgaacagggccctacgctgcctaggtggtgaaggaccgagctttccttgtgtccgtttagtgtggtattctgccttagtgagagcctcatttttagtgtttccatctgtttttgcattatgcgcttgtttattttaaacacccgctagaaattagactcctttgtgaaatgaatttcccaggccaaagtgagggttaattttgtgtgtgaagtgtgtgtgtttaaatatatatttaaagtaatttattcttgtctgtgcacacacttccagtcttcttctaaaatacttaccttgactcttctcgtttatgagataatgtaaacaggtagtttagtttgattttaaagaatgttactaccgtggggacctagtatcatgatggagagtgagtggactacaaaagctagggatatagtgatagctgctcagcctgtttgattagtacaagaaacttgcagtctgtttatgctgcttcttagttgcaaagtgaaaataaaatttgtctcccatgtacctcagaaggaagccttaagaatacttgaggtgaactttgatctgtagtggagtcttgcttccacattcagggtggaggtttgtctagagtgtgattaatcaacttatttatttgtttaaaatttacatgcagtaaaattcactcttgtgatacagttctgtcttgacaaatgctaagaggcatgtatgcaccaccacaataatggcacataaaaggttcatcaagcctcccgaattctctcagctgctcctttgcagttgatctcaccccgccaccacgcccggctaatttttagtagagagggggttttgcaatgttggccaggctggtctcaaactcctgacctcaagtaatccgcctgcctctgcctcccaaagtgctgggattacaggcgtgagccactgcgcccgcctgactgtaagtatttatctgtttgctggttgaagaatatttcagtttttggaggttataaataaagccgtcataaacattcacgtacgggtgtttgtgtgaacataattgttatttctcttggataaatacctaagagtggttttaaattgggttgtacgttttttttttttttttgagatttatttcatataccataaatttcactcttttaaaatgtacaattcagtgttttttagtatagtcacaaaattgtacaaccatcaccactctctcattccggaatatttcagcaccccaaaattaaatcgtatgtccattaggagtgactcccaatttcctcccttctcactactccacctctggcaaccactaatctttctgtctttatggatttggtaattctggacatttcatttaaatggaattatatgatatgtggccttttgtttctggcttctttaacctaatgtattttcaaggttcctccatgttgaaggatgtatgactatttcatttgctcttagggttgaataatattccattatattcatagaccacaatttatttatctatactcaccagttgctggatgtttagattattcctaaacatccaccttttggatattatgaataatgccactgaacattcatgtacaagtttttttgtggatgtatgttttaaattctcttggatatatacctagaagtggaattgctgggtcatatgctgactttgtgtaaccttttgaggaacagccaaactctttttccagagtgtttgttttcttatggttgagttttgagagttctttaaatattaaggatacaatttcttcatcagatatgtaatttgaaaatactttctcagtcttttcccattttgtcttttgcagagcatacatttttgattttgggaaaagcccagtttataaaacatttcttttatgaatcatggcttttggtattcatatctaagaaatcttttcccaacccaaagtcaaagatgttctcctgtgttttcttaaggaagttttgtagttttaggttttggatttctttttgtataaggtgtgtgatatgtgttgaaggttgaggttcatttgtttgcatgtggatgcaaatatccaattgtttagcaccacttgctaagaaagaggatcctttctctattgaattatctttgcatttcgtaaaaaaaaaatcagtagacttaatattgtgtggctttagtctgtctcaatctgtgtgtctatcatttcaccaatactacactgtcttgataactgtgtctttgtagttagtctagaaatcaggtaatgtgatccctctaactttagtctttaacaaataatttaaaaaataacaagtcattgtccaggtgtggtgctcattcctgtaatcccagcactttggaaggctgaggcgggaagattgcttgagcataggagtttgagattacagtgagctctgatcatgccactgcattccaacctaggcaacagacagcgagactctgtctcaaaataaaataaaataacatgtcagtgttttatttatagaaattggttatgttttgataaatgaaactttaaataatagctggagtatttttttaaaatattctttgagaatttcaaaagtagtaatttgataaatttggaggattttttaaaaacattgtttgaaaatttctgtaatagaaactaggtggccaggcatagtggctcatgcctgtaatcccagcactttgggagactggggagggtggatcacttcagaccagcctggccaatgtggtgaaacctcatctctacgaaaaaaataagatacaaaaattagctgggtactgtggcgctcgcctgtaatcccagctactcaggagactgaggcaggagaatcacttgaagctgggaggcataggttgcagtgagctgagatcacaccattgccctctagcctggccaacagagcgagaccctgcctcaaaaaaaaaaaaaaaaaaaaagaaactggatgctgcataggaaaattttaagataatattttatggtctaacgtgaaggacctattggtagttgtaaatgtgtgcttttgctaggcttctgaaataatccagcaaatttcaatattagcatgttactataatagtatcaattagtattcagtcattgctaataatggatggtgctctgaaaatttgttgctgagatggattctttggaaatcagaatgcatttttcccatggaagcattcttatatatgaatgaggacttttccaaaaacctgtttaactataatgcagcagaagagtgctactgtactgggttcaatacagtaagtagactcactgctagaagactctgtcttacaggggatgaaaaaggaattgagcttcattccaggactgactcttggcaaattttgatgttggtaaggtatactttttatacacttctatttataattctcccttcccatatatcatctagttagagaggtggtaatatttcatagactcatctgaaatttatcttcccaactttctccagcaattttctttttctttttcttttctttttgagacggagtctcgttctgtcacccgggtgggagtgcagtgacgcgatctcggctcactgcaacctctgtctcacggcctcaagtgagtctcctgcctcagcctcccgagtagctgggattaaaggtgcccaccatcatgcatggctaatttttgtatttttagtagggacggcatttcaccacgtcaaccaggctggtctcgaacgcctgacctcaagtgatccacctgccttggcctcccaaagtgctgggattacaggtgtgagccactgcgtccggccatttcacatattttctttaagagctaggctgcatcagaatcagccataggtgcttattatgaatacagaacctgcccccagagattataaattatttatctggagtaggacatgaaaatatttttttaaacaaatgacactggggacttgatgcacagttgggtacattttaagagaacattaaggggaaaagtattagaattttaaatagacaaaagcagtagtaaaagtggcttgtgtgatagaattatcatttgtaacacaggaagtacctgtacttcatagccccttcttaagttagcctcctttgtctctattttgttttctccgaaatcacaatacttggacaaatttgtaatttttttttgataatgcctgacatctttatgtaacattagaagttcagatttcttgtctattaactaacatacgtattctgtttttgaaatgttaatctcccagttttccctttataatagaatcatgtgtttagtggccacttagctggataccgccatgataccagaagcagtacaaaagatgaagattcagttaggatacagttttcgatttttaaggagtcattcttctgtgcccagaatacactagggagccaaacaaatgattcttacagtctggtgttaatgaccaattctaattccttatgtattatttttatatttatgttctaagatactttaataaaactttaaagactatgaaacattttattataaaaagtgttaggagattttacagtgcctctccatatacccattatctagattctgtcattaatattatgtattaacagctttattgacgtataattaacatgcagtaaaatacacgttaaagtctacaatttgataagttttagcatatatgtgcatgcaggtaacaatcatcacatgataatgaacatatctgtcatacctagaagtttccttgtgcctttttgtaaaccgtatcttctaaccctccttgtcccttatacccttcttgtccccaggtttttgctgatttgctttctgttactgcatattagcttgagttttctagacttggataaatgggattgtacagtttgtattctttcagtctggcttatttcagcataattattttgagattcatccatgtggtagtacaatcaataatttattcctttttattgctgaccatagcaagtggtggtgaggatgtgcaaaaactggaactctgttaatatgtctcctggggatgtaaaatgttaaacaacttgggaaaacagtttggcaatttcttaaaaagttaaacatacatcaaccatgttatcaagccattgtgcttctacatgtttacccaagagaaatgaaagcatatgttcatacaaagatttgcacacagatgtgcatagcagctttatttttaatagccccaaatgggaaacagtccaagtatccaccaacaggtgaatggataaacaaactggcatatccatataatggaataccattaatatttaaccacacatgttttgtcacatacctgtccatctgtccatctctctatccatgcagcaattcatattattaaatgtatttcagaataagttgtagagatgagctcatttcctcctaaatacttcagcatgtgtatcattagagtgcaatatttgcttagtttttttccttttgaggtaaaatttatgtagaagaaaatatacaaatcttaagtgtacattgactgagttttgacaaatacatacacacatgtaactcaaacccagtcaagatatagaacatgaccatcaccccagaaagtctttttcctgacctttcctaatttattcctaccctcatcttcagaggcaacaaatactctaatttttttctttctgtcatacatacacatctattctgctttgctgagagtgttttcttttccttcaagaatgttggagccaggcatgatggctcatgcctgtaattttagcactttgggaagctgaggtggccagatcagttgaggccaggagttcgagcccagcctggccaacatggtgagaccctgtctctactaaaaatacaaaaattagctgggtgtggtggcgggcacctgtagtcccagctacttgggaggctgagacacgagaatcgcttgaacatgggaggcggaggttgcagtgagccgagatcgtgctactgcactccagcctaggtgacagagcaagactccgtctcaaaaaaacaaaaacaaaagaatgctggattttgtcaaatgtttttttctgcatctattactattatcacaggatttttttcttttttaatctgttggtgtgatacattacattaattgatctttgaatgttgaactagccttgcatacctagaataaatcccatttggtcatgacgtgtatgtttagcactcagtatctccaggggtttagttccaagacctgtgcagataccaaagtccacaacagggagggcatggaagctccccaccaccttactttgctctgtccatctctttatctgtatcctttgtaatatcctttatgataaactgttaaatataagtatttccctgagttttgtgagttatcccagcaaattatcaaaccaaataaaatcaggtgcgaaccctgatttatagctggtcaatcagaagcacagatcacagcctgcgacttgtgactgacatctgaagtgaggggcagtcttatggaactgagcccttaccatgtgggatatgacattatctctttttttttttttgagacagagtctcgctctgtcgccaggctggagtgcggtggcgcaattttggctcactgcaacctccgcctcccgggttcaagtgattctcctgcctcagcctcccgagtagctgggactacaggcgcctgtcaccacaccaggctactttttgtatttttagtagagacggagtttcaccatgttgaccaggatggtcttgatctcttgaccttgtgatccacctgccttggcctcccaaagtgctgggattacaggcgtgagctactgcgcccggctcgatatgacaccctttctaggtagatagtgtcattatttaattgaattatagttagtgtctgttggagaattgtttagggattgggggaaaaacttcacatatctggttatctaagggttctgtgtcgaatatgagagtagagagaaaaacctttattttcctttgacagtgtcttatcatatttatagctgttttctgttttgttatacttgtttcctttttaaacagtcttcccctcctcttttgccctctctggttttaattgatcatgtgatatgatttaatttttttctcctgtcttagcataccaattatgcttcttaaacaatttatttaagtggttgtattacagtttgtgctgttcacttaaaactagtccaagtccacgtccaaataacattataggtcaggtatagtggctcacgcctgtaattccagcattttgggggactgaggctggcggatcatttaaggttaagagtacgagacctgcctggtcaacatggtgaaaccccatctctactagaaatacaaaaaatttgctgagcatggtaatgtgcgcctgtagtctcagctactcaggaggctgaggtatgagaatctcttgaactgggaggcagtgagccgagattgtgccacttcactctagcctgggcgacagtgcgaaactctgtctcaaaaaacacaaaaacaaaaatcccactatactacttcatggaaaatggaggtagtatatgtaatactctatcttacaatacagtatacagattcctcccttctgcccattgtaacattgttgtcattaatttcacttacctataagctgtaataatccaatgcattgctgctattagtattttagacatttttctattaatttaagaataaggaagaaaagacttaatttaccttcatctcttaattctctaatgctcctgtgaatctgagtttttggtttaaatcattttccttctttctgaagaactcctttatttatttgttttttttaatttttgagatggagtcctgctgtgttgcccagcctggagtgcagtggcgcagtctctgcttactgcaacctctgcctcctgggttcaagcgattctcctgcctcagcctcctaagtagctgggactacagatgcatgccaccatgcccagctaatttttgtatttttagtagaaatggggtttcactatgttgaccagaatggtcttgatctcttgacctagtaatctgcccgcctcggcctcccaaagtgctgggattacaggtgtgacccaccacacccggcctatcttaaccattttaagtgtacacttcatgtcattaagtacacttacattgtgcaaccatcaccaccattcatctcctgacttcaccattattcatctcctgaattcttcatcttgcaaaactgaaccacttacccgttaagcaatgactacccattccaccgtcttcccagaccccagtaaccgttattctacttttgatgtctgtaaattcgaatacttgaagtataagtggaattatacagtatttgccatttgttattggtttcttttacttggcataatgtcctcaaggtgcatccgtgttgtaggaaatgtcagcatttcaataatttttcaagctaaatagtatcccattgtatgtatatactgcattttgtttctccattcatctgttgatgaatagttgggcagcttccaccttttggctgttgtgaataatggtgttatgaatgtggatatttttctttgaagttcagtctgtgctgtcagatttttgggttacatacccagaagcagaattactggatcatatagtaattccattatcaatttttttgaggaattatcatactactttctatagtgactgcaccattttacattcctaccaacagtgtacaaaggtcaccatttctccacatcctcaccaacatttattttctctttttttgatagtagttatcctaatggatatgaggtggtatcttgtagttttcatttacatttctctaattagtaatgttgaacatcttttcatgggcttattgaccatttgtatatcttaattggagaaacatctatttaagtcctttgtccatcttttaatcaggttgtttgttttttgagttgtaagagtttacatacaaacatacacacacacacacacacacacacacaatgttagctgcttatcagatatatgatttgcaaatatttcccattttgtgtgttaccttttcttcctttttttccctgctaacttttattttaggttcatggggtacatgtgtgggtttgttgtgtgggttaattgtgtgtcactggggtttgatgtataaattattttgtcacccaggtagagagcatagtacccgatagatagttttttgatcctcaccctccccacaccctccaccctcaagtaggccttggtgtttgttgtttccttctttgtgtccatgtgtactggatagagtttgaatacatgtccccaccaagtctcatatttaattgtaatccccattgttggaggtggggactggtgggaggcagttgggtcataggggtggatctttcatggcttggtgctgtccttgcaatagttcttgcaagatctggttaagtgtgtggcacctccctatgcactccccctcttgctcctgctgtgaccatgtgatgttctggctccgcttttgccttctgccatgattgaaagcttcctgcgtcctccccagcagctgggcagatagatgctggtgccatgcttcctgtacagcttgcagaaccatgagccaattaaacctcttttctttgtaaattacccaggctcaggtatttctttatagcaacacaacaatggactaacacagtactcaagttttaactccgtcttgtgagaatatgcagtatttggttttctttttctgtgataactcgcttaggataatgctctccagtggcatccatgttgctgcaaagggcatgattttgctccttttcatggctgtgtggtagtccatggtgaacatatactgcattttctttatccagtccactgttgacagacatctatgttgattccatgtctttgctattgtgaagtggtgctgtgatgcacatacgcatgcatgtgtccttatggtaggacagtttatggtcctttgggtatatacccagtaatgggattgctggttctaatggtagttcttaattctttggtagttcttagttcttaaatctccagactgcattccaaagtggctgaactaatttacattcccaccagcagtgtgtaagtgttcccttttctctgcagcctcaccagcatctgttatttttgactttttaataatagccattctgactggtgtaggatcgtatctcactaatcattaatcctctaatgattagtgatgttgagttttttttttccatgtttcttggccgcatgtgtcttttgagaggtgtctgctcatgtccattgcccattttttaaatggggttgttagttttctgcttgtttgtttaagttccttatcgattctggataattagatctttgttggatgtatagcttgcaaatgttttctcccattttgtagattgtctgtttactctgtggacagtttcatttgctgtgcaagagctctttagtttaattaggtcccacttgccttttttttttttttttttgtagttctggaattttcatcatgaaatctttgtcagggcttatgtccagcatggtattccctaagttttcttctagggtttttatagttttaggttttacatttaagtctttaatctatcttgagttgattgttgtatatggtgaaaggtaggatccagtttcagtcttctgcatgtggctggccgttatctccacaccatttattgaatagggagtccttttcccattgcttgtcagttttgttaaaatcagatggttgtaggtgtctggctttatttctgggctcttgacctgttccattggtctacatgtctgtttttgtatcagtgccatgttgttttggttattgtagccttttagtataggttgaagtcaggtagtgtgatgcctcaggctttattcttttggtttagggttgctttggctattcaggctacttttttgggccagtatgaattttaaaatagttttttctaattctgtgagaaataacattggcagtttgataggaatagcattgaagctgtagattgctttgggcagtatggacattttaacaattttgattcttcctgtctatgagcatggaatgtttttccatttgtttgtgttgtctctgatttctttgagcagtgttttgcaattctcattgtagagatcttttacctctctgattagctctattcctaggcattttattctttttgtggcgattgtgaatgggattgaattcttgatttggctctcagcttggatgttattggtatatagaaatactactgatttttgtacattgattttgtatcctgaaagttggttgaagttattagttctaggaacctttgggcagagactatggagttttctaggtatagaatcataccgtctgcaaacagggatgatttgacttcctctcttcctatttggatgtcttttatttctttctctttcctgattgctctggctaagacttccagaactatgttgaataggagtaagtgggtatccttgtgttgtcctggttctcaaggggaatacttccagattttgctcattcagtgtgatgttagctgtgggtttttcatagatggctcttattatttccaggtatattcctttgatgcttagtcttttgagggtttttaacatgaagggatgttgaattttatcaaaagtcctgaatctgaaaagatgatcatgtggtttttgtttttagttctgtttagtaatgaatcacacttattgatttgtgtatattgaaccaactttgcataccaggaataaagtctacttgatcatggtagatgtgctgctggatttggtttaccattttgttgaagatttttgcatttatgttaatcagggatataggcctgaagtttcctgtttttgttatgtctctgccaggttttgttatcagaatgatgctggcttcataaaataaaatgagttagggaggagtccctccttctcaattttttggaatagtttcaataggattggtaccagctcttctttatatgtccggtagaatttggttatgaatccatctggtccagggctttttctggttggtagactttttatacaatttcagaactcattattgctctgttgaggtattcagtttcttccaggttcaatcttgggaggttgtatgtttccaggaattcatccatttcttgtagattttctagttagtgtgcatagagatgttcataatagcctctaaggattttttgtatttctctgggtcggtggtaatgtcccctttgccatttctaattgtgtttatttggatctcctctctctctttttttttctttgttagtctggctggcaatctatcttatttattctttcaaggaaccatcttttgtattttttttgttcagttcaactctaattttggttatttcttttctgtggctagctttggggttgatttgctcatttttctagttcctctaggcatgatgttagttgttaactttatatctttctaacattttgatgtgggcatttagcactataaactttcctcttaagactacattagctatgtcccagagattctggtatattgtatctttgttttcattagtttcaaataattcctttcttttcttttctttttcttcttcttttttttttttttttgagacaggttcttgccctgttgccgaggctgaagtggagtggcatgaacacggctcactgcagcctccaccttccaggctcaagcagtcctcccacctctcagcctcctgagtagctgggactgcaggtgtgcactcctacacctggctaattttttttgtattttttgtaaagacaatgtttcaccatgttggccaggctggtcttgaactcctgggctcaagtgatccccccacctaagccttgcaaagtactgggattacaggcatgagccaccgtgcctggcccaaagaatttctggatttcagtgaaattaagatttcgttgtttacccaaaagtcattcaggagtggtttaatttccatggaattgtatggttttgagagatcttcttggtattgttacctatttttattgcactgtcatcttgagaacatggttggtatgattgtgggatttttaatttgttgagaattgctttatggttgagcatgtggttggttttagatacgtgccatgtgcatatgagaataacgtatattctgtttttgttgggtgaggtgttctgtagaactctgttaggtccatttggtgaagtgttgactttaggtctgtctaatactgtcagtgggtttttgaagtctcccactattattgtgtggttgtgcaagtctctgtaggtctctgagagcttcttttttgaatctaggtgctccagtgttgggtatatacgtatttaggatagttaagtcttcttgttgaattcaaccttttattgttttgtaatgcccttctttgtcctttttgattgttgttggtttcaagtctgttttgtctgaaataagttacccatgcctgcccttttttgttttacttgcttgatagatctttctccattcctttactttgagcctatgggtggcattgcatatgaaatgggtctcataaagacaacatacaattggttcttggttcttcatatgaattgccattctgtgcctttgaagtgggatgtttagcctgtttacattcaagatgaatattgttatgtgctgatttcatcctgttatcgtgttgttagctggttggtatgcagacttgattgtatagttgctttatagagttagtggtctctgtacttaagtgtgtttctgtggtagccggtaatggtctttcatttccatggttagtactcccttaaggacctcttaaaaggcaagtctggtggtaatgagttcccttagcatttacttgtctgaaaatattttatttctgattcacttatgaagtttagtttggttagatatgaaattcttggttggaatttcttttctttaaggatgctgaattaggcccccaatttcttctggcttgtaggatttctgctgaaaggtctggtgctagcctgatgggattccctttgtagtagacctaccccttctctctagctccctttattatttttttctttcacattgaccttggagaatctgatgattatgtgtcttggggatggtcatcttgtatagtatcttgcaggggttctatgaatttcctgaatttgcatgtcaacctctctagctaggatggggaaatttttgtggacagtatcctcaaatatgtttccaagttgcttgttttctctccctctctttcagggacaacagtgagttgtagatttgatctcttcacataatctcatgtttttgggagatttttttccattgaaaagttatttttcctttatttttgtctgagttgatactgaagaaccagtcttcaagttcttgagattccctcctcagcttaatctgttctgctgttaatacttccagtgatattgtgaagttcttgtagtgagttttttagctctgtcagatcagtttggttgtttcttaaaatgactatttcatttttcagctcttgactcattttactggagtccttaaattccgtggattgggtttcaactttctcccgaatttcggtatcttctgagttttatgcccatcatttcagtgtgattaagaaccatcactaggctgggtacagtggctcacacctgtaatcccagcactttgggaggctgaggcgggcggatcacttgaggtcaggtgttcaagaccagcctggccaacatggtgaaaccctgtctctaattaaaatatagaaattagctgggtgtggtggtgggcacctgtaatcctagttacccaggaagctgaggcaggagaatcacttgaacccggaaggtggaggttgcagtgagccgagatcatgccactgcactccagcctgggcgacagggcaaaactctctcttcaaaaaaataaatatataaaataagaaccattgctggggagctactgcagtcattttaaggtaagaagacactcaggcttatagagttgctagaattcttgccctgattctttctcatctttgtgggctgatgttcctttaatctctccagttgctatcctttgaatgaggctttttgcttttatattcttggatgccccaagggtttgaccttgatataagttgagtttagtcgactggcatagtttcttgatgatttctgggtaccaaggctcagctcagcactcctggcatgcatgctataaccctggggtgttaggactaggcacatgactttgttctctgtctcctcgaggttaagcacccattgcactggtggggccaaggtgttcccggtctgctgggcaacaacactctgatggtggggccggcaaaagtgcttggttggggtggtgacagtagggtggtaaggcctgcatatacattggaaaagccgtcgggggaggctgtgggtgacggtgtcctggcaaaacagtgcggggaagctgtgcgtgggtggatgctggtggaggcccatgtgcaggtgctctctggtggttacctggggcttgccagcaaaggagctatagtggtggctgtcgggaagtgctgcggttgggcatcagcgtccattgcaattggatgtggccaggcagggactgtggaacaggcaaccagggatgggggttggggggggcgctcaaatctgacaagccctgtgccatgggcaagatagttctgttctgtctaggtccaatagtcagcaaagaccaaagctacctagaggtgtgtggtgagctttgggagatggacatacctggccatgctccactgcagccattcccacaccaggccttctgggctccgtgcagactggagtcctgtttctgccaacttcccaagcagctgtctttgcaacctcaaatgtctgtaggggtcatggagcctccttcagctaggattctagaggtccatgacaagaacaggctactccatgcctgtttaactcatcctttccccaggagcatttggggtcagaatgagtcatggtgctaggggagctccctgtaaggttcccagctttctcctccttcagcccaggatccgcatcctccttctgttcactctcagtgccttccttccaaagatctgctcagagtgtgctggtcttcttgatggcctggtctcttggtggtggaagctcttcctgactctgtgtctacttggccaccctgactcctctctgttgtctgttcactgtatatagtgtcatgtgaggaataaaagttttaacatttgacgaagtccaattcacctattttttttcttttgttgcctatgcttttggtgttatatccaagaaatcattgcaaaatgcagtgtcacagaactttctccctatgctttattctaagttttatagttttcagttttacatttagctcttggatccattttgagttaatttttgaatatggtataagcctgtcacacaggctggagtgcagtggcgcaatctcggctcactggaaactccgcttcccgggttcacgccattctgctgcctcagcctcccgagtagctggtactgcaggtgcccgccacaacacctggctaatttttttgtatttttagtagagaccgagtttcaccatgttagccaggatggtctccatctcctgacctcgtgatctgcctgcttcggcctcccaaagtgctgggattacaggcgtgagccaccttgcccaacctattgatctttttagaaaactaacagtcggtgtcccggtgcagtggctcacgcctgtaatcccagcgttctgggaggctgaggcgggtggatcacttgaggtcagcagttcgagaccagcttggccaacatgacaaaaccccgtctctactaaaaatacaaaaattagctgggcatggtggtgggcccctgtaatcccagctactcaggaggctgaggcaggagaatcacttgatcccaggaggcggaggttgcagtgagctgagatcgtgccactgcgctccagcctgggcgacacagcgagactccgtctcaaaaaagaaaaaaaaagaaaacgaatgctttatttttatttttattttttttccattctctttcacttatctttgctctgatctttattattttctcccttctgctaggtttgcattttgttttgtttttttccctatttccttaaggaataaatttaggtggtgatttgggatgtttcttctttttaaacataaacagttacagctttatgttccttctagcgctgcttttgctgtatcatactaattatgatggtacagtctttttattttcatctcgatattttctaatttttcttggggttacctttttgacccgtttcttatttaagagtgcttaattttcatatatttgttcattgttctgtttccatctgttatttccttatttattttatttatttattgttactagaaaagataccttgcataacgtcaatcttttataattttacaattttgtttttaattgacatgtattgtgcatatttattaggtacagggtgatgtttcaatacatgtatacattgtataaaaatcaaattggtatttagaatatccatcaccttatacattcatcatttccttgtggtgaggacattcaaaatctttcttctagctatgttaaaacatgcaatacagtattgttaaccatagtcactctgctgtgcaatagaacaccagaacttattcttcccatcttactgtaactttattctcattgaccaatctttacctatttcccctctcgccagtattccccagcctctggcaaccactattctatacactacttctatgagatgtcaacttttttagatttcacacgtgaaatcatgcagtatttgtctttctgtgcctggcttatttcccttagcattatgccttccaggtgcgtctgtgttgctgcaaaggacaagattatattgttttgttttgtttttttttttaaatggggaatagtatttcactgtgtatatatataccacattttctttagcagtgcatctgtttgtagacacttgatttcatatcttggcttttgtgaaaagtgctgcaataaacataaagtccaggtttctcttcaacaaactgatttcatttctttgggatatttatacattagtgggaatgatggatcatatggtaattttatttttaaattttttgaagaacttccatagtgtgttttataatggctgtactaatttatactcccaaaaacagtgtgtaagagtttccctttctccacagtcacaccagcatttatttttttgtctttttgatgatagccagtctaataggttgaggtaatatcttcttgtggttttgatttttatttatctgatgatgggtgatgctgagccttttctcatatatatacctgttgaccatttgtatgttttcttttctctttacaaaaattttgacacttgttttatgacctcacatatatcctggagaatgtcccatgtgcacctgagaaaaatgtgtattctgctgttggtgggtggagtgttctgtatgtgtcttttggtccagttggtcaatagtattaagtcctatatttccttattaatcttctgtgtggttgttctgtccattactgaaagtggggtattgaagccttctactgctaatgtagtgctatctgtttctctcctcaattctgtcagtgtttgcttcatatgttttgctggtctcatgtttggtgcatacatgtttataattgttacatctttttagtgaagtgtcggttttatcattatataatgcccttctttgttttttgtaacagattttgacttaaagtttatatgtctaatattagtataggttgaatatgccttatctgaaatgcttggaatcagaagtgatatggattttggattttttttttcttcagattttagaatacgtacatatacataatgagatatcttggagatgagacccaagtctaacacaaaattcatttatgtttcaaatataccttgtacacatagcccaaagataattttatacaatattttaaataattttctgcatgaaacaaagcttgtgtaccttcaaccatcagaaaggaaaggcgtcactgtctcagctgcccatgtggacaatctgtggttgtttggcatcatcgttattcttgactgaatttatatgctgatcagcaataattttctcacatttattcacacgtaagttgttaacagtaagacatatgaggtaccattaattcagtgaaaatacagtgtgttcagggtgagtaagcagcacagtagcatcactgggaatatatgtatccactgttaaacagcagcagcaacaaacagtggcaggcaggctctcagtctccacctacaatgctgtgttttgattaaaaggtaactgtagaatgtactgtatttatttattttttttttcaagtgagaagaaacattagaagcagttgaggggcccggaattggatcctcaggggatgaggaggcattttgctagatggcttttaaaaatgtttcctccagaaccatctgcctcactaactcttttttgtctgagaagtctctgattttataaactgtcataatttattgttctgttatgaatgcctgctgctccagtcctttaataagcccatcacacattttcaccatgtaccatgtggtctataggtacctttttgcattggtaacatcatcatctttatcttcatcatccacttgtggtattatgtctgcactcagaaagtttccgattttggagttttggattagtgatgcccaggtatctttgctcttttggttatttttgcatgggcttacttttttttaaatctttttgcttttgacctatgagtgtccttagagccaaagtgagtttcttgtagaccacgtacttttattttttttgtctctctctctttctctctatttatttattttgagatggagtctcactctgttgcccaggctggagtgcagtggcgtgatgtcggctcactgcaacctccgcctcctgggttcaagcaattctcctgccttagtctcccaagtagctgggattacaggcatgcaccatcacgaccggctaattttgtacttttagtagagatgggatttcaccattttggtcaggctggtctcgaactgctgacttcaggtgatccacctgcctcagcctctcgaagtgccaggattacaggcgtgaaccaccgctcccggctgggatcctgtttattttaatccattctgccaatctgtctttttgtaggagagttaagccatttatatttgaagtagttacagatagggaaggacttaatattgccattttgctaattactttctatgtgtcttacagcatttcttctttctgttttaccccttagtgcctttcctttggtttagttaattttttatagcaactttgattcattttgtgtttaattaactaataacataattaatattaacatcaagatagcaatgaggtctcgctgtgttgcccaggctggacttctaggcttgtgtgatcctcccacctcagcctcctcaagtagctgggactacgggtgcctgccaccatgcctggatgacttttgtgtatgttctaaaggtattttctttgtggttacgatggggttacatgtaacatcctaatgttatagcagtgtattttaaactttcattaatcccattacctgtatgttacagcttttgcaattgtcctatagttcttagacattctgttctattatttttctcattttctttttttattggctttgaattgggaagtttttatttacgtatcttggggcttactgattttgcattaaataattttttctcaatggtttattgcaagtatatttaaatgtagtttactttttgcatgttgatcttgtatcatgctactttgttagactcatttgtataattctgattaaaatgtttgtatatattaacattgagctacaattgcagaggtcaaaagatacaattagtgaagatttggtcaagcatactctgttagactatgtagaagaatgaaggtgagataataagattataggcagattatattatctgttatgcacattatttatatatttttcctgattatgacaggaatgaagcatacatattaactttttaaaatgaaaaatatttgattgtttgaatcttttttttaatcttttttaggagctgtggccctcaagaatcttcaaattaaagaaaatgccctggtaggttttgactatgaaaaatttgtaaagttattgcatttaattatgtataattcttcctgattcagtttgtcaccttaaattatttaaatttgagaaagttttttgtaaataatttttgcaaaatgtaaattttgctaaatggagttttaatctccctgaaagcacaaatggacagtgtgattttttttctatttaaaaatacatattgttttaggctgggcatggtggctcatgcctgtaatcccagcactttgggaggtcaaggcaggtggattatttgaggtcagtagttcgagactagcctggccaacatggtgaaaccccatctctactaaaaatgcaaaaagcttcgccaggcatggtggtggacgccagtaatcccagctgccagggaggatgaggcaggagaatcgcttgaacccaggaggtggaggctgtagtaaatggagatcgtgctactgcactccagcctgggtgacagagtgagactctgtctcaaaacaaaacaaaacaaaaacaaacatacaaaaaatacagatgtttttatttcaaatttttaacttgttttctgattttttttttaagacaggctcatgctgtgtcaccccaggctgcagtgcagtggtgtgatcatagcttactgtaggcctcagctcctaggctcaagctgtcttcccctttcagcctcctgagcagctgaaaagtttttaatctgataaagactagttcatttttttaattgcttgtgcttttattgtcatattcaagaagtctttaccgaatctaatgtcgtgaagattttcccttatgttttcttctaagagttgtatagttttagctcttaggtttagatcttagatccattttgaggtaatttttgtatatggtataggataagggttcagtttcatgtttttgcgagtggatatctagttttcctagcaccatttatttaaaaggctattctttgaatggggagaacgttttgaaagtttattttttacaaaacgcgtattttgcaaaatagagttttaatctccctaaaagcataaaatgacattgtaattgccacttctttttcttaaaataatataaaattggtaatgatttgatatgagtagattttctggtcatttttactgtagacctttatccccaattattattaaaagagcagcttccctggattttatggatttgatagtaatattgcagttatatgtttatatatttaaataaatgttgatgataaggaaatgtgtaagtttattaaaaaatcccttgaaataatttttggaagtaaagagtattcatttatgttgttaaactctatatctactaatgttttgtgtatatataaattttttctgtagagtcaactggatgtaccatttaaagttaaagttggtcacataggtaagccatattcattattgggatatcctccttcctggacatgcagccagaataatttgcctaatatatctattatgtgatatttttcatgtttctgagcatcaattaaaaataatcatgtgtttttgtctcagtagagctttgttgtgcaacttaaaaatattgtccgatacatatatcccttgcctagtatttgatatcctaatacattacatatctctttaggtggtaaattgagttaattcaaaggattacctctaagggagagcttaactgtttcagtttcctaggtttctgtctagttaccactgctatattttgattaacattggatatattgtgtaaagaataggttctgcatcatccaggccctgtgactaggggccgatttgaaaactaatttctgctctgcaagtttttgtatggtttcagaaaatactgtgctttttcttgtttggtattatttttaccagtgtttactgtttatatcttaaatatattggttgagcagtaaatgattggaatttgaggttttaacatctttaataaaaacttatctgtcatgtttcttgtgttacagttttactggtttaaatattgtgcaagataatagtgtctttagttgggacttggagatatttttgttatatagatagttttgtggtaggatgtatacattgttattgaagctatactgttgtcacttggggaacaaagtattctgaaaggttacctagattacatgataaaggtcttcataattatgtgtacttatggttggtattagaccacataccatagaaaactttcatcatcatatgttactgacagtagaattctatcctccccactcctaccttttaaagactgtttactgtaagagggggagaatgtcacccatttttatctacctaacattttaattttttcatatttctgattatttacatgtgtacattttaaatacttacaagtttatatgtattgaaatacttgtaattatgctatttttacagttttatattttttcattagcgtataaaaaggatttctcataatctgagttgatttgatctcatttattctgtaccataataatccagtgaatgcatatttggatattgtagaataattttatttttccattggtacagaagtattacaatacatatttttatataacttttaaacttttaccaaaggtcattgaattttacagtgatgattgtcgtatttcagtgtatgtaaatttaacctcaattcaagaacagtcaaaaaatatatcaggagagtagatagactattttctttagaatctgcccgccttctcttttcttgcctaatcttgtttaaaaatgataaggtaatttttagtgataatataagatagtagaaagtacactgaactaaacccaagataattttgagagtcatttaaggtgttgtgtacctctgtcgtagcacctgtcttttaaaaatatcactgttttttcccccttctagtagacatcgagtttcttgagaagaagtgggtttaatttttaatgtatcctcaccacttagcacattacttggtatatatagtaggggcacaatttattgtatgaaagtaatacatgtttccaaatgaatgatacagtagtacaatcagttttataggaatgtatgtccccttgctattattgggtattgatctttcaaaatttccctcgtttagaatgcagaattatagatatatcaaatataaatacacatgtacatattataaaagaggttgtcttctgtggaaggtttttggaattacatctgtgtatttttttgaaatttgccaaattttctactaggagtctacattttataagggaaggaagaaaaggtttgtttgtttgtttggtttttgagacagcatcttgctctgttgcccaggctggagtacagtggtgcgatcttggctcattgcaacctatgccttcctggctcaagtaaccctcccacctcagtccccgagtagctgggactacaggtgtacgccgccatgcctggctaatttttgtagtttttgtagagacagggttttgccatgttgcccaggcttgtcttgaactcctggactcaagggatcctcctaccacagccacccaaaatgctggggttacagatgtgagccactgcgcctggtcaagtttggattttttaaaaaaacatttgtggtgaaaatggcacactgttaatatgtgtttattatttttacagttttgtaattgctctttgtccttttgttcatttactttttttgaagtattactgtatgtattttaagcagtctgttggtacatttataaataaattaaccgtgtcaaatttgttacagttttttcacaatcttattatttcattttggttatatttttggtctgtacagaaatttgaaatgatccccatgttctctggtttaaaaacttagaaagttattcctcttttagaaatcagatagtttagaggccgggcagggtagctgatacctgtaatcccggtactttgggaggcagaggcaagaggattgcttgaggccaggagtttgagaccagcctgggcaaaatagtgagactgtgactctacaaaaaatataaaaaagaaatcagatagttcatttttctctgaagtgatattatatgatgaaatctttttctcagtttgaagttttctacacatggagtttataaaatatcatgagatggatctaagtggatttaaaaaaatttcccaatcactaaccagttttagcaacatagtatatttaataatctattccttacacaattatggcagctgtataaatctagacactcataccatttaaacaattctaaaatattttaaaactctctattacgaaaatattctcaagatacaaaactagagtgagtagtataagaaaccccatacatagtgtttttgtagttcaagaacccttacgcttaaaaaaaaaattctttgctgtttgattttcttaggatgttttcattagtttgcataattttcaaatattacccagaatattttattattactttatgtgtagttttcatatatatagtttatatgtatgattattaccatatgtgtatatgtgaattactatacatacatacatacgtatgtaacacacatatacataatgaaaaatatacatacacacacttatttaaagtatacaatctacctttcattgcggggaggtaaaggtctcactctgtcacccaggctggagggcagtagcatgatcatggctcactgtagtcctgacctcctgggctcaagatcctcccacctcagcctcccaggtagctgggactacaggcacatactgtcacgcctggctaatttttttagtttttattcatagagacagggttttgccatgttgcctaggctggtcttgaactcctgggttcaagcgatccacctgccttagcttcccaaagtgctaggattccaggtgttagccactgcgcctggcctaatctaccatcttaaagcattaaaaaatataggtttagagtaagaactggggaaattcaaagttatgatattaaggattgttgattaagggaagaagaacattgttttgtttatggtacagagaactgtaaatagaaacttgtatatttcgaatataatctaggttttccaacagtactgatataaatacaataatttcaaatcattacaacaaacacttgttgtttgtagttgtaaaatagctttcaataaagtgattaaacgcttaaggacaaaggccactttattatctcttcaatgcctgacagaaaatagactaaccataaatgcaggttgaaggagtaatattttttgtcctttttttttttcccaaaaaaatgtaggtaatcttaaacttataattccatggaaaaacctttatactcaacctgttgaagccgtattggaagaaatttatttacttatagtgccttcttctagtaagttaaatttaaaaaaattataatttaagttattcttttttatggatggaaaaatatttatattcaaaatacttttggaatttttttgagattttaatatttaaatttgatatttgttaattcaaattaaattggtttttactctacatttttggcaactttgaattatttattatttatttattattatttttttttaagatggagtctcgcactgtcacctgggctggagtgcagtggcaccatctcagctcactgcaacctctgcctcctgggttcaagcgattctcctgcctcagcctcctgagtagctgggattataggcgcctgccaccacgcccagctagcttttgtatctttagtagagatggggtttcaccgtgttggccaggctggtttcgaactcctgacctcatgattcgcccagcttggcctcccaaagtgctgggattacaggcatgagccaccgcgcccggccaattaatgattatttgtaaggatttttttggaatgactatatttaaatttaaggtagttatgattcttcctttttaatcttcctataggaataaaatatgatcctttaaaagaagagaaacaactcatggaagcaaagcaacaggaactgaaaagaatagaagaagcaaaacaaaaagtagttgatcaaggtaaagaaaacagtaaataacaatgctaataagagaagtagaaaagacctaaatatttatcataattgaatattatttttctctggagatgctgagattatttcagaaatatgatagaatctcattgcatggggaattttaatgtggtttgtatgctttgttatgtgtacaggaattttaccttatggaaatttatcttaaggcaaataatatgtctagcttattattattattaggtttacatattttttatatatatatatatacacacacacacatatacatactaggtaaggtcagtttttaatgatagcaattaattttatcaagcatattttcttaattttctagcctttgcttttgtattccttttatatcaattcttcacccttttggagatacttagtttcttgacatatttctatttgcctctatctgtttatttaccctctggcttcacatattttccaattaaacttagacaatatgttccattactgcaacctctttttcattattggaagcggtgtcctgaagaaatctaattccttttcacctgttctctgatccttactgccagctactttttaaactctcacctagtgggttttttgccttggcatgtaaatacgctgttctttatcttgaaacatgaagtcattttcttaacctagtcatctgtttatgttcttctcctctgtcattcatttaatagttaaacatcttaaaattaaaaagtttactgacttcactgtctctgaaatgcattgattttcttttaataaaaaataataagcttcaataatgttttacttgttggcaaacattaatagagatttaacatgtaattcttggcaatatctcttgtaattctgttttttctctgtaacagttactttatattatgtgtagtcatttatccttacctccagtcctctttcctaagtctcttaggccttttctttttaaaaattatttttattttatcaagataatatatatacatagctttaaaagttaagcagtattatagtgtccggattaaaaaaaaaaaccaactgttcctggcccaggcccgcacctatattactaaatatggtgctcaaacctctgtgtcttgatttatttagatattatatatatatatatatatatatatatatatatatatataaaacgtgttatatgtaacataacatgcatattatctataacataacatattttataacatataattaatgacattacatattttaaactcatctcgtgtttcattggcatatatatgacatatataatatataacgtgtaatatatatattacacacacatccttttatgatgtactatgaagattgaccctattttttcatcttctctatatagttctgtcacatttttggttaaatcagaattcattgttaatagtatcatggctatatataaatgttttatttatatataaataaagtggctttaagtatgactgtttattttgtaggcttttagttaacctccctgttctcccatgtacaaaatttggatcctattagggccattttctctaaaataaacccttgtgttctcactagggtgggaaagggatgttgcttggatattgggctgggagagaaggggacctaacttaactgctccttatacagatttaaatcagttcttgtgttatcttcctctctctccactgtgttccatgtttgctattttttgtttggtggggtttccagttcctgtgtctttccagggttctgtgacttggatttttgttgttgttgttgtttgttttaaactcatcttgtgttttgtttcattaccctgcaagatataggcattgatatgcttttcatgtaaaatggatagttggttttattcaggattggtactttattgacagtaatatgcaaaaaaagagcaaagggatttaaggtgttggtaaaataacatatcatggaatctgagctgcataaggaagtcaggaggaagtagtgggtagagaaagaaagacaacatttaatcgaatgactaaatgaatttataaaagaaaagattttattaggtagtggtgagagtcaaagattaaaatatgatcctctgtctttaaagagcttgtattctgttgtctacttaattctataatctatttatatgtatatatattcatttaactctggtgtatttgaggtacatatgattagtatcttcagctttcctttatctaaggcctcctgggccagctgaatttgagagtaataggcaattagaggaaaagatagatttatatgtattatttctatataggagtagaaatatgaaaagaggaacagaattagaaataaagaatatagctttcattggcatttttaaggggagaaaaaggataataactatgattatcaaaggcatatttcaaaaaaattaggaacctcaattctttattcttctttattcttggtttttctttttttttgagacaaagtctcactttgtctcccaggatggaatgcagtggtgtgatctcggctcactgcagcctccacctctctggttcaaacgattctcctgcctcagcctcccaagtagctgggactacaggcatggaccaccatacctgcctaatttttatatttttaatagagacggggtttcgccatagtggccaggttggtctaaaactcctgacctcagatgatctgcccaccttggcctcccagagtgctgggattacaggtgtgagccaccttgcccctccaattcttgattctttctatttctttggaaagtaatggaacttgagatagttaatgctgttttctgaacatgaaatagttgatgaacttctttcatccttgttcaaaagaagaaagaagatcttatttcctattttgtatttactgggggaggaggatattcaactgttttacacatctatacacaggcaacttaatggtggtatcactaattttgagagagatttctgctttgctgctgttagtggattttctcatttaagtctattgtaattcttacccaataatcttcatttttaaatatatttttgtactcaggcataggttaacagaaattataaaatttaatgccagtaaattctacatggtctgctttagtctcatggcacaataaactagcttttgaaaaatgtttacttgcttttgaaagacttttggaaagcaagctattagtgttctatttacatatatatgtatatttcagcaaggcaacgtaagcatgttacttcagtatgtggatatttatagagtatatttttcattcaattttaaaaaaggaatatttgcaattgtagaacaacatctgccggaaaaacaggacacttttgcagaaaaattagttacacagatcataaaaaatcttcaggtgaaaatttccagtatccatattcgttatgaagatgatgtaagtattttaatatgtgatatttgtttttatatttatatgtaagttattttactatttaatgacacctactttttaatggccaatctgttaaatcccaaaaggttacagagctaaagatgatgtgatccttcttttctataattatagttgtaatttgcagtccttagtgttgagtgcttgattttacactttcccaaaatgttcagacattagatcatgaaggaaatgccttgggaattatgaatttagcagttatgtatttttaaaatactttaaagtatgctatatttacctcctggatggagtactggtctagcaattagtggagctagccttaaataattccttgatcctgaataggtcatttgttttctcttaaccagataattatttgctttataatcctattttgttagtcttttttaataattttttttgtaaactggaaaacatgcagtataatattcctgtgtaacacgaatacattaataattagtattctaatttgttttaggaaaaatataggaatgaaagtttttctggaaagtaataaaatgtttctgaatgtttgaaataagttacttcccaaaaagttatccctccctcccttcctccccccacctccctctctctctctctctctctctctttctctttctctctttctttctcttctcctcttctctcccctcccctccccttgcctccccttcccaagacaaggcctcacactgtcgccaggctggagtgcagttgcccgatcatgactcattgcaaccttgacattccttgctcaagtgatcctcccacctcacccccacccacccaccctgcagtagctgggactacagttgcaccccaccaggcctggctaattttcttaacatttttttttgtagaggcaggatctcactgtgttacccaggctggtctccagagctcaagcagtcctcctgccttggccttccagagtgctgggattacagatgggagccgctgcacattgacagttttttctataaagtggattttatccaactactaaaaatctgaataaattttactttctttcctctttagatcacaaatcgggacaaaccgctgtcatttggtatttcccttcaaaatctgagcatgcaggtattttgtttataaaagaatcttaaccatatttaatgtgcaatatagtctattaaactgctactatttgtatatgccagcatcagaaataggtgtctatgtagaacgggtgcacaaagggtcttcattggattggaatcgagggtatgtagattcacatttcaaaaaatggttgaaaatcaaattcagaaatatgaggtcctattattattggtaattatgatgttagatgcttttgcttactttaagaaatccatttccaagtttgtaatgagtaagtaccaaatacaagtaataaatgttcatatctgaaacttcgataagccttgaaaaacaaaaatcttcagtttttctcaatatcattattaatattgtagcatagtgttttcctgtttaatttttgaaattgaggaattttaaaaatataagaacatgtagagaattttgaaacatatgcttgcctccagaatggatggctgttaaattaagagcctattaaaatagcctatttgcttaaagtcttaaatatttttataggaataagctgttttggataaagtttgaatcccttttgttttctacttccacccacccgtccttccccagagataagtatcctaaattttaaaacttttatataatatatctattaaaaatgtaggattataaaagtttacgcgttttatatgactcttttatgagttcctttttgcactttccagtgttgttgacatttatctgtgttaccacatgtaacaaaattcattcagtttaactgctgtgtatttcattgcatgattttatttgttgtatctattgggttttgtgtaagatttctttttaattttattattatttttaaattgggcagcctcccaagccagagcaggctcagagagactccacagtttctttttaaaatgtggccccactgcaacgaaaaaagaaaaaatgccctccaaaaagttactcaaatactctcattaagttgaaaaataagaatggagaattagccattggattgggcaatgtgaagatctttggtaaccgtgataacagtagttactaatcatcacctttggaaacttgtctgccagcctagacctgttcagttagaaactctaggatttggttgcagcaatctgtgttttacaaagccctctaggtcagggttcctgggccacagaacaggaggtaaggcctgggagtgagcattaccgcctgagctctgtcagatcagaggtggcattcgattctcgtaggatcctagcgaaccttattgtgaactgcgcatctcagggatctaggttgtgcccctgatggaaaagttatctcctatgaaactggtcgttggtgccaaaaaggttggggaccactgctctaggtgatcctaatgcatgctaaactttgagagctactattctaattatccattcagttcgtctccacatagaaacgaaaaccatctttctgaaataaagatctgatcactttattcctctcagtggcttttcattgctcttagttttatccttaaacaacttataaaccctttttaaaccgaccccaggcaatatacctggttttactttttttctctgtctgttttgcattatattctcctgcatactgagctacttcagttgcctgaatgtgccatatatttgtgtacttttgggctctgcctgttgtgaatcatattccctgtcgaccttagaatcaataatttttagttacatgttatatattaggttatatataacatctctttatccatcacacccctgaattggatgctcctgccatgccctctcaatgaaatgagagggcattttttttgtagagacaaggtctcactttttgttgcccaaatttgtctcaaactcctggcctcaagcaatcctcccaactcagccttccaaagtgttgggattacaggtgtgagccactgcacccaatgatacctgcaaatctaaatagctcctagaacattcttttataagttaaatgagttatgagttttagaagttaaatgagtatttaacttctgctgtggcacttacctgttggaagttgcctgtttctttgtttgcttttctgacccgcaatgagctccttccttgaaagcagacactttactgtggtcagttagtattttttgatggagtgatatgtctttaaaggcattttcatgaaagggacattggtctagggtatggtagataatgatttattactctgctgtttcaaatggaatgacctttttactgccattgttttttttccttttcagacaactgatcaatactgggttccatgtttacatgatgaaactgagaaactggttcgtaaggtaaataaatactgtgtttgtcaactcatggacttaagagaattttggaaagccaaatgataatatatagataaggatgtatgtgaattttgcttatttgtttaactctgtgatatggctcacttaattatttgagacttctgaaaatagtgtatgataaaaattcttcaaagaaaatgagacatctaataaattttattttcagttaatccgattggataacctgtttgcctattggaatgtgaagtctcagatgttttatcttagtgattatgataactccttggtaagtaaattttttctgtatgtatttgttggtatcatattttgcatgaggtttaattcattgtcatttatctaatatactgtagtcagtattttttcctaggcacaatctattagcagaatttacagatacaggtgaagatgtgtgtaactatacacaaacatgaatacatacccccatatctttttttttttttttttgagacaaggtcttgctctgttgcccaggctgaaatgcagtggcacgattatagctcactgcagcttctaactcttgggctcaagcaatcatccttcctgcctcagcctcttgagtagcgaggactataggcacacgccaccatgcccagctaatttttaaatttttttgtagagacaaggtctcactttttgttgcccaaatttgtctcaaactcctggcctcaagcaatcctcccaactcagccttccaaagtgttgggattacaggtgtgagccactgcacccaatgatacctgcaaatctaaatagctcctagaacattcttttataagattagtttggtgagatgttgtttaactactttaatattttgccatagctaagttctaagtttgaattggtttttaaaattgcttttaaacatttttcttttgcagataataggattttttaggataaagacatattggcatgaatatggctaggcgtggtggctcacacctgtaatcccagcactttgggaggccgaggcgggtggatcacttgaggtcaagagttcaagaccagcatagccaacatgttaaaaccctgtctctactaaaaatacaaaaattagccaggcacggtggggcacgtctgtaatcccagccactcgggaggctgaggcaggagaatcgcatgagtccatgagacaggggttgcagtgagctgagattgcaccactgccctccagcctgggtgacagggggagactccatctcaaaaaaagacatattggcatgaatataaataaaagcaatttgtcttttaataggacgacttgaagaatggcattgtcaatgaaaatattgttccagaaggttatgattttggtaagtacattttataagataaaaaaagtagttaaagtaattggtataaattttaaattagcattgttgctatcactgtgctagttcctgttaaatttccttctatatagttaaatgtatttataatgtatatacaaaagcaaataatattatattttttagtaacgtattttattgttatgaagcttttgactatatttcaaaactataggggaaaatgtccaacaaaagatgttaataaattatgataaacctctaaggattattcagtaacaattagggtaatatttatgaagacatttcaaaatggcaagtaaaatttaataaggctagctagtacagcctttttcgaaatagtaagatcacgctgcatttaaaatttttttaatttatacttttctatgttttcctaattttccaaaatgagcatccattacttttacaatcggaaatgaattactaaaacagaaagaaaaaaatcagtgctgtttctcagtttcccaagtagctgggactatgggcacacactgccacacctggctaatctctttcgtattttagtagagacggggtttcaccatgttgcccaggctggtctccaactcctgagttcaggcaatctgcccgcctcggccttccaaaatgctaggattacaggcatgagccacctgggaacctgggaggtagaggttgcaatgagccaagatcacgccactgcactccagcctgggtgacagagtgagactccgtctctacaaaaacaaacaaaaaaaagtgctgttttttctatgataagggcacttaataaaagttggtgatggataacttaattattgaatttgcatgcctgatgtcattaaccatagaatatccttcctgaaagtatttcctttcttggctcagtgatacttttctgtctatattatacaccttcatgactactcaagtgattcttctttttgtgcccactcttaaaataattatttttattggtttgaatttagtttcattttcttgattctcttctcataggaaatattcagaacagatgagttatctgtcatatgtgtttatgattttcaaatccataatcgtaaattcgacttatttctcctttgccctgaagtcatttttgttgtatcagagttcagtgaggagagagaaagtactgagtaatttgaagaggacaaatttaatataaagaattaccaactataagaggagactggagtaacaagggactgtctcataaaaatgctaaagatatagacagaagaaacatcccctaccctagggctaagacggggtgcccaaaagagagggtccccctccttcaggactgagttgtagaccttgttggaggacatagcgtggcttattgaatggcaggaaattatctgtggtgctgtgccagcaaaacctgttggtacttcactctctggaactttctggaaattacttttagggagcctcatggaggggtgtctctctgaatgcactccagtacaaaactgccttagcaaggtgctgggggaagttgctggcatctggctgcatctagctgccatgtactgcataaggccggtgctgaagaactccgtgctggaggaaccagacactgcagaagctaccggttctgtaggagctgggtgtgggagaagccgtgttcttgcaggagtctattgaatgaacatactggaaccaggcagcataactctttcctcctgcagtgtctctccagtgtcctctactgataaagcttaacattacgccagctggaaaaagaaaaaaaaattttttttctctacattctctgccttcaaaggaaacatatttaaagatccccaaatcatttttcagagcaggctatgaaggagaagtttggagctcagaagtaaaaaattgataactggcatacctgttggagagcgaagggggaatgaagggtttctttttgtttgtgtttatatttaatcagggagatgacagcttgtttttaggctgagatgggaatgatccagtagaacatgacaaattgacgatgcaggagaaacgggggacagtttctggattgatgtaggtgaaagagaatggtgtctagtacgcaagtgaagagctttgctgcatataggagcatagttaatttatatgatagagtttagttgtgagagaagtccttatactgagtagatgagtagatatggtgataagagttgatgtaaattctcttctgagctcttcaattaaaaaatatgtatctgaggtatgttagggttctctagagggacagaactaataggacaggtgtatatttaaagatgagtttattaaggagtattgactcacatgatcacaaggtgagatcccttaaataggccatctgcaagctgaggagcaaggaagccagtctgagtcccaaagctgaagaatttggagtttgagaagaagaatttgaatgtttgagggcaggaagcatccagcacaggagaaagatgtaggctcagaggctaagccactctggtctttccatgttcatctgcctgcttttattctggccatgctggcagctgattagattgtgcccacccagattgagggtgggtctgcccttcccagtccactgactcaaatgttaatcttctttggcaacaccatcagacacacccaggaacagaagttgcatctttcaatacaattgagttgacagtcaatattaaccattacatgagatgttggaggtttttggagggaaaagagggtatgaaataggaatgctaggggagtgagagagtgaaatgacgagggcagtattctcaaagtatggttcaaactagcaacatcatttagaaatgcagatttctagggcctttcccagacctcctgaataagaacctctggaggtgaagctcagcatttgatgtttttgtatttaattttttatttgtataaaattgtggagtacaatccttacatggatatattgcatagtagtgaagtctaggctttcagtgtttccatcacctgaataatgtacattgtccccattaagtaatttcttatcatccacccctctcccatttctctacctttctgagtctccagtgactgtcattccatgctctatgtccatatatacacattatttagctcccacttacaagtgagaacatgcagtatttgttgttctgtttctgcattgtttcacttaagataatggcctccagttccatccatgttgctgcaaaaaatgtgattttcttctttttttggctgaaaagtattccatgatgttcatgtaccacattgtccggttacctgttgatggacactttggttgataccatatctttgctattgtgaatagtgctgtggtaaacatacaagcgctttttttttcttttttttttttggatagaatggtttcttttctttcgggtagatacccagtaatggaattgctggattgaatagtagttctgtttttagttctttgtgaagtatccatactgttttccacagaggttgtactgatttacattcccaccaacagtaatcccttttctccacatcctcaccaacatgtgtcattttttgtctttttaataaaaaagacattatagttttaattttcatttctcggatgatgagtgatgttgagcagtttttcatacacatgttggccatttgcatatcttcttttgaaaaatatttatgttctttgcccacttttttttttttttttttggagacagagtcttgctctgtctcccgggctggagtgcagtggcgcaatcttggctcactgtaagctccacctcacgggttcatgccattctcctgtctcagactcccgagtagctgggactacaggcacctgccaccatgcccagctaattttttgtactttaaatacagatggggtttcactgtgttagccaggatggtctcaatcttctgacctcatgatctgcctgcctcggcctcccaaagtgctgggattacaggcgtgagccactgcacccagccctttgcccactttttaatggagttgagttttttgttgttgctgtttgagtttcttgtaaactctggatattagtcccctgtatgattgatggatagtttgcagatattttctcccattctacagtttgatattttaataatctctccaggtgattctaatgaatactaaagtttgagaaccactcagatagactagggttcaataaggttctcatactttgagaacattgccttttttttttttttttggaaagggacatgtagtaagttaaatattttacattttgcaggccatatacagttcctgacacattcctctttgtttcttttaaacaactctaaaagtgtatgaatcatctttggctcactggctatacaaaaataggctgtagcatggatttggatgattcctggactgaaggactgttgtgtaattgctcagcagcattaaggatgcacttgagatttatgacactaaagtgagacccagcagtatgtttttacccccggccgtgttcagctccttaggggcactgtggagttaagttggttactccacactgacgaagtgagaagttaaggagtctatgcaaaggaatgattaaaataactgatggtggaacttcagtaaggtggggatggactgaggatgtgaagcagaggtgaagggcagagaaaggttggaggatcagtgaattgtaggtccagggtagcttctgtcaccagccactaaatttatttatttcttctgcttttttttttcaatgtaagaagaaatacagaagaaagaacaagatctttaagcatttatttatattcaaatgaacatattcttgaatgtttaatgtttaagaaattaaatgttagtccatatcaatgattaaaataaaaggaatatatcatctttatatacagattagcttataatttaatgatggatctttgtctagattctgctattactggtcttcctctgaattgttcttattctttttggcaccaaacacaaagagttgagaggaatttatcttagattatgggttcagccaagcaggtaatccagagcaaactttcactcttcatctctctccttttaccaattaaaaggaagaacacagatggatctagagaaattgatcagaaattcagaaattataattatataatggaaaccagtgttaatcctcttagcatttctaatgttcattcattctgtaaaactgtgtacttgtattaaaactatttttttgattttttttttcttaaaatgtttctgcttttaagtatcatattggtattttgagggggagttcaatttgcctttattgtatttatggaagacagtgaattttaagtaggaaaaagataaagaatcttctccacacatggttcatctgactgaaccatggcagtgtgaacatctgggaactgtagaaggggtataaaataaatggaaatcagtgttttcaacttcatcactttattgccttgagactttggaaatataactcagttttttttccatttttattatttttcagtatttcgtcccatatctgctaatgccaaacttgtgatgaatcgccgatctgattttgacttttctgcccccaaaataaacttggaaattgagttacataacatagcaattgaatttaataaaccacaggtgattttctttaatataattttcaattgtgaattattgtttgataaaagcaaaactaagattttaaatgtttcactaaaattcatgatgttatatggtagcatttccctaaaaagtcagtaatgtaacttttatcttcagcaattgaacaaaaaaatgtgatacatttaagagctttaattttccattctttagtatttcagtattatggagcttcttgaatcagttgatatgatggcacaaaatctgccatataggaagttcaaacctgatgtgcctcttcaccaccatgccagagaatggtaaatgccttgatttttttttttttttagattttaaaaatacaacataaaaataaatttctcgacttcaagaataatctttaagatataccatttttaaggtctgatacaaaccataattgatttatagctagaaatatatgtagctgctttagcttattgagttaatgaaactgatttaagggattcttgctaacacagtttacaactcgagatgctcgaataccatagttttcatttactatggacgggtcagtatatttagaattattacaaaaacaaatcctggtttgttttcttgcattgtctctccccaacccccacctcagcttccctatcagatacactgaaccaatattattaaacctgtattttaaaagctaaaaatgttacggagtctatgcaggataatcccattttaaaactcaaaagtcttgttattccagtttttaagctattccctagtttctagaagttacaattactctttcagttgactatttcagttattattcagatgactaaatgttatttgccaattaatgccttaacagttcttgtgtagaactatatttaacaaaatggagtgattttgcttattttcacttaagaaagaggaaagattaatattgaatggattattaatgcaaatggagttgggtaaaaaggaagtactcagataatatatcattttcctaatctttgtattatagttatgtatgttgttagagtagaagcaatgtcagtaatgtttcatactgttgatttgagggtgttaaatgtttttctttttttaactaggtgggcttatgctatacatggcgttcttgaagtaaatgtttgccccaggttatggatgtggtcatggaagcatattagaaaacataggcaaaaagtgaagcaatataaagaactgtataaaaaaaagttaacaagtaagaagccacctggtgaacttctcgtgtctttggaggttagcatttaaaatgaaattgttgagtgttttatactacatagctccttattggtcttcagtgactgatactccctacctttcattccaatttttattgaccttttcatctcttttacttagacttttttgtgcttctgttcttaacttcagctgaataatacaagatttgttgaaattctccagtgagcttttgaaattcgagattattctcaatcggaaggaatttgggttcatgcaaatagtatgattatgtcatttttaacctcaaaagtctaaatagtgtttgctacattgattccaacttctctgtgttggtttcaaagccttttatgtgtcaccactacattttccctatgttacaatctgaccatgcactaatttaatgtttcctgtactctgtatatttaatgctcattcttttagccacgcctatgctcataaatgctacctgcctttatctctctacctactcaattctactcatccctgaagttctacttaagtcttagtgcttgcatgaatgtctctgaattttctgcttatacagagccctttttctcttaatttttgtggtatctctagtctctaccagtagttttacatttaattatctatcttgagatattatttttgtattaatcttgtcttttagcattatgacatatttcaagagggactcttttacaaattgatgaactatagcttagagagattaaggggagttagtctcttgaagttaatgtaaacattctgaatccagaatgaatttctaatttatagattagattgacttttacttttattttcaatgtgggagactttctgaagacctagggctgttaggaatgcctgggcttagagtctttgggggatgggttcaggttgtcttagtcttgaatcataacctgagtcctccaagtctggataggagaaccctgaataagttattctgaaataataatgggttgtagttacttctcttgggggaaacatagtttgatcatgaaattctcaaaagtaattatgggtatgtcaagatagctgtgatgaaagatttagctaatctcagcttatttcaatagctatgacaactatgaaaagtgttaagtattaaaaacaagttttaagtgtatctgggtctacttgaaatacaggcatacttcactttattgtgctttgcagacattgtgttttttacaaattgaaggtttgtggcaacactgtgtctagcaaatctgtcggcaccatttttccaatagcatttattcctgtctatgtgtcacattttggtaattcccacaatatttgaaactgtttcattattattatatctgttatgatgatctatgatcagtgatctttgctgttactgttgtaactgttttggggtgccacaaactgcatccatataagacagctgttaaattaagtttagactaaagctgcctccttacatattttaagtttggccaaaaggtttctttgtacgccataaactatagcttaaatggaagtataaacagactctagtctactcttgtgccaatcaccaagttttggccaatcacatgtggccagttgttcaaaccgtgttcaaataaggtgaacactaagctataaccaaaccagctgtttctgtacctcacttccattttctctatgtcagtttcctttttctgtccataaatcttccaccgtgtggctacaccagagtctctgagcctcttctggctctggaggctgcccaatttgcaaattgttcattgcttaattaaatcttttaaatgtacttcggctgaagtttttattctaacacagcaaacttaataaatgttgtgcgtgttctgactgttctgctgactggctgttttcctgactccctctgcttgggcctccttattccatgagataaaatattgaaattaggccgattaatagccctacaaaggcctctaagtgttcaaatataaggaagaatcatacgtctctcactttaaattgaaagttggaaataattaagcttagtgagaaaggcatgttgaaagcagagataggccaaaagctaggctgcttgtgcccaatggttagctgagtcctgaaggaaattgaaagtgctattccagggaacacatgaatgataagaaagtaaaacagcctgattactgatgtggagagtgttctagtggtctagatagatgaaatcagctacagcattcctctaagccttatccagtgcaaggccctaaacatattctcttcaatactataaagactgagagaggtgaggaagctgcagaagaaaagtttgaagatagcagagattggttcttgaagtttaagggaagaagctgtctctataacaaaagtataaggcaaagaagaaagtgctgatggagaagctgcagcaagtgatcctgaagatctagctaagatcattgatgaaggtggctatactaaacagattttcagtgtagatgtaacagccttttactgagagaggatgccatctgaactctcctagctagagtgaaaaagttaatatctggcctcaaagcttcaaaggacaggctgactctcttgctagatgctgacgtagctagtgatttcaggttgaagccagtgattctttgccattctgaaactcttagggcccttaagaatatgctaactctactctggctatgctctatacacggaacagcaaagcctggatgacaacatatctgtttacaacattttaaacccaagctcagacctactgctcagtaaaaaaagatttttttcaaaatattattgctaatagacaatgcacctagtcaccaaaagctctgatagagatatacaaagagatgaatgttgttttcatgcctgctaacaccacatctgttctgccacccatggattgaagagtaattttaactttcaagtcttattatttaagaagtacattttgtaagatgatagctgccttatgaagtaggcagctatcattcctctgatggatctgggcaaagtaaattgaaaaccctctggaaaggatttgccattctatatgccattaagaatatttgtgaatcatgggtggaggtcaaaatatgaacattgacaggtgtttggaagttgattccaaccctcatggaagaccttgagaggttcaagatttcagtggagaaagtcactgcagatgtggtggaaatacgaagagaactagaagtggagcctgaacatgtgactaaattgctacaatctcatgataaaactttaaccaatgaggagctgcttcttatagaagagcaaagaaagtggtttcttgagatgaaatatactcctggtgaagatgagaacattgttgaaatgacaattagaaatttacataaaattagttgataaagcagcactgctgtttgagaggattgacttcaattttgaaggaaattctgtaagtaaaatgctatcaaacagcgttgtacgctacagataaatcagttgtgaaaagaagagtcaattgatgtggcaaacttcagttaagagattgcaatagccaccccaaccttcagcaatcaccaccctgatgagtcagcagctatcaacatcgaggcaagatcctccatcagcaaaatattacaactcgttgatggctcagatgattgttagcattttttagcaatgaagtattttaaaattaaggtatttatgttgttttcttaagacaatgccattgcacccttaatagactataatgtagtaggaacataacttttatatgcactggaaaaccaaaacatttgtctgacacttgccatactgtggtgatctggaactgaatctgcagtatctctgaggtatgcctgtatcttaatgataacatacaggctgtacacataatatgaaggatttacgattatatatctttgtatagattttttttgagacagagtcttgctttgtcactcaggttggagtgcagtggcaccatgacccctcagacttaagctgtcctctcatctcagcctcttaagtagctcggactacaggcatgtgccaccatgcctagctaatttgtatatgttttgtagaggttttgcagtgttgcccaggctggtctggaactcctgagttcaagtgattcgcctgcctcagcctcccagagtgttggggttacaggcatgagccactgtgcttggccttgtaattatatttttagttgaaaatgtaactaatatgtttacccttatctgtagtttaaacccaaataaaatcattttaaacaatgcatgtacatattttaatatgtgtttataacttgaagagtttggaactctttatgcagaatatgtattatttcatttttcaaaaaattactctctaatttactaatttccatgctgatatatgttcaagcattgcttcccagaatttaacatatgtattatattgatgaatgttctgttgtttgcttcctattatatcttttctttagtgcagccatttgatagattatgtgcttaagttaattatgtaaagttatttttgtaaagttaacacatttttgtttatatttttcaggagttggaaaaaaccttggatgtctttaatataactatagctagacagacggcagaagttgaggtaattcttggcttttcaattagtaaaaataattctgaattccatatagatatgacagatgtgatattattaatcttatactgtaacatattgtttccaaaaagtggttcaatttgctttttagtattataagaaaattatttaatattttttggcacatccatttaaatcagacagatttctatgggaaaaaatctttctaaatatttgggcttttcaaatattcagttatgaaggtaaaagccaatttattttttttcaatcatcatttcttataagatggtggaaaaactatgtggtactcctaaattcttatgttcgactaatgttgcagtttctgtgttctgttattaatgtgtatattgtttacattcattttgctcaagaggataagttctcagaatgtcttgcttatatttgtttcagttgctaaataaaggataatgtgtcatttatttgaaaatttattcattttaggtaaagaaagctggatacaaaatttacaaagaaggagtaaaagatccagaggataataaagggtggtttagctggctatggtcttggtcagaacaaaatactaatgaacagcaaccagatgttcaacctgaaagtatgtccatttcattttacagcatagttaatcactgggtgtcaaaataaagttttgccattttttgcctaattaaagtaaatagacattgaaatatatttatttaattatatataaagttattacaaataaaactattaaaacattgaaaatgtgtattagtttaaaaataaaaaataatttaaaaatcatgctagtgcttacaaaaagagctttatgcccagagatttagtgaatgcatatagcacagtaataaataaataaaaattccaaagtgttctccattgtaaatttttattgaagttgtttcttggaaagatttttgatttttaactaacagcttaagagtatagctttggaggtttagagacttaggtatatgttttagatctatcacttattagcagtgtgtctctggcaagttatttaagtgcactaaacttcagttttatcatctataacatgggaggaaattacaatgttaatactacctactttttatactaaatgtgttgattagcacagtgctattgtctaatatagttagccgtttttgagctcttgcttaatacaaatattataaattaatgttgctaaacttacatatttagcaatttatattttggataattacttgtaaaattgccagccccattcaaacattcagtgtttataatttcttaagagcgttcaagaaagtaaatttcacattctgtttattaaaggcagatacattgtgttaattttattgtttttatttaagaacataaagcacttctttctgatttgtagctcttgaagaaatgttgacacctgaagaaaaagctttactctatgaagcaattggctatagtgaaacagcagttgatccaactttactaaaaacagtaagatgttttcttgccttataccttagaatatatttatttatttatttgtttagagacagggtctcactctgttgcccaggctggactgcagtggtgtgatctctgctgccagccttaacctggcctcaagcaatcctcccacctcagcctctcgaatagctggagccacaggcatgcaccctcatgctagctaatttttgtggttttttttttgttttttttttttgatagagatggggtttcgccatgttgctcaggctggttttgaacttctgagctcaagcaatccgcctgcctcgacttcccaaagtgctgggattataggcatgaaccactgctcctgaccttatgctttggaatttaatgttacatatgtccatttttaatcctttcaaaaatatatgttactgacttgttctgtgatcttttttctgggtctgtaattgcatttattttaatttctaaggtagggataaatattgtctctttttttggggtcaatgtgatgattcttgaagaaataaaatgtccttaaaatatttggtggtttttgaaatgaatgtactataagaatatttgttatgcttatatatatatatatgttttcattttattcttctgaatataccttagtttgaagccttgaagttttttgtccacttgaaaagtatgtctattgttctaagagaaaatcatcaaaaacctgagctggtagatattgtaatagaagaatttagcaccttaattgtgcaaagaccaggagcacaagcaataaagtaagtattaatttatctttttttatcatatatgaaaaaacttcactgtgttcttagacattaggtcacaatcttagtcttttgtaaagagcactatagtttcatatatccttttgtggtttcaggaaaaaggttttttttttaattgttaagataatacatgttcaatagaaaaccacattccagtgaaacatagggcattaaagaataatacaaaaatgatcagcaactacactacacaaaaagaaacagcattaacaatgtggtttttatctgagagtttttagttttattttttttaaagtagctttgagatgtaattcacataccctacaattcatttaaagtgtgtggttcattgatttttcacaactatattatatagtaatttcacattggtatatttacgaagctgtacaaccaccagcactgtattagtccattttcatgctgttaatgaagacttacccaagactgggaagaaaaagaggtttaattggaccaacagctccacatggctggggaggcctcagaattgtcaggggaggcgaaaggcacctcttccctggtggcagcaagagaaaatgaggaagatacaaaagcggaaacccctgctaaaaaccatcagatctcatgagacttattcactaccatgagaacagtatggggaagccacccccatgattcaaattatctcccaccaggtccctcccacaacacgtgggaattatgggagtacaattcaagatgagatttgggtcgggacacagagccaaaccttatcaactactatctaattctagaactttattttattttatttattttttttgagacagggtttcactctgttgcccaggctggagtatggtggtagggtcttggctcactgcagtctctgcttcctgggctcaggctaacctccagcttcagcctcctgagtagccgtgactacaggcgcgagccaccaacaccttgctaatttttagaatttttgtagagatggggtttcaccatgttgcccaggctggtctggagcttgttggctcaaagcagttcgccagcctcagcctcccgaagtgctggaattacaggtgtgagcctggctcattcgagaatatgttaacaactcccaaagaaaccctgtaatcattagcagtcactcccaagtgcccccttacccagcccctggcaacaactaatttactttctatttgaaaggatttgtccattttggacagttcatatgaatgtagtcatacaatatctggtcttttctgtttggcatttttcacttagcatgatgttttcaaggttcatcctgttgtagcatgaattagtacattcctttttattgcctagtaatctctattatggacgcatcacgttttgtttatccatttaactgttgaggatatttaggttgttccttctttttggctcttctgagtattgcagctatgagtattcatgagtaatattttgtttggaggtgggttttaattttcttgggtagacacctggggtggaattgctgtctcatatgctaatactatttaaccttttgaggaactaccagactgtttcccaaagcagcctcaccattttacatttccatgaacagtatatgatgtttccaatttcttcatatcttcatcaacacttgttattatctgttcttttgattacagccattctagtgagtatgaaatggtatctcactgtggttttgatttgcattttcctgatggctaaggattttgagctttttttctttgtgcttattggccatttcacgtgcatatcttctttggagaaatgtctattagattttttttcctattttatgttgggttgtctttttattatcgatttgcaagagttctttatatattcttgatacaaatctcttattagataaacaattttcagttattttctctcactgtgttttctttttatttttcttaatggtgaagtcaaatttatattttttttgctacacatgcttttcattataactcagaaatctttgcctactccagtggtacaaatatatactcctatatattcttataagaattttatgctatttcctcttatatgtagggttagaatccattttgagttaatgttagtgtgtggtgtgaggtgggggattcagcttcattctttttcatgagattattcagttgtcctagcaccatttgttgaaaaaactattttttcccattgaatgatcttggcaggcttgtcaaaatttataagttgatcataaatgtaaggatttctagactcttaattctaatcccattgttctatatgtctagccttatgccagtaccctactgtcttaattatggtggctttatagtagaacttgtaatcaggaagtatgactcttccagttttgtttttttgttttagctgtcctgatttccttaaacttctgtataaattttaagattatgttgtccatttatgcaaaaaaataagctcagatttgataaagattgtgttgaattttgtggatcaattttgggtgtactgaacaaattattcagcacaaattattcagctacttatctaaacaatattaagtcttccaatccatgcacattggatatcttttcatttatttagatttttaaaatttgaacaacgttttacagttttcagatacagtacacctcttaggttaaatttatttgcaagtattttattgtttttgatgatataaatggaattgttttcttaatttcattttggattattatgtgtatagaaatacaattgagttttgtatactgcacttgtaccctgcaaccttgatgaacttgtttcattagttcaatgagtttttttagttgattccttaggattttttatatacatgatcatataatctgcaaatatagttttacttcttccattccgatgtggatgccctttcttttgttttcttgcctaattgccccggctagaacctccagtagtattttaaatagagattatgagagtgggcttctcttcttgtttctgttcttcgaaggaagtgttcatcctttcaccattatgatgttagatgtgagttaggtgtggtctgcatcattttacaatcccaccagcaatgtacgtggattcatattttttccatatcattcccaacacttgttattttgtttttttattttaaattatagccatccttatgggtgtttagtatcatattgtggttttgatttgaattcccttaatgactaatgatgttcagcatcttttcatgtggatattggccctttgtataagttcattgggtcttttttttaattgagttatttttcatttgttgttgaggtgtaagaattcttttgtattctggatactaaactgtcaccggtacatgatttgcaaatatttccttctattctttattttgtgatttcacttcattgatactgtcctttggtgtacggaagtttttaattttgaagctcacttcatccggtcttatattttgttgttcatgcttttgatgtcttatctcagaaggttcacctaagccaaggttgtgaacgtctactccagtattttcttctaagagttttatacttctgtcgcttacatatacgtttatgacctgtattgagttaatttttgtaaatggcataaggaattggtacagctcatttcatttgcatgtggatatcccggtgtcccctcacacttgttgaagacactattctttcctcaatgaacactcctggtaccattgttgaaaatcaattagccatagatgtatgtatggctttatttttggactctcaattctatctcatttttattctagactttcactgtgattatcattataccaatatcgtactgttttgattactgcagatttttagtaagttttgaaattgggaagtgtcttccctattttgttctgctctttcaagaatgttttagctgttcaagggttgcttacaagaccttatgaatttgaggattcacttttccatttctggaaagtgtctctttgaaatttgatagggattgcattcagtatgtagattgcttttggtagtattgccataataacaatattaagtcttctgtgaacatgggatatctttccatttaaataaatgctaaatagatgctttttctgtttttatgaagagtttcagaaggattgttattaatccttctttaaatattttgtagaattcactagtgaagccatttggtccttgtattagtctgttcttatgctcctaataaagagatacctgagactgggtaatttataaaggagagaggtttaattgactcatagttcggtatggctggggtggcctcacaatcatggcagaaagcaaatgaggagcaaagtcatatcttatatggaggcaggcaagagagagcttgtgcaggggagctccctttataaaaccatcagacctcatgagacttattcactatcatgagaacagcactggaaaaacctaccctcttgatccagttacctcccatcaggtctctcccacgacatgggggaattatgggagctacaattcaagatgagatttgggtggggacacagccaaaccatatcagctgaattcttctttgttgagagtttttggttactgatttactccttactagttataggttttactataagtaagtttaaaaggttatagtaagttttactatactaaagtttatagtaaagttttactgatagtttataggtttataagtaggatctgtaggttacagtaaagtttactataggtttttaaggttatagaaaagttttacttcctattagttatctgattttctatttcttctcgaggcagtttttgtaatttatatatttctaggaatttgttcatttatctattttgttggtactgttttttgcagtactcttttgtagtactttttattcctctatggtgtgtcataatgcctccactttgatttctagttatagatatttgcatctttagtgttttttttcttattttaggtaaaggtttgttaaatatgttaaccttttcaaagtggcaactttgattttttttcattctctctggtgtttttgttttctgtatttcatttgtctccactctgacatgtattattttattcatactgtgagctttgggtttaatttgctcttctctttttagttctttaaagtgtaaagtgaggttattgatttgataatctttcttttttaatgtaggcatttgcaaacaaaaatttccctgtgagaactgctttggatacatcctgtatgttttgtaatattgtgtttgattcgcatccatttcaacgtattttctgatttctcttgtggttttttttttaacctgttgcttgtttaagagtgtttaatttccacataattgtgaatttttcagtttttcttctattgagttctaatttgattccattgtggttggagaagatgcttggtgtattattaaacttgttgagatttgctttgtgacctaacatttggtctatcctggagaatgttccatgtgcttgcacttgagaagaatgtattttgctgttgttgggtagagtagtccatatttgtctgttacatgtagttggtttataatgttgtttaggttctctgttactttattgttcctctgcctaaatattcctcatttaatggaagtgggagattgaaatttctaagtgttattgtgagctatttctccctttaattctgtcaaggtgtgattcatatattttgaggactttggtgtataaatgtttataattgttgtatctttgatgaattgagccttttaatcaaactataatgaccttttcttcttgtcacagttttctattgaaagatatttaagttaattaattaattattaatttagatacagggtcttgctttgccacccaggcttgagtgcagtggtgtagttatagcctcactgcagccttgaactcctgggctcaagtgatcttcccaccacagcctcctgagtagctggaattaaaggtgtgagccaccatacctggctaaagattattttatatgttagtataaccacccagctctctcttggttatgagttgcatgcagtatattttttcatcctttcactttcaacccatatgtgtctttggatgtaaaatgagtctcttttaggcagtatgcctatggtccctgacttaggctaagtatattaaatacatttttgacttggaatattttcgatgggtttattgggaaataattagtcataagttgaggagcatctgtattgttgtatcatgtttttttcatccattctgccagtctctatctttcctttgatgagtttaatttcatttacatttaacatgtttactggtaggcaagaagttctgccattttgctatttgtttattgtatgtcttataccttctgtaccctcagttcctcagtactgtcttcttagtgtttgttaattttttgggggatatatttttatttcttcctcatttctttttccaaacatattttagtcattttgttgagggctactatatagggattacaattaacagtccaaatttaagacagtcaaatttgaattgacactaacttaactttaatagtgtataaaaactctactcttatgcagctccattcttcatctttacgttatcattttcacaaattactgctttacatacttgtgttcattagtctaggtttatatttgtttttatgtgtttgtctttaaatcatagaggaattaaaaagaggagttaaaaaccaaaaatgcaatattactggctttcttatttgcttatgtagttacaattacaacagttctttatttatttgtatggctgcaaattactatctaatatcctgtcattgcagtctttaggacttcctttaacctttcttgtagggcaggtctactaatgacagacagactcagtttttgttcatctggaaatgtgttcatttttccttcattttagaaggatagttttgtcatatatagatttcttggttgacattttttttcatttagtgctttaagtacatgatcttgctgccttttggactgcatggtttctgaggagaaattagctgttaatctattacatatcttgttatgtgatgagttgcttctctcttgctgctttcaagattttccttgttttagcttttgacagttggattataatatgttgctgtgtgagtctctgagtttatcctaattggaggtctttgagcttcttggatgtataaatttgtgttctttatcaaatttgagaagtttttggccattatttctcccagtatttttaatgtctttttctttttctcatgtccttcggagagtcccgtagtgcatatgttgttccacttgatggtctcccactttaggcactgttcattgttcttcattattctttatgctccacagactcaataatttcagttgtcctgtattcaagtttgatgattctttctttgggctgcttagatcctctgtgaaacctctctgcagatggttcccaaatcatgattgttcagcttatgatttttttgattttagaatggtgcgaaagtgatccatatttagtagaaatcttactttgagtatccatacaacctttgtttttcacttttcagtacagtactgaataaattacataagctatttaacattttattgtaaaataggccttgtgttagatgatttttcccaacgtagactaatataactattctgagtacatttagggtaggctaggctaggctatgatgcttggtaggctaggtgtgtcaaatgcattttaaacttatgacatattcaacttacaatgattttattgggacataaccccattataagtcaaggaacatctgtagtgaagttttcatattggctgttgtacttttcaccttcaaaatttctgtttggttctttttaataatttctgtcgatttatattctgtgctcaaatgttattttcctggttttctttagtctttgagtgtaagcttatttaacatgatggcttagtgaacataatgctagtcttcccttttctgtgtaagctttgtacatttttgtttaaaacttgatgttttgagtggtataatgtggtaactgtggaaattagatgtcccccctctccatggttagttgttgttgattgttgaaggatgtagttttccatttgtttacctactgtagtgggtagaattgtatcatccaaaacattgtcaatttctaattcccagtacctgcaaatatagccttatttggaaatagcctttgcagatgtaatcaagttaaaatgagttcatgctgtattagtgtttgctctaattgaatgatgtgtgctcttcaaaggaaagagaaatttgaacacagactcagaaaataagacagactagagaagacaatttgcagacagacataaagaggagaatgccatgtgacgatatcttcttagctgcgcccatattaatgtagattttctgtaacgtggtgtggggattagaggtgggaaatgatcatagctcagatgccacaggctctccctgttcttatcaagttttagtagatttttttgtttgttttgagatggaatgccactctgtcgccaggctggagtgcagtggcacaatctcagctcactccacctcctgagttccagagattctcctgcctcaggctcccgagtagctgggattacaggcatgtaccaccacacccagctaatttttgtatttttagtaaagacagagtttcaccatgttggccaggatggtctcgatctcttgacctcgtgatccgcctgcctcagcctcccaaagtgctgggattacaggcgtgagccaccgagcccagcctagatttttttgaataaaagtttttctgtttgctgtatgcccttagattgatttccagagattttataattttcaccagttctttccctgtttggtttgctggggagaagagttgctgagctcctcacatagtcattctcgaagtcctgcctcatccttggtttttaaatgtttattaaattgttttatttttttgagacagagtctcactctgtcacccaagctggagggcagtggcatgatctcggctcactgcaacctccacctccctggttcaagcgattttcctgcctcagcctcccgagtagctgggactacaggctcatgcccccacacctggctaacttttgtatttttagttgagacagggtttcaccacgttggccagtttggtctcgaactcttgacctcaagttatccacctgtcttgacctcccaaaatgctgggattacgggtgtgagccacatgtctggcctttaaatgtttatttttatttttagaagaaaacatgtttatagacttgtgttaaatatgcaaaacttttcagttttacattaagcattgtagatttactgtcattttaattttagcttatcataacttttttacatataagtcaacacaaataggattctttgtgaattaatctatgtcaatttagaggaatcattgtatgtcttctttgatgggaatggactggagtcagaaatgcaaagtgaagttgtcttcattaattttttaaatcattttcaatttttaaaatccttcacaattttactgatcgctgacttttttcttttttttttaatgcagatttgaaactaaaatagattcatttcatattactggcttaccagataattcagaaaaaccccgcctcctgtcttcattggatgatgcaatgtcacttttccaaattacatttgagataaatccattagatgaaactgtttctcagaggtgtatcatagaagctgaacctttagaaatcatatatgatgcagtaagcatttttttaaattactaagttttaatataatttagtttgctttgagtttgtgttaatgatgtttattttaacagaggacagtgaatagtatagtggaattcttcagacctccaaaagaggtacatctagcacagctcactgcagcaactttgacaaaactggaagaatttcgcagtaagacagcaacaggtaaatgccaatattaatgttggtgaattaaatactgtatcctatattaaacttttatttatggtagaatgtttttagtaaagtttattttaaatttattatatttctagactggttttagtttaacagaaactaatttagtacttttatgtttaaaggcagataaaaccataatcattttttacactcagaaagttcatacctagtaaccacatttaagttagttgcaaaattttgcttaggatacttggacctctatttatgacaaaaactggcctctcgttttcctttcttagaatgcgttccagattttgatatatcagcctcagggaaaaaagttctatccttttttattctctaggagagtttgaataaggtcgggtacgatttcttccttaaatatttggcagagcttaatggtaaaaccacttggttttggagatttctttgtgggaaagtttaagattacagattgaactttttaattaaatagttgaccatagagattatctgtatgattttaatgctttgtaattggttgggacttgttttctagctcaatgtatgatattaaaaaaaatgttcctcatatgctgaaaaggctgtcttttcatatctatacctattcattaggtatggattgttaatcctttacttcaaattttttgtatccttactggattttttttttccccttttgtcaccttgttctaacagttattaagagaaatacatgaaaaatgcctcattatcaatgtagatttttctatttctaatagatctgtcagtttgtttaaaaaaataaatttggctgggcgcggtggctcacacctttgatcccagcactttgggaagccgaggcgggtggatcacctgaggtcagagtttgagaccagcctggccaacatggcaaaatcataatagagacggggttttaatagagaccaggtttcaccagcctggcgacagagcaacaccctgccacacacaccaaaagtaataataataaaaattaaaaaaaaaataaattttaagactgtcattaagtacatgcaggagtaaattatttttcctcctataaaccacatctttaatgctttaatttttttccctttgtacttttttattttattttatttttgatctgatgtcagtatgaagtacaaagtttcttttcgttagaatttacctggtatatattttttcttatatttttactttttccctgtgttttcagatgtgtcatgtcaacaacatgtaataggattttttccaatctagatttatggtccttattttttatttatatctactttttgcatttaattaatttatttaggcttatgtctaacatcctattttgtgcttttgaatttggttttccttgttttatttttcttgccttcctttggataaattctaggatacctttcttcccccttccctacaatctactattgggaagttaaatattctctatctctttttattttataaattacagtatacatttttgtaaaaatataaatttaatgaaaaattttatattctcctagtcattatatggactttagtactcttgaactttatataccatccccatatactattttttttacttaaaaatactttattgtactgtatgtatatagttcatggtagtttacaattacttgtgcatttactaccttctttgctcttcatttctcttatagcttacactttttatttgattttattttctttctgttggaagttcattttttttttttttcaacctctgcctcctgggttcaagcgattctcctgcctcagcctcccgagtagctgggattacaggcacccaccacaacgcctggctaatttttaaaaaaatttttaatagagatggggtttcactgtgttggccaggctggtctcaaactcctgacctcagatgatctatcctcctcgacctcccaaagtgctgggattacaggtgtgagccatcggacctggcctggaagttcatttgtaaacttcccttgtaaatattttctcttgtaagaatctgctggtggcaaatctgtggtttgtttttgttatgtttttgttttttttttttttttttgacagtgtcttgttctgtcagccaggctgggggtgcggtggcataatctcggctcgctgcaacctctgcctcccaggttcaagcaatttttttgcctcagccttctgagtagcttggattacaggggtatgccaccacacccagctaatttttgtatttttactagagatggggtttcaccatgttggccaggctggtctcgaacttctgtcctcaggtgatccatctcagcctcccaaagtgctgggattacaggcatgagccaccatgcccgttgcatattagcttgacatgatactactgtatgtagaattaaaggttgatgttcattttctccttaacacattgaagagggcattctgtctttaggttttcattactgatgttgagaattcaggtgtcagtgtgtctgctgtttttttttgtacattatctacccttttcttttacatataagaactttttatcttttgtattctgttgtcgcaatttggtgtatccagctatagatttgctttatatatcctttttgggattcactggatttcatgaatctgagtactgggatttttaatgagttctagaaaatctatctggaaaattcttagccactaactctttacatatattctcttctggaattctggctaaatgaattttagcctttcttactccatcttccattctccttaacttctgtatcctgctttctttccatctgtttcttctctgtgttacatgctgggtaatttcttctaatttatcttctcatttactgagtccttctgtagccatgcccaatgtggtatcaaatctcttcattaagtttaatttcagtgattatatttttccctttaggaattctgttttgttaaatttaaaatctgtgttgtcattcttttttggttttgtatttcccacggatatctttacacttgtcttttttttttttttcagagatcataagtacagtattttatattctgtctcaccagttaattctctctcttcagatagtccgttatatgaagacttttgtggttctgtttttcctatcttctgtcttttgtttttgttggtacttacttatggtaacgtgtgtctttttatgcttggtaatttttaattgtaatctgctcattttccttagaatattatttgggagaattctctgaagcctgagataagtgggccttcatttcgggaagatttatatttcttctgccaggtaccttgggtatgttggtggcatagctaaattaattgcttaagatgttctggactgccaaagaattcttgggctacatacctccttgaggaatatatcatacttatcattcacagaggtattacctttttctcctaatttttctcacagcctttgtttgcatccccctgtgagagtgttttagggagaggaaggttttacttcacaattattctttctttgagtgagtgtcctttaagatttcagatttgtgaggagaactcttgcaagactctccatctttgtcttctgtttcctgtgttctgagaggctgaaattatctttggagtaagatccaatttcattgtcaaagttttaaaattctggttttgttaagcctgggagtacacttctaattgaactcagaatttgtcccattttggtggctataaaacctggcatgaaattatgatttttctcttgccatttttattatattcactttatccttattggtagatatgagatatactatctgtcattttcctttgttctctttcctaagataaaataatttagatgagtcaagaaatcacattttgataagaccttcaggaaatgtctaactagttgtcttttgttaggcaatattataataggcatcttgattcattattaatttttcttttttcacagaaaagtgtgtgttatattcttcaaaatatatgtgtcttctctggcttttgctcatttttctctactatttttatatctgaatagttttaaattagattgtacatgaataccttacctctagaaactgtagggtttgcatttattcctgtattctttgttaaaatctgggaattccattcctagtttacattctgtatattggtatattatatactgagtagaaaccaaagcataagatcaggctacttctagtcagtttttcttgattgatagaaactcatagttaaatacaaattaatcatattggaaatccactatagacattcagattttgagattttttatctctaagatttatttacctcaacttttattacttaaaaaaattaccaaacagtaaatatccacaatataaagttcacatgttacagaaatatgttttagaaagtggaagtcttcagtattttaccttctgtacataataacctttaaaatttgaagtctgttcttccaactttgttttcttttctataccaatagtataaaaatgctaattctatgaaaaaaaatggaaagcttctatgataggtttttgcacttaatttttaaaatttaatatattttggattttttctagaaagttaaaatttacctatttgtgaagagactcatatatattataatgattctggttacttaggttctttccttccctcatattcctcctttcttccttttattttgttacattctcctctattaacatcctggtttctttcttgtattataggttgagtatcccttagcagaaatgtttgggatcagaaatgtttcagatttcagatttcttcggatattggaatatttgcattttacttacttgttgaacatccttaattgggaaataggaaattcagagtattctaagcagcattttctgtgaatatgatctttgaggatcatgttattgtggtgctgaaaaagttttagatcctggagcgttttgattttggattttcagattagggatgctcagcttgttattttccccttcctttctaagaactcaaggtctttcaggtctttttgttgtcaactatggcatgagcttacagagcctgctcaactagttatcctttgtctctggcaggaaaacagatgtggtcgtttgctaaaactcttctttcagagtacaaggttctctgataggatcatagtgaatcattttctttcagttatttcatttatttactcatttaaatatatatcaagagcctaatctatatgtcagacactatgctaggttttagggaacatagcaatgatcagaatggatgtagttcttgcctattgatagatgttatactcttatggataggacaaatataaaactaagagcaatatactggaaatttttgattaatgctgtatgggtccaatcaggaaagaaaaaccacacagtaattttgataggtatgtttaatgtaatgaattattaactgtaatgagggactgttttgttactccaaagagtaactttaaagaatgtaacaagaggccaagcgccatggctcatagttgtaatcccagaggttttggtggccgagcggggaggaacacttgaggtcaggagttggagaccagcctggacaacatagtgagaccttgtctctacaaaaaattacaaaattagtcaggtttggtgacgtgtacctatcgtcccagctacttggcaggctgagactggaggattgcttgagcccgggaggtcagggctgcagtgagctatgatagcaactcctacattccagcctaagtgacagagtgagatgctgtctccaaaaatacatatatttaagaagagtagttatgaggaatatagaactgagacagcgttccctaggaagaggtctctctcttccctgagaattgaaatccacactttgttgggagaaggaacctctgtgagtcattgaatggtagaaaagccattcttgtgtctttctggtaatctgctctctaaaactttctggaaatccatcctctgaggtaaaaaggaaaaatattcatggggcaatgtctcactgccctcgttctgctgtgaaaccacctgaggagggttctaggggcagaatactggcttttgagtgctgttatgtgcacattatgcattgtgttggagaaaggcacagtgttacaggatattgctaaatgagtgtactggaaccaggaagccagctcttttctcctgcagtgtctctcctgtgttctttatctatttcagtgctagttggcaaaggaaaatcatttaagcaactcagatctactttcacagagcagacaagtgggtgaatttggagctgagtgaggaaacaattctataatcagcccaaatgctgtgaaagaaatgagaatggatagatgccccaatttagtcttggtggtagtgtcagagaagatctctgaaaattcaacattaagatcagatatatatgtaggatccacactgctaaagggtataagaaagagccttcaaggtgatggtccactgtgaagagcttaacttagcaaacaattgggtgaatttggaagttgtagaaagctgaattggttctaatgtaatgagtgaggggagagtggagggatgttaaagatgcatactcttgattatgcaaatatgaaagtcatattaagcagttaggattttgttgtaagtgcaatggaaaataggggagagacccaatcaacctaaggtcaaaataaaatactccccactcccttccattaaaaacaacttagagaaatcattgtgtcctggtatcaagaaaggctttgttgaaactaaggcttgtggtaggacttccagggagtaccagaacttagatttgtagaagccagaatacttgaggaatccttagactagagatggaaatgaagatagagaaatgcttaacagatagtctctggagaatcttgaatgtcagattgacccttctggatgcttcttgttactttagtaaaatcatgccatctgtgtttgaatccaaatcatttggggaaaaagaatgaataactgtttgagtcaattctgctcttaagtttcaggctaattggatggtcttcagaatttttgatgatctgtcagtctgttttcaaacctctatctcacctcaccttccatcctcattttaagagatttcacttgaatttgcttcttacaggctatgggaaatgccagggttttttcttcctctctctactagagtcttgcttgggctacctgtgcaaggccgttggaatcccttaaagatgacacagttttgataacagtttctcatatttcaaggaagagctgtcccagatgtaatttattagtgttatttttataaagactactggaggcagcgtaatttgtgaagaaaagaggtttatttgtttcatggttctacaggctgtacaagaagcatgactccagcatctgcttttggtgagggtttcagaatgcttccactcatggcagaaagagttggggagcccacatgtgcagagattacatggcaagagaaaggaaggaggtgccaggctcttttaaacaacaagctctaactaaaagagcgagaactcactcattaccatgaggacaacatcaagccatttgtgaggactctgcccccatgacccagacaggtcttattagggtcccacctccagcattaaaaatcaggtgtcagcatgagttttggagggctaaaatcccaaactgtagcacaggcttaggttatttattttctattttaatttaaatagatatttaaaacagaaggtattttaattacttttaatttattcattttctttctgttggcttgtatatcaagctgattatgtgttggcacttgacacttgctcaatgtctgcttttaagctttataattgtatatgtattttatttgtaattttaagtacattaaaattgttgacatattctttaatttgaacatgtattctttaataataaattcttaactttaaaggttatattcaaatatactgacctgcctacattttgtgtgtgtgtgtgtgtgtgaaaaaatgtgcctttttgtttgagtgtcagatctttttaaactttttaagtcaaatatctttcatttactctaactgatttgatggctgctcatataattttttctttaagaaagggttcacatctcatagaaaataatttgtttagatttaaaagctgatgctgatactggacttagggacataaaatagatgaatttggtatactaatcacatgcaagtgaatgaattaaatttattagactaaaaaactccaagtgaatgaaggacctagggaatggaaaactctggtttgttgccttttctggtttgcatatgattttattgaagatgatttgataatccaggattttttatattctcagaataatattaagatcaagtgttattgttcagtatggtaaatgtagcttatgaagtttatgaattgagaagtatctatgtagattctaagagttgttgtgagtaaatattttatgccactgaaactttttttttggtctgtatcttcccaattttacccaaattgagtttataggttaaaaattttttttggaagaatcactccaattttgtactcagctatatttaaataggagtacatgcattggcaggtattttaaattttatattggaagtattttgctgaggtcattttaaaattaatactaattttacattaagattgttttatcagttcatatatttagtgattctgtatttctcgagtaatttgtgaaaagtattcatagaaaagatttacatttttccaggtctactgtatattattgaaacacagaaagttcttgatctcaaaattaatttgaaggcttcatatattattgtcccacaagatggaatttttagtcctacatcaaatctgcttcttttggaccttggtcatctaaaggtatatactaataatatttgatttatgatacagcatttggggtgtttctttgttttaaatgtattttgttttttaaacagtttgatttattgctttttttcctagatttgtggtagataagtaagatttgagaaatctccctttctgttaaataaagtgaagtctcaattaggtagttttcctacacttatgaaagcaaaatgaccaattaaactctgcagggcaggtttgaatctaagcttgattgactgattgattgattgattgattgactgattgatttgagacagagtctcactctgtcgcccaggctggaatacagtactgcgaccttggctcactgcaacctctgcctcctaggttcaagtgattctcaggcctcagcctcctgagtatctgggattacatgtgcccgccaccacgcccacctaatttttgtatttttagtagagacggaatttcactatgttgcagactggtctcgaatgcctgtactgaagtgatccacttgcattggcttccctaagtgctgggattactggcgtgagccaccgcgcctggcccgaatctaagatttatatttgtagtatttgagagttgtgcttgagaagcttatttctttctcaatttagacctattacttgattacttaaagtatatagaatgatagagaattgtggaaacaatcaaatacgtcttcatctttctgaaattttttgtgcataaaactatatatatattgacattttaatatttgtatttaataattctaaattgagaaatggccttcttctgtttacctaagtcatttccctttttttctttcttttttttttttgagacagagtctggctctgtggcccaggctggagtgcagtggcacgatctcggctcactgcaagctccgcctcctgggttcatgccattctcctgccccagcctcccgagtagctgggactccaggcccccgccaccacgcccggctaattttttttgtgatttttagtagagactgggtttcaccatgttagccaggatggtctcgatctcctgacctagtgatctgcccacctcggcctcccaaagtgctgggattacaggcgtgagccaccatgcctgaccctttttttctaattatatacttttttctttccaaattttcagtagagaatacatttttttggcggtattctagatctgtgctcttcactatagtacccacttcccagccacatggggttatttaaattaattagaattaaaattaattcagtttcttagtcatattagccacatttaagagtttaatagtcagaagtggctagtggctactgtattttttgtttttgtttttgagacatagtctcactctattgtccaggctggagtgcggtggcgtgatttcagctcactgcaacctctgcctcccgagttcaagtgattcttctgcctcagcctcccaagtagctgggatttcaggcgtgtgccatcaagcccagacagtttttgtatttttagtagagatggggtttcaccatgctggtcaggctggtcttgagcccctgacctcaagttatctgctggcattgacctcccaaagtgttgggattacaggtgtgagccaccgcgcctggcctgtatttgacagcattgatatagaacatttccattattgtagaagttctactggacagcgttgctgtaaatcattaaatgtagaggaatatctatcacaatttaaagaaccaagagaggtggataatattagaatgctttttctggccacttaacaaaaatacgtgcctgtccttgatactgacatcttcccttatcctatttttaaaaattctgcatttgttaattgtgtaaacgcccactgggtatatatttataataaaatttatacagcttattattcatatttgaattttattcagttgtttcaagggcagtgtggtataatagagcataaggttaggagtaaggatatctaattttgtgactttaggcaatttgcttaacctgttacctaaaatttattacttttcaaacagagataatctttttttgagtgtttacttcacatgagctatatagagggaaaaaaagttaaaaaatgtatgtgtacacacatgtatttttatgagtaagatctttatgtactattgtggagtcatctccaggatgtttaagtgaaaaaagtaatgcgcacagtatgccaataaaggagagatacaaatataacttgcctggagttgcataaatggcagagttggaactaaaattcagctatcctatttaattctggactcttttacttcttattgtacagccatgtcagtatttgtcatcatgccatagaaacattttataagctaaatttgtctcttgatcttgctcttaatcagaaggcctcttatcacatttaaaaaatttgtagacatattattcttcaggaccatcttggtttcttttaatgcaagtaaatgggaaatatatcctaatatgtaaaaatttactttatcgctctccttattattatatatctcatcgatgaggacctttctaatagccttattatgtatgcttacttgtgaatttatcctctcctattaacattttataagtctaaaaattaaacactttatacttacattttgaagtattttgcatagtctaaactattaaaattaacttgaaggtgacgagtaaaagtcgttctgaattaccagatgtgaaacaaggtgaggccaatcttaaagagataatggatagagcttatgattcatttgatattcaacttacaagtgtacagctgctttacagtagagttggtgagtataaaatgcattatttgttgattgattttgttgaagtgattaattaggtttttagacactttgaagaccttcctcttaaatgtgttagaacgtctatatttttgaattagaaatgatagtaaatattgtctagctgttcttaccaggagcagtcttgcccccccaagagacatttgtcaatatctggagacatctttggttgtcacaggtagagcatgagtggcactcctagcatctagtgggtaaaggtgagggatactactaagcatcctacgatgttcaggccagtccctcataataaatatcagtagtgctgaggtcgagaaatcctgatctgtaccaatgttttccagcctttgaccaaagttggcccatattgaaaatgatattggtattactacacagttggataaccagaagacattgctcagggccagaagtaagcagcctaggggctctgacagtcatggacagccatacaaagacgagggtcactctcctagacatacttgtatctcattcactgtggtataccagtcaggagtctgatttagagctagttttgaagatgaagtcaaagccagaaattcacttgccaagagccatttaagtagttagggagagaccccagactcgttcagctttcttttcgttctgtcatactgcttttgaatccctagagtgttagtgaacatgcagataattcagtaaaatttgatctgttgaagagatccatatgtagagatctaagtgtttgtatgcagtcagattttaattacctgagctaaccaataaaaggagaaacaatgagaatccaaagtagttgttatcaaaattgttaatttgtataggactgaaacattttatttcttcaattatatttgcttcaggatagtgaatgtagtttgtatttttatcatattctaattgtggtggaggaaacccaaaggtatagtgggtggcagaagtacgttattttcagaattccacaaattctttttcagggaataaattactgggtttggttttccttgactgggattttatctgactcatagaattattatgttcaaatgagatagtatatatgaaaatgcattatatgactgagatcccattaatcttgttatgaatttttaaagttatttctttctgattatacctatttcagaaaatctgaacaactgagaaaccaaaaagataaacctttatgttactgcttaggcaggaacactattgatattttgttgcacatccttttagtatgtttttcagtgtgtgtacctgtgaatatatgggatgtgcttgtttggtgtttatattggaggtatttgtgaatgtattttttttacatgatttatatagttttatatccaggtattttttcttttaccagtaatattttggtcacttgaactcatggtttttattgtctatattatgctatatggctatggtctcagttatttaaccattcccttatggaacatttaggctcgtaactctgcagtgattgttgccaatcaacaacatccaagtagacttggatgtgaatttcagttttatcactagcagattgatcataggcaaattataaattcttttgagtctcagttttctaaagtgggattattatacagaattttgagaattaacatttaaacattacctagaagagtagaaattataaatcttgaataaatggtagcttttattagttactgttaaagaacctcactttttactaccttttgcattattgctttactgccatgttacttttttgggtaaggtatgtggttggtgtagtgattgtcagtggatgcgcagtagatttgataacctactgattgtatgtacctgagaatgtgacattaagattacctagatgtggggaaatttcctcatataatggaatgtgtgactatgaagtattaatagttattttaggttttgtgtgttatagttacgttaaatatgaactattttctgtacttaggtgataattggagagaagcacgaaaactcagtgtatctacccagcatattttggtacccatgcacttcaatttggaactgtctaaggccatggttttcatggatgtaaggatgcccaagtatgtactgtttgtttcatgtgaatatggattttctgggtaattctgtagctagggaaataccatacttaactgactcttccttgtgtgtgtggtgaaatgtatataactgactcttccttgtgtgtgtggtaaaatgtatataaaatttaccattttgataatttttaagagtatagttcattgtcattaggttcacgcatgttgttatgcaaccatcaccaccattcatttccagaactgtttctcttccaaactgaaactctgtactcaattaaacaataacaccccatttcaccctgcacccagcccctgacaacaaccattatatcttctgtctttatgaatttgactattttaggtgcctcatataagtggaatcatagaaaatcagattttgtgtgcctgggtttcttcacttagcataatgtcttcaagattcatccatgttggagcatatgtcagaatttcatgtatttttaaggctgattaatattccttatatgttgtatatactatgtttttatttattcatccttcaatgaacatttgtgttgttaatgctgtttggctgttgtaataatgctgctgtgtacaaatatctgcttaagtccctgatttcagtatttttgggtgtatactcagaagtagaattgctggatcatattatagttcagtgtttaagttttagaggagtgctgtgctgttttttatagcagttacaccattttactttcctaccagcacaagagtttcaatttcttcactgcctctacaacacttggtattttctgtttttttattttaatagtcatcctaataggtgtgaagtgatgtcatttttctaatgcttagtgatgttgaacatctgttcttgtgtttgttgaccattcatgtatttatttggagaaatacatattcaagatctttgcccatcttttaatctggttatttatttttttctgtttttcgagatggagtctccctctgtcacccaggctggagtgcagtggcatgatcttggctcactgctacctccacctcctgggttcaagtgattctcctgcctcagcctcctgagtagctgggactacaagcgcatgccaccacgcccagctaattttttgggtttttggtagggatgggatttcaccgtgttagccagggtgggcttgatctcctgaccttgtgatccacccgcctcagcctcccaaagtgctgggattacaggcatgagctgccgcacccggctgagttgtgagagttttaaaatatattttggatattaactctttatcagatatatgatttgcaaatattttttctcactctgtgtttccttatcactctgttgattgtggcctttgatgtctaaaagtttaaaatttttattgtccagtttatcttagttgcctatgcttttggtgtcatatccaagaaattattacaaaatccaatgtcataaagcttttcttctttgtttaccttaaagagttttatagttttagcttcttttatttagatctttgatccattgagttaatttttgtatgtgacatataggataaggaccggcctttattcttttttttttttttttttttttttttgagacagagtctcgctgtcgcccaggctggagtgcagtggcatgatctcggctcactgcaggctccgccccccagggttcacaccattctcctgcctcagcctcccgagtagctgggactacaggcgcccgccaccacgcctggctaattttttgtatttttagtagagatggggtttcaccgtgccagccaggatggtcttgatctcctgacctcgtgatccgcccgcctcggcctcccaaagtgctgggattacaggcgtgagccactgctcccggccttattcttttgcatgcaaatatctcatttcctctatacaatttgttgaaaagactgtccttttctcattgaatggccttggtaccctagttgaaaatcatttatccatatatgcaagagcttatttttgggctttctgttttattccattggtctctatgtctttattttcctgtaccacactatttagattactgtagctttataggaagttttgaaatcaggagatgtgagttatttaactttgttctttcgattgtcttggctattcgggatcctttggtattccatatgaatcttagcatgttttcttttcttgtaaaaaatgttatagagattctaacaaagagtgtatcaaatctgtagatccctttgaatagtattgacatcttaataatattgactgttatagtccatgaacatggaatatctttctatttatttgtgtctttgatttcagcaacattttctaggtctcagtactaaagtctcttgcctcatttcttaagtttattctttgtgatgctattgtaaatgaatttaaaaattttggggggattgtttattgttagtatgtgggaacttaactgatttttatatcctgcaacttgtgaatttgtttacaattctaagttttaggattctaaagttctaacagatttaagattttccacatataagatcctatcatctgtgtatggagttaatttttttccctttctgatatgggtgccttttatttctctttcttgcctaattggtctgtctagaattttttagcactctcttgaatagaagtagtttaggttggcatcctcaccttaatcctgagcccagaggaaaagctttcagtatttcaccattgagtatgatgtcagctgtggggtttttatggatgacctttattatgttgaggtagtttccttctgttcctagtttgctaactttttattatgaaaacgtgttgaattttttcaaatcctttctgtgctttgagatgatcatgtgatcatgtaaaaaatgatcaagatgatttttttccttcattctgttaatggggtatgttaccttaattgctctctatatattaaatcatatttcttgagtccagcaaaaaatccttttattccaggaataaatcctcttattctaggaataaattccaagagtaaatgatatataaaccatgtaatgggctattgatttaggtttgcttgtgcttttgggttttgcattaatatttttcagatatattggactacagatttcttttcttctagtatctttgtctggctttggtatcagggtaatgctgtctttatagaatggattagaaagtattcctgcctcttcagtttttgattgtttggtagaattcactattgaagcgatcagatcgtgggaggttttctttattgggaggtttttgattactgattcagtctccatagtagtttatccagattttgtttcttcataattcagtgttggtagatttgtgtttcttggaatttgtttcatttaaggttatccatttgttggtgtaaaattgtttgtaattgtctctctcttaacagccctttttgttttgtaaaatgagtagtaatgttaccactttcatttctgatttaaattgagtcttttctgtttttttctcagtctaactaaaggttttcaatctcgatcattttgaagaaccaactcacatttttgttgatttttttctctattgtttttctatattttatttatttctgctttcatctttgttattttttttatttcgggtagctttaggtttagtttgctgttctttttctagttccttaaggtgtaaagttaggctattgattttaggtctttcttctttattaatgtaggtgtttacagctataaagtccgcttttggcagacttttgctgcatcctatgaattttggtatgttgtattttcattttcatttgtcttgagttattttctaatttcccttgtgatttctttgatctcattgcttgtttaaccatctgtttttaaatttctatacacttgtgacttctacactttttccttctactcttgcattctagactcatttcatcattattggaaaagatacttcttatgatttcacttttttaacattttttgacgcttggttttttacctgacgtataatctgtcctggagaatgtttcatatgcacttgagaaaaatgtctattttcctggatggagtgttctatatatgtcattttagtccagttggtcaattttattggtccagtcccctgtttccttattaatctactgcctggtgtttctattcagtattgacagtgagatattgaagtctcctattattatcaaggaactgtctgtttcttcttcttaattgtgtcagtgcttgctttatatatttttgaactctgatgtttggcacatatatgtttataattgttatgtcttcttggtgaagttatactttcattatcattatgtaatgtccttctttattgcttgtaacagtttttgatttgcagtctattttggctgtttttgttacaggcatccctgctctcttttggtgattatttgcatggaatgtctttcttcattttttttttcacttttaacctgtgtgttttctatgagttaacgtgatctcttgtagacagtatgtagttgcatcctgttttttaatccattttgtcacttgaagtttttaattgagaaaaaatatatttacatttaaagtaaatacagatggggaggacttacttttgtcatattgttatttgctttctgtatgtcttacagcttttttgatccctcatttcctcctttaatggtgccctttgtgttcagtggatttttgtgtgtgacatgctttgattcctctctcatttccagttttgtatattctacaagtattttctttgtggttaccatagagattgtgtataatatcctcaagttataacagtctatttatttattatttctttatttttttagacagggtcttgttctgtcacctaggctagagaacagtgttgtggttgtagctcactgcagcattgaactcctgtgctcaagtgatcctcctgccttgtcctcctgagtagctgggactacaggcacacgtcactacactcagctaatttttaaatttttttgtagagatgggtcttgctatgttgcccaggctataacagcctatttaagattgaggcaggttgcatagtcttatacctgtaatcccagcactttgagaggccgaggtggtaggattgcttgaggcaaggagtttgagaccagcctggccaatgtagtaagaccctgtctctacaataagtaaataaataattaaataaaattagctgggcataatggtgcatgcctatagtcctagctacttgggaagttaaggtgggaggatagcttgagcccaggaggttgaggctacggtgggttatgattatgtcactgcactccagcttgggtgacaaaaattttaaaaagtgaaaaataaaactgataccaagttagcttcaattgcatgcaaaaactctacttgtttcctgttttgccccctccagtttatcttattgatgtcccagattatatttttatgtattctatacccattaacaaagaattgtaattatttcttatgcatttgtcttttaacttatgtagaaaataaatagtagagttataaaccaaaattctaataacatttgctttatactcatccatgtatttacatttactgggattattatatttcattgttagctgaagctatgtgcctgagatcctaagtagagaagtctgttgaactagactgggccatttagattatttatttctaaatagttttagactgtaggtagtcatttaacttcttccttgtaacagcaccttttttctcccttacaaatattcagacctcaggcacagatctattttaaaatttaaccaaaggcttttctcatctaacatctaccaaacacttccaggagagttgctactagcaaggcaacatgagaaggcttcatgcctagttaaagtgtactaggaagaatagagggaattagagagactctggccttttcctatatggtacatggggtggacattgtttttaatacttattatacttaacatgtaaaagggagagacccacactcttttttgttgacctttacctcatagtgactctatctactaacaaatattgtccagggccctaaatcttactctcctagattttcttttcttagaaaatcaaagcatgcactgagagtcttgaggcagaggaatggctagaatttggtttaagagacagaaggaaagaaaaccatgctacgcattcccttgttttttttcaaatccagctttagatatggttcaatttaaagagaaaaggcttaattcttttcatttctcccaaattatgtctgctgcttgtttactcttttctactgtttcttgtaaagtttttcattctgtgataaagattaaagatctgtgcgatttcttgttgtaagcatatgactaagaattgattttttttagcatagtttaagtacttttcttcttggtaagtatgctataatcttggaagttacagggtaccagaaaaagtaggtgatatttctctgagggaagaaaagggcagcttttatcttggtttggacttgctctgtcagtatatgcttaggaagaatttatgtcttgtgatgcagggaatatgtacagcatagcaggaattaaaatagctgattataagggtacagggcagaaatgacaatgacttaacttagaaagatgaaatcttagaagttatttggtttctattttataatattgtgagcagtataaagtggatatgatatgtcaaatcctgaaactccacaggtgtcaggaacattcccttgaaagttgagctgcgttaagttgaaggcaaataaaaggatgcttgctatttggtagatactgttttggtacccagcatctttagactgcgcaacttgcagatttttcaagaaagtgaaaaaaagtttaagtgcattaagagaaccgattcataatgtttaacaaagttaaactactactacgcttgtgattaattacaaatatttaaggtattggaaataaaagaaagcttgtaattttctgtaggactccagtacatttttagaaagataacgtaagtaatcagtgtgcgtacgtggaaaaagtaatttttagggaaaatgcagggataaaaatggggagtgaaaactttctctctctctctctgatagtgaaaactaactttctgtctctctcaaaggagactgtcaaggcaattaaaagaataataaagcactctgatgtggttttgctcaatgatctttgatacatagtctcatgagcaggctatttgcactgccaaaccttagttttctcataggaagcatgtacatataggaacttaaatagagagcaaaaataggttgtctgcctcatagattgtgaggactgtttacaataatgcatgtaaagtgctttcctcagtgcctgtcacatgagaaacacttgattagtagtaattgtcaattgtatatagcaaacagtagaaggacattacatgaaataagaacataaacctctgaaaaataatgagtttagcccatctaatgaaactggttaatacggtaagacggaaattggaatagagatttttagtgtttaaaatcacatttgattcagataatttgagaacagtctttttaattagtgcacttaaatcagaataattcctttataattacttatttttatcttttcaaaacagattcaagatttatggaaagttacctcttatttctttacgaatctcagataaaaaactacaagggattatggaattgattgaaagcattccaaaacctgaaccagtaactgaagtatctgcccctgtcaaatcattccaggtaatgttactttcaaaattaatataagcatgaattaagaaagtccacaaatagtatttcaaacaatcacaggaattttatataagacaatttgcaatttgttttgaatagacattaagaaaattactttttttttttttttttttttttgagatggagtctcgctctgtcaccaggctggagtgcagtggcgtgatctctgctcactgcaagctccgcctcccaggctcacgccattctcctgcctcagcctcccgagtatctgggactacaggcgcccgccaccacgcccggctaattttttgtatttttagcagagacggggtttcaccgtgttagccaggatggtctcggtctcctggtcttgtgatctgcccgcctcggcctcccaaagtgctgggcttacagacgtgagccaccacgcccagccagaaaattacatgttgagagagaaattgaaatggtaaaaagtataaatagttaagaaagatataaaataataaatctacttttctaatttctgcagcctccaatccctctcctgagcaataacactgttaactactgcttctctagtttttaaaaaaatttttgtggcatatactagtacacacatgcacaagaacatgcatgtgtgtgtgtatgtagtatgtgtgtgtatacatacatgtatatattcattttttttttttgaaacagagcctatctctgtcacccaaggtggagtgcagtggcgcaatctcggctcactgcaacctctgtctcttgggttcaagcagttctctgcctcagcctcctgagtggctgggattacaggcgcccgccaccacgccagctaatttttttttgcatttttagtagagacagggtttcaccatcttggccaggctggtcttgaactcctgaccttgtgatccacccgcctcggccttccaaagtgctgggattacaggcgtgaaccaccgtgcccggcctgtattcttttatttttaaaattaaatgaaatcattatacacactattctgaatctgtattattttcaccattattatcatatatgccttagataaatttttatgttagcacatacagatctacctcatttgtttatggtgatatagtatttcattttctgcatataccatcttttgcttaatatatcttcttttgatggatattcacattatgagtgtttacagttatgaaaaatactgctttgaacttcctcatatatatacatatatatgtgtgtatatatatatttgcttatacttttattcataggataaattcctagaaatggaattgttgagtaaaagaggatgtgaattttaaattttgattattttgccaaaaaaaaaaaaatttttttttttttgggacgaagtctccctcttttgctcgggctggagtacagtggcacaaccttggctcactgcaacctccgtctcccaggttcaagcggttgtcccatctcagcctcccaagtagctgggactacaagtgcgtgccactacacttagctgatttttgtatttttagccgagatggagtttcaccatgttggccaggctggtcttaaaatcctgacctcaagtgatctgcctgcactgggctcccaagtactgggattacaggcgtgagccactgtgcccagcccagatttgcttaacttatagtttgctaacagtgaatgaatatctttctctgctttcattactgagtattagcaaatgttaaaattttattcgaagtgaaaaaaatgtcttctggttttgatatgcttttttaaataagtagaacatactttcctaagtttactattttaatttctgtttttggaaactgctgttcatgtcttttttctattgggttatggttgtctaattaaggaagtaacctgcttgtcatttaaaattactgttttttcctcattttattgtttggttgttttttatctcatatgtaaatttatttttgccaggcagaagcgttttattttttacatagtcaatttttttttccttcatgatttctggactttgtattatgtgacttttccctttccaagagaatttcagaaagaaaaaaaatatattcacatttccctccattttcgggggtaacagggggttctttactcatgtttaaatgcttttcttttgaagtagtttcaaacttgaaacattccaaaaatagtgtaaagaaggtttttttttattattatattttaagttctgggatacatgtgcagaacatgcaggtttgttacataggtatacacgtgccatggtggtttgctgcacccatcaacccgtcatctacattaggtatttctcctaaagctatccctcccctagcccccgacccctcgacaggccccagtgtgtgatgttcccctccctgtgttcatgtgttctccttgttcaactcccacttatgagtgagaacatgcagtgtttggttttatgttcctgtgttagtttgctgagaatgatggtttccagcttcatccatgtccttgcaaaggacatgaactcatccttttttatggctgcatagtagtctatggtatatatgtgcagcattttctttatccagtctatcattgatgggcatttgggttggttctaagtctttgctattgtgaacagtgctgcattgaacatacatgtgcatgtgtctttatagtaggatgatttataatcctttgggtatgtacccagtaatgggattgctgggtcaaatggtatttctggttctagatccttgaggaattgccacactgtcttccacaatgctggaactaatttacactcccaccagcagtgtaaaagtgttcctgttttgcaacatcatctctagcatctgttgtttcccaactttttttttttttttttgagacggagtctcgctttgtcgcccagcctggagtgcagtggtgcgatcttggctcactgcaagctccacctcctgggttcacgccattctcctgcctcagcctcccgagtagctgggactacaggtgctcaccaccacgcccagctaatttttttgtatttttagtagagatggggtttcaccattttagccaggatggtctcaatctcctgacctcgtgatctgcctgcctctgcctcccaaagtgctgggattacaggtgtgagccactgagcccggccccttttcccaactttttaatgaccgacattctaactggcatgagatggtatctcattgttgttttgatttgcatttctctaataaccagtgatgatgagctttttttcatatgtttgttggccgcataaatgtcttcttttgagaagtgtctgttcatatccttcgcctactttttgatggggttgttggtttcttacttgtaaatttttttcagttctttgtagattctggattttagtcctttgtcagatggatagattgcaaaaattttctcccattctttaggttgcctgctcactctgatgataatttcttttgctgtgcagaagctcattagtttaattagatcccatttgtcaattttggcttttgttgccattgcttttggtgttttagtcatttagtctttgcccattcctgtatcctgaatggtattgcctaggtttccttctagagtttttatggttttaggtcttacatttaagtctttaatccatcttgaattaatttttgcataaggtctaaggaagtggtccagtttcagttttctgcatatggctagccagttttcccaacaccatttattaaatagggaatctttcccccattgcttgtttttgtcagatttgtctttaaatagggaatctttcccccattgcttgtttttgtcagatttgtcaaagatcagatggttctagatgtgtggtgttatttctgaggcccctgttctgttccattggtctatatctctgttttggtaccagtaccattgctgttttggttaccgtaggcttgtagtatagtttgaagtcaggtagcgtgatgcctccagctttgttctttttgcttaggattgtcttggctatacgggctcttttttggttccatatgaactttaaagtagtttttttgaattctgtgaagaaagtcaatgataacttaatggggatagccttgaatctataaattaccttgggcagtatggccattttcacaatattgattcttcctatcagtgagcatggaatgtctttccatttgtttgtgtcctctcttatttctttgagcagtgttttgtagttctccttgaagaggtccttcacatcccttgtaagttggattcctaggttattttattctctttgaagcaattgtgaatgggagttcactgattatttggctctctgtttgtctattattggtgtataggaatgcttgtgatttttgcagattgattttgtatcctgagaccttgctgaagttgcttatgagcttaaggagattttgggctgaggcattggggttttctaaatatacagtcatgtcatctgcaaacagagacgatttgatttcctttcttcctatttgaataccctttatttctttctcttgcctgatttccctggccagaacttccaatactatgttgaataggagtggtgagagagggcattcttgtcttgtgccagttttcaaagggaatgcttccagtttttgcccattcagtatgatattgtttgttgctttgtcataaatagctgttagtattttgagatacattccatcaatacctagtttattgagagtttttagcatgaagggtgttgaattttatcgaaggccttttccgcatctattgaggtaatcgtgtggtttttgtcactggttcagtttatgtgatggattacgtttattgatttgcatatgttgaaccagccttgcatctcagagatgaagccaacttgattgtgatggataagctttttgatgtgctgctggatttggtttgccagtagtttattgaggattttcacattgacgttcatcagggatattagcctgaaattctcttttttgtgtgtgtctctgccatgttttggtagcaggatgaggctggcttcataaaatgagttagggagaagtccctctttttctattgtttgggatagtttcagaaggactggtaccacctcctctttgtgcctctggtagaattcggctttgaatctatctggtcgtgggctttttttggttgataggctattaattactgcctcaatttcggaacttgttattggtctattcagggattcgacttcttcctgatttagtcttgagagggtgtatgtgtccaggaatttatccatttcttctagatttttgtagtttatttgtgtagaggtgtttatagtattctctgatagtagtttgtagttctgtggaatcagtggtgatatcctctttagcattttttattgtgtctgtttgattcttctcttttctttattagtctggctagcagtctatgtattttgttaatcttttcaaaaaaccagcacctggattcactgatatttttgaagggtttttcgtgtctctatctccttcatttctgctctgatcttagttatttcttgtcttctgctaccttttgaatttgtttcctcttgctcttgcttctctggttctttaattgtgatgttagggtgttgattttagatctttcccgctttctcctgtggggattttagtgctataaattttcctctaaacactgctttagctgtgtcccagagattctggttgtgtctttgttctcattggtttcaaagaacttacttctgccttaatttcattatttacccagtagtcattcaggagcaggttgttcagtttccatgtagttgtgcggttttgagtgagtttcttaatcctgagttctaactggattgcactgtggtctgagagactgtttgttatgactgccattcttttgcatttgctgaagcttgttttaccttcaattatgtgatcaattttagaataaatgtgatgtggttctgagaagaatgtatattctgttgatttgggggtggagagttctgtagatgtctattaggtccacttggtccagagctgagttcaagttctgaatatccttgttagttttctgtcttcttgatctgtctaatattgacagtggggtgttaaagtctcctgctgttgttgtgtgggagtctaagtctctttgtaggtctcttaagaacttgctttattctttaagaatgttgaatattggcgcccactctcttctggcttgtagggtttctgcagagagctctgctgttagtctgatggtcttccctttgtgggtaacctgacgtttctctgtggctgcccttaacattttttctttcatttcaaccttggtgaatctgacgattatgtgtcttggggttgctcttattgaggaatgtcttagtagtgttctctgtatttcctgaatttgaatgttggcctatcttgctaggttggggaagttctcctggataatatcctgaagagtgttttccaacttggttctattgtccccgtcactttcaggtacaccagtcaaatgtaggtttggtctttgcacatagtcccatatttcttggaagctttgtttgttcgttttcattcttttttctctaatcttgtcttcatgctttatttcactaagttgatcttcaatctctgatatcctttcttccgcttgatcgatttggctattgatacttgtatatgcttcacgaagttctcatgctgtgttttcccactccatcaggtcatttatgttcttctctaaattggttattctagttagcatttcctctaaccttttttcaacactcttaggttcattgcattgggttagaacatactgctttagctcagaggagtttgttattacccaccttctgaagcctgtttctgtcaattctgcaaactcattctccatccagttttgttcccttgctggcaaggagttgtgatcctttggaggagaagaggcattctggtttttggaattttagcctttctgcactggtttttccctaatctttgtggatttatctaccttgagtctttgaagttggtgaccttcggatggggtttctgtgtggacgtcctttttgttgatgttcatgctgttcctttctgtatgttagttttccttctaacagtcagacccctttgctgcaggtctgctggagtttgttggaggtccactgcagaccctgtttccctgggtatcaccagcggaggctgcagaacagcaaagattgctgcctgttccttcctctggaagcttcgtcccagaggggcacatgccagatgccagccagagctctcctgtatgaggtgtctgtcgacccctgctgggaggtgtctcccagtcaggaggcatgggggtcagggccccacttgagaaggcagtctgtctcttagcagagtttgagtgctttgctgggagatccactgctctcttcagagccagcaagcaggaatgtttaagtctgctgaagctgcacccacagccgccccttcccccaggtgctccgtcccagggagatgggagttttatctataagcccctgactgggctgctacctttctttcagagatgccctgtccaaagtggaggagtctagagaggcagtctggctacagtggctttgctgagctgcagtgggctccgcccaatttgaacttccaggcaactttgtttacactgtgagggaaaagctgccttttcaagcctcagcagtggtgattcccgctccccccaccaagcatcccaggttgacttcagactgctgtgctggcagtaagaatttcaagccagtggatcttagcttgctgggctccatgggagtgggatccgctgagcaagactggcttcagccccctttccaagggagtgaaaggttcatcttgctggcattccaggtgccactggggtatgaaagaaagctccttcagctagcttgatgtttgcccaaatggttgcccagttttgttcttgaaaccctgggccctgttggtgtaggcacccgagggaatctcctggtctgccggttgcgaagactgtgggaaaagtgtagtatctgggctggagtgcaccgttcctcatggcacagtccttcagggcttcctttggctatgggagggagttccctgatccctttgtgcttccggggtgaggcaaagccccactctgcttcagctcgccctccgttggttgcatctactgtctaaccagtcccactgagatgagccgggtacctcagttggaaatgcggaaatcactggccttctgcattgatattgcctggagctgcaggttggagttgttcatattcagccatcttgccagccaccagtgtagagaagttttatccccagtctgttagagagtatgttactacctgggcgtggtggctcacatctgtaatcccagcacttagggagcccgaggcaggcagatcacttgaggttaggagttcgagaccagcctggccaacatggtggaaccccgtctgtactaaaaatataaaaattagccaggcatggtggtgggcatctgtaatcccaactgctcaggaggctgaggtaggagaatcacttgaactctggaggtggaggttgcagtgagccaagattgcgccactgcactccagcctgggcgacagagcgatactccatctcaaaaaaaaaaaaaaagaaagtgagttaatgtcccattactcctgaatactttagtgttttgttgtattcttttcctagtctgttggtgagtttttttgtttctttaattgtcttttggagggcaaaagtttaattttgatacaattgactttagcaatattttctctagatattgagctttttgtatcacatctctgcaatttttgcctaatttaaggtcaagaagatttttccctatgtttttttctagaaattttttagagttaggttttatacttaggtctctcatccatttaatttttctatatggtgcttgtgatgggatcctctttctagttttacatctgcacttagttatttccattttgtttgttaaaaagactattcttttactattgagttgactatatatgtgtaagtctatttcagactcttccagtgatttctgtgtctatcatttccatctgtttctgtccttttgttgatatcatactgtcttaattatactataacttcatgtcttgaaatccagaaaggttagtcctccaactttttgtatttccaaaatgttttcgactgattcctttgccttttagaatcaacttatcaatttccacaaaaattctggctgagatttggatagaaattgtatcattaatttgggagaattaacattttagcagtattgagtctttcagttcattaacatggtatatctctccatttgcttaggtctttttaagtttttaaaaattggttatttgtagcttaagcatccgtttgctaatatatgttgttaaatttgtacatagtgtatgggctgaattgtgcccttcaaaatttatatattgaaccctaattctgctatttcacattgtgactgtatttacagataggttctttacagcagtgattaagttaaaatgagaccactagggtgggcgctaatccagtttgactggtgtctttataagaaaaggaaatttggtctcacagagacaccagagatgcatgcacactgaggaaagcccatgtgaggacacagaaaggaggtcatctgcaagttaacgatagaggtggcctccagaactgtgagaacatagatttctgttgttaaagtcacccagtctatgctattttgttatggcagctctggcaatctcatatacgttttggtaccaagcagtgagttgttgcttaacaagcacttagaaatgttgaagtggctttagaactgggtaatgggcagagactggaagaattttgaggcacatgttagaaaaaaacctagattctatcgtttaataaattattgatataaaatatggacgttcaagctgtttctgttgagacctcaagtggaaatgaggaacatgttatttgacattgaagggaatgtggtccttgttataaagtggcaaagatcttggttaaattatgttctagtgatgaagttggatatttagctgtggagatttctaagtaaaatgttgaaggcatcgtcttatttctcattgcagctggtcaaatcacttgaggccaggagttcaagaccagcctggccaacacgatgaaatcccgtctctactaaaaatataaaaattagctgggtgtggtggtgcacacctgtagtcccagctactcagaaggctgtggcacaacaatcacttgaacctgggaggcggaggttgcagtgagccgagattgtgccactacactccagcctgggtgacagaaggagaatctgtctcaaaaacaaaaaaaaaattgtacaatatgtggttaatatgtgtttgatttattacaaagatgccagcctagctaagtgggggaaggatcaccttttcaacatatggttctgaaacaaccggatttccatgtggaaagtaaattaatttcaacccttatcttatatgcggaatttaacttgaagcatagacctaaatataaagtccacaagtgtaatttctggaacaaaaaatgtaggttaaaattttgaatccttgcagtaggtaaagataccttaggatataaaaagcgcaaatataacaggagaaaaaaataaataaattggactttataaaaattaaatttttctgctgtttggaagacattgttaaaaaaggtgaaaaggcaaaccatctaaccatccacttgggaaaaatagttgcaaaaatatttttacaagtccagacttgtatctagaatatatgagaagactaacagctcaataataaatgactaaacaggtagcatgaaaagatgttcgactttattactcaccagaaaaatgcaaatcaaagccacatagaaatactactacacaatggttagaatggctaaaaataagaagaatggcaataccatgtcaaggtgttgccatgacaaggatttaaaactctcatatgttacttgtgaaacttgaaaatagcataaccctttgtaatttagtttggtagtttttaaaaataaggttaagtatatacttaccatatgacttgggaattctactcctaggtttttacccaagagaaatgaagtcacatgcctaccaaaagacttgaactagaatactcacagtagggttattcataatagtaaaaagttgcataaaacccaattgtctatccagaagtgaatggataaggaaaaatagtatattcatacagtagactactactcaggaaaaaaaatactaatacatgtagcagtgatgggcagtgattgagtgtagggggagcttccctcaaaactccagggcattttagggaatagaacgcaggattacttggcaattcatttaagaacttaacaaaacttgtattctaaaacctaacaactacattataaaagaggaaaataatagcccagtttcactaataaatgtaagatacaaaaatttcaaaacattaaaagttgaaattaaggtaacatagttgttacttttgggaggatgcctaatgattgcaaggagcttaagggaggcttatgagttgcttgtaatgtttcatactggacctgggtggttggtaggttgagtgtgtttactttctgaaaatgtattgaactttagagtttatgtacttcgtgtagtagattataatgtgcttaaaaaaaatgctgctgctgcttccaaaatgagcagaatttcacagaatggcaaacacaaataaccaaggaagctatttgtgtttgatatgatatgtaaccgttatgcatttgtgaaattgtaattaaaactaggatgacatggccaatgagactgatataatttgaaatctttgaacaccctaagcattgtgaggatatggagagatagaaactgtgctgctggtgttagtgtaatgtcttatcaccacttttgaaaatggtttgatagtgctcaataaggtgaacatatataattttactgtttgggaaagttttatccacaagcacctatgggcatatcaaggatgtttatagtagtgctacaagcaaaagcaaaaatctataagcaacacagatactcaccaacagtatagtggacaaataagtagtggtttcttcatcagtgcaatacaatatcacagtaaaattcagttaactatcagtgtggttaaaatttaaacattgttttgtaaaggaagtcacaggaaaatgtatgtcatatatgctacagtttggaaagaggcaggggtaaacgatgcattatttagataatcattcataggtgctttagtacaaacaactaaataaaagcaagatcatgatgagaggtagggaacgtgacaaggaggaatgagatccgggaggaacacataagaagatgcttctaggtcaggatgtggtaatgttttattgcttggctgggttggaaaattcagatgtgtcttttattattatttttttaaactgcaaaatttgtttttatatatgctgtatttctccaaactgtaaaaaagtaaatttcctgaaatacctttcagagatcaaaaataaaagtaagttcctcaattctagaggctttaagtattgtgacttgtgtgttcctcacagatgtcctgatttaatactatgttgacttaaaatataagatctgtttctactcaaagcctgtcatcaaggacattattaaaacagttctacaatttttatttagccttaaaattgtaaaactacttctttaaaatctgcgttttataatgtatttttctaatttaaacctgattatcttctcagttaattcaaattggatagctttttgtcaaaactgttgtagaactttgaataaacattttttgaataagcggtgaataaacatttttgtgctaatcaacattgaattacttttctttcagattcaaacatctacttctttgggaacatcacagatttcacagaaaataattcctctcttggaacttccatctgtttctgaagatggtaaaatgaaactgcttaaggatatttttcttattttattaaaataatttctgttttgaggcatatttttctcaaaggaccacacagaggaaggaaaatatcttttccttttaaaatctaggttcttgactgaggctctatgaatggaagacagattaacatgagaaaacaagcagatttactagcattcatatttcatgggtacatgcaagaagctcaggaatgagtaactcaaggtggtgattaaaatttgggtttatataccagtttgggcttaaacaaaggaaaagaggttttgggcttcagggataggggttgctggggaggcaaggtatatgggaaggcgaccagaaaaagtatggtacacaagggtaaagtttgttacgcagatatgtcagtgttttctccgttgataagaatgtcttgggagtaagagtcatcttccctggtacagaaaggaagatacctttacaaggtagatttctcttataaatgttaatttcccttagaaaagggaaacttaggatctgtcttcagagcttttcctgtgtctgctgtttcttaaaataattgactcagtgtaatccttatgccaaaaagacatgttttcgagtggcgtattttggtcttctgtagtcatataagaaatttaaggcaatagcagatatttgtatattttcaggaaattttaactaaaatttattttaaatagcacaattccttaaagttgcttttgcaatgggatttttttggtataaagttgaacagaaaatgacaaggaccagccaggcgcagtggctcatgcctgtaatcccagcactttgggaggccaaggcgggcggatcatgaggtcaagagatcgagaccattctggccaacatggtgaaaccccacctctactaaaagtacaaaaattagctgggagtggtgctgcacacctgtagtcccggcgactcgggaagctgaggcaggagaatcgcctgaacccaggaggcggaggttgcagtgagcagagatcgtgccactgtgctccagcctggtgacagagcgagagtccgaatcaaaaaaaaaaaaaaaaaaaatgacagggaccactaataagttaattatctttatttggctgtgagttaaaaaacaccacaaaacttcacagatgtcttaatttctaatgtgttttttagttatttggaaaattttgctatagtatatttaaaacatttttaaaaatataattattaaaggaaaatcatcaataattatctacatttacatataaaaatatataactattctgataccaaatatgtgctttttaatgaccgtattagaaaaggtgtatgtctatatttttaagactttaaaaattgataaatgttaaataacagaaactgccatgtcgattcttggtttcttagagaacaatttttctttatttatagtcaccagagagaagttgtttgtgagatcatctactttaacttcagtcttagtttattagggatatacttctgattgtttcatttaaacctagttttaatggttttactaagttatctaatgctttttcagtcctttttaatatcagcatatgtgtatgctgatgtgtattacatatcaacgtatatgtacatatacctatatttgtgtatatatatgtatacaaagtagtgcttgatctcagtttacttcattcagactctgctgctaatattgcagagtttatacctaagtcctgttacactatccaggtagagtgagcatattaacatattactttgagtattcatggtgtgtataatcatcggcattggcatttcctgtaaaatttaagcaattttaaaatagactatttcaaaagatgggcttcttaagctaaagattacatcttaataatgttccatgcttctttataaccaagaatgttatttaaaagtagagtatccctttgtttaaaatggacaataaaaaagtacagtaatgtctatattattttctgtttatttcggttctcatgttaatatttgatatttaaaagagagccttagtgttttagtgttcatatttatttctattgaaatactgttaaattgatcattttaattattgacttaaataatgttctgtgaaatgtagattcagaggaggaattttttgatgcaccatgtagtcccttggaagaacctcttcagtttccaactggagttaaaagtattcgaaccagaaagttacaaaagcaggattgttcagtaaatatgactacatttaaaataagatttgaagtaccaaaggtaggtactacggtaaaattaacatggcttaatttgtttgctgtttctatatttacagcttactatatagtctcattgttaagaagcactatctttttcaccctaattaaagtaattccagacttgctgtgtgattcttggtcactccccgccccccccttttttttttaaataagattaacttccttaatcaagagtgaaggatttaaatttattcagtacatgtttttgtgaaaacgattatttatgttgtgtgtgtattgtatgtctgtgtgggtataaaatctctcctaaattttaaataataatatatcaattgtatgtatacctcatatattcacatgtaaccactatgcacataaacatgtttttgttttatgtagtggtaatttcttttttctttcttctccaggttttgatcgagttttatcaccttgttggagattgtgaactatctgtggtagaaattcttgttttaggattgggtgcagaaattgagattagaacatacgatttgaaagcaaatgcctttttgaaagagttctgcttaaaatgcccagaatacttgggtaagaatctctattttttaaaataaataaattaatttcattgtttgactacctgctagagagttttcaattctttaggctctgaatcagtacatttgctgaaatattctcagagaaccattcctttttgagttaatctttaacttttatagttggtaatgtggggggcacaccggagataaaatgaagataattttattcattatggaaaatcagatgataatggttgaattttaaatctacttaactgagtattggaacacttaattagttttctattgttgctataacaatttaccacaaacttagtgcttaaaaacaacacaaatttattatcttagagttctgtatgacagaagtctgacacaagtctcactgggcaaaactcaaggtgtcagtaggacttccttttaggaggctctagaggagggtccatttcattgttcagtcaggtgttgacaaaattcatttacacatggtttaagtctatgtttccttgttgcctgttagcggatggctgcccttaggcctcagttgcttttttgcacgtagctgctaaccacaataaggcatcagatcctcctcatgttgccatatctctaacctcctcttctgtgttttgcttccactcttaaaactccagtgattagattggacacacctctataattcaggataatatacctttaaccttaaccttaatcccattttccaaggcccttttgccatatgagttaacatattctcagattccgggggattagagcgtaggtatctttgttgggggcagagggcagtattctccttactgcaaaccttttgtgttcgtaatggatatatgatccctaagaaactattctgtttcctatgttaggtaattaggagggttgtatttatatttcttcatttacattttttggatttttccttgaaagataattgtgaatagtagaggcaattattaggacaccagtttcattttattaaactcctttgtagcataataatattatgtatgagcagaggtggaaataaaattttttaaatagactattttttagagcagttttagatcatgggacaattgagcagaaggtacagagatttcccatatactccttgtacccacacctgcatagcctttttcattatcaacatcctccactagagtggtacatttgttacaactgatgaacctacactgacacatcgtaattaccaagagtccacaatttacattaaggttcactgttgctgttataccttctgtttggacatgtataatgacatgcatctaccattaccttctcatgtggagtagtttcactgccctaaaaatcctctgtgctccacctatttgtccctccctcccacttaacccctggcaactggtgatccttttagtgtctccatagttttaccagcatgtcacataattggaatcatatatatccttttcagattggcttctttcacttagtaatatatgctgaagttacctccatgtcttttcataactgggcagcccatttcttttttagcaatgaatgatattctcttgtctggatgcaccacagtttatttatccattcatgtactgaaggatatcttggttgcttccacggtttggcaattgttaataaagctgctgtgaacatttgaatgcaagtttttgtgtagacataaattttcagtttcactgggtaaataccaaggaacatgattgctaaatcatcaagaaacagtttgctctagtaattggaaagaaaagtaaaccaacgtgacagtgttccctagtaacccaggaactttatagcagttactaagttttttttattattattagttttatttatttttattttttgagatggagtctcgctctgttgcccaggctggagtgcagtggcatgatctcggctcactgcaagctccacctcctgggttcatgccattctcctgcctcagcctcctgagtagctgggactacaggcgcccgccaccacgcccagctaatttttttttttttttttttttgtatttttagtagagacggggtttcaccatagtctcaatctcctgacctcgtgatccgcccgccttggcctcccaaagtgctgggattacaggcgtgagccaccgcgcctggccacacttattaagttttatgtttattcttatgtttgctttgccaagaacaaaggattaaaaaacccttgcaaacagaaaaaagagtatacaattattattgcgcttatttctgtaatatttttgtttctgttttctcagagggagtgaatagcagtttcttgcacaaagtaaatgatcagtaaatggttcaatgaatgaataaatgtgtaaacaaagtgggaacttttttaaggcttcaagtgtggctagcacttggagtagaaaacaggtttatgtgctaagcattaggtttggagaactctgtgcaatttgtggcatttttttctcaggaattgtaggattagtttgtagtcctttcttccagtctttagatactaattttctagcaaccgtaagtcatttggtgatgagagttttaaaagctttctataaattctcttctacactggttttcttagtatagcacattttgagcagaagcagtaatattaaaatgggagagttcctttattcccctcgcaggacatgccacaggggtgtgtatttccctagagggagcatgcagatgggcaggtgcagaggctgtggggagtgcttttgggctccggccccaggacagcatctaggggtaggtgtctacaacccctgaagcccaaggggcatgtgttacagtatgctctttcaactttgccatctgcagacagcttttgttaatcacctcgatagaccgtcttccttatcgcaagggcagggggccattgtgactgcctgagttcttgcccagtgtaccagaagaattggatgacatgtgggctggaaggatgagtgcaaggttttattgagtggtggaggtggctctcagcaagacggatggagagccggaagtgggggatggagtgggaaggtggtcttcccctgaggttgggccacccagcagatggactcttcactgacagcccctagttgaactaccccagcgtccggacgtccacgtccttcctcttctctctttttctgccatgctgccctgccactctctgccactctccaccactcttttcctctgctcttctcaatgctcagctgcttgtatctgtgcccactaaggccttgggcttatatgggcacaggatggtgggtatggtgggccaaaaggcaacttttcaggtgcaaaaacagaaatgcttgttctcgtttagggcctccagtttttaggcttgagggtggggcctttgctggggaactgccctcttctacccagtatttccctgtctgctgtccatatcagtataactaataaagactgattacatggtaatagggtttattttaatctaaactaatatacagaaaacttaatgtttcatctcattcccggtctgtcttctgaacagctgggttttcaaggactctgatgatttcctttttagttatttcagtgatccagggccagaattctcttcctgccctttcattgttcctaaaaaccattctagtttctctttagttgattcctgttttttcttaccttacctcctatctaggtttagaagggtatgagacttcagtgttgtggcacatgaggaggtaagggaattgtgaggagaaattaaatttttagagtttaaagaacaaagaagtaacttgacttgggtgaggtagaatccaaggtccagaactcatataggaaagccttcttttgcaattacataattaataagattgcttgcatttattttcagttacctttccgatgaaaagataatttttaaaaaattatttttagatgaaaacaagaaaccagtttatttggttacaaccctggataacacaatggaagacctgttaacgctggaatatgtaaaggtaagcagtttcatttatatctgcttaatatggtaagtatgctgctgaaatgttaagttttgtaagtttggtattattcagtttatttaatcttcactgtaacataatctctttgtaactcctaatactaaggttttttttattttgtcatcttgtattaaatagttgtgatttataaatacttcatatagcaaaataagaagattgtgttctaagtagaaatgacctggagtttgattttttttttctcccaacaggggtactgagaaagaaacacactttttagtcttgttagagtgtattgttttatgtgatacaagatgatgctttcactttcttttccactgttttgtgaagttacttgatattcctagggtcaataactccattccttttttattgatttatgatattcattttatcgtttgttaagcttttctatgtactatggtctatttctaatttttccatgtttctgctgacttccgtgtttctgcgtcagactattttaataattactttataataagaataatgcagaaagcatttaatcactttaaaaccatttttgctatccattattgactagatgtcttaagatttttgttgtatatgcattatatagcttttatgtagcaaaagtattctagacctaaagaaaatggataaagaaaatgtggtatatatacaaaatgaaacactattcagctttaaaaaagggggggaatcctgtcacttatgtcgacatagatgaatgtggaggacattatgctaagcaaaataagccaagcacggaaagacaaatacctcatgatcttctttatgtgtggaatctaataaaactgaacttatagaagtagagagcacagtgatggttaccagagggtagcagggatgggagggagggaaggagagggaatagagagttgtcaatcaaatggtacaaagttccagatagacaggaagaataatttttgagatctgtatacagcaggggaactgtaatcaataataatgtgttgtttattttaaaacaaccaagaaagtgaatttcaaatgtctcaccacaaagaaagataggaaagcgaggtgacagatatgttagttagcttaatttaatcatttaacattgtgtacatatatcaaaacatcacattgtcctccataagtgtatataattatgatttgtcaatcaaaaatattaaattttttaaaaagaaaaagaaaacacagagtatttggatacttggtggacaattctgtcacaaattttgtttttaaatacaggaagaattaggaagaaccgtacagagttgttgatgaccgaatgattattctccacacttgataatatccaacatttcctctcttaataataagaatgatagtacgtaacatttattgaatacttgctatgtgccagagagtccaatacttacattttcttttgttctggtgaagcggttgcttatttaggtaattatatgtgtgtgtatatgtgtatatatatatatatatatgtatatgaacagctggaaaattatataaatgtgtattaggactataatgtgattgtatatgtatgtcttcctaacgtgttctaacagatttgttttctctttggataggctgaaaagaatgtacccgacttgaaaagtacctataacaatgttttacaattgattaaggtatgagtagataatttattttttaattatgtactatttcttatggaaattattttctaactggaattgtaagatccttaaagataagaaaatattataaattatatcctttatgccacaaagcatagtgccttgtagagagctggcaagcaaatatttattgacctatcactaaaatcagctttgttctttaggtaaatttttcctctttggatattcatttacacactgaagcacttctgaatacaataaattatcttcataatatccttccgcaatcagaggaaaaatcagccccagtgtccactacagagactgaagacaaaggagatgtcattaaaaaattaggtatgttttttaaaaatttagcatcaactttttttttttttaaccatgtaggtcaataaatctagaccctgactttattattaacttcaaatattggcttcagaattctgttgcctaggttaatatctagaaggattcattatatgccaggataattttagaaaataaaggaaactactggcgaagaaaatgttgcttttgtttatcgtatataataattgtttttagtttaagattatatagtaggagtattagattaaaaaattttttttcttccacctcccagtaggaggattagatttaaattaaaatttatgcatttcatgacattattttagattagacaaatatgactaacaaaatttgagtattgtcagctgggtgcggtggcttatgcctgtgatcccagtgacccagggaggtgagcgctgtggggattgaggctcaaggatcacttgaggccaggagttcaaaactagcctgggcaacatagcaagaccctgtctccaacaaaattttaaaaattagttgggcatggtggtgtttgtctgtagacccagtttacttgggaggctgacacattagaatcactggagcccaggaattcaaggttgcagcgatctttgagctacaattgcaccactgcactccatcctgggtaacagagagagactctgtttcgaaaaaaaaaaacaaaaaagagtatcagagcatattttaaaatcagagtatagtactttcgaagcagtgaaaagttgcaattttgataatgacaagtatcacctagtaattattggttctcaaaaaattttgaaatttatagctacagtgttttagtttcaaatgtttagtttcttcttgaaacagtgttgtctatttgcttttgtttttgttagattttattgttttttagaattttcaattcagtagggaatatcataccttgctttcaactgaattgcagatcaggttttctctgatatcactatttgtggtgatatttcagttactttataagtatagtgaggtaactactaaatgtttttcctcatgttttataatatgaatttttttttgcagctttaaaactatccacaaatgaagatatcattactttgcagattttagcagaattatcgtgtttacagatctttattcaagatcagaaatgtaacatttctgaaattaagattgaaggtaataaaatttcacaaaaagcaaattaaaagacattaaatgaaagaaaaggcagtcattcttttgttcccttagggcttgattctgagatgattatgaggccttcagaaactgaaataaacgcaaagctaaggaatataattgttttagattctgatataacagctatatacaaaaaggtaagaattcttttaattaaataatagtacatcattaaataggattgtcctttaagagtggtcataggtatcatttggacatttgtcagaatttagtagtatggcttattatgtgcatgggttttggagtcaggcataattgggttcttagctctactccttagtagctgtgtgaccattagcaggttacctaatcttggactctgtttctttatttgtaaaatgaggattacagtatctcataaatgagataagtacgaataatgctgcaggaacaaagttttgggagagaacctagtaaatacctttttcactttttttttttttttttggttcatgtactctgaatcttgtaatgcattttagatacatttgagggtctgaagtctgaggaagtgagattttttataaagcttattgtcatcagcgatcactagtatcgttgttgtaataatgataagagagtcctttgaactggatgattagttgttgaaggttaggtaatttgttactggttataaaacagtgaggttcctgctgcagagttgaacaggcaacatcctacctgaagcaggcaggattatgtatttaaggaggttaaaggaatatcagatagtaggatcaggaaaaactgaagtacttgttgagtcaggaagtcagcatttggaatatgttgagaagaaaggaaatagataaatagattttgccagtaatactgtagtgatgaactgatttttatgtttaaaaaattcttatttctaatatcttcttgttatggcttatttagtgggatagaaaaacagttccaacatcaaaaagaagtgactcatagcaataaggaacaagaaattttccagaagccgtggttttatttgcttctattgcttttattttaaaaatcataagtatcagagtatttaagaaataggttatccattttattttccctatctagaaagtaaagctcacagaaataaagtatctacgaaaagttatacagaactgagagcatgatccaacccattgatttttttctctgtaattttattttattttatttttttattttttttgagacagtcttgctctatcacccaggctggagtgcagtggcgcagtcttggctcactgaaacctccacctcctgggtttcagtgattctcgtgcctcagcctcgtgagtggctgggattacaggtgcgcacaaccacacccaactaatttttatatttttagtagagacagggtttcactgtgtttggccaggctcatctcaaactcctggcctcaagtggtctgcctgtcccggcctcccaaaatgctggtattacaagcatgagccactgtgcccggcctgtaattttatttttaatatatctacaaggttaaaaattcagtttacagaaagttacaaaataaaaaaaatctttctccttgtcttcttgcacgattttcatttccctttccctgtttctttgattccattgtacatggtttttaaacaaactgccttgtttagtaactttccacgtgtcaaagaaccagagaggcataaggtttttgcccttatgaaatcagacctgattatgaatcagtttcataagccttgtacagcgatatatattattgtgccagttttaagtgtactgagacattgaggccctcaactttaagggtgggagcccccagaccatttgtttgactctgtcttggagcagcatcctccatttactgtagcaccattggacaaatactgtttttatttatatatgccataaggtaaaaaggattcttgctgacctgatagtctcatgaaaaacatatcatagtaaattagtttctgatatcttcttcataaaaaatattttgaaagtaaaggcttaaaaaaatccaatttttaatgcttaattcttggtgatgggtacacaagtctttctaattattctcaacttttctggccttgttattaggccaacacttgcttcatgaaatgagttgggaaatgctttcttcctgttttctgaaaaatttgtatagaatttgcattattccttaaatgtttgatggaattatcagtgcaaatattttttgtgtatagttgagtctgggattcactttattttattttccatatggcattcagtatccaaaggagatccacacactgcatttgattgatataccacttaagtctgttatagtttatgaatttcctttagtttcttctctgcccttgtgttagccatttgttgctatcttatttattctgtacaattttccatagcctgtatcttgctgattatgttttcatgctatttaacatgttactgtatcctgtgtttccttaaatcggtatttaaatctcagggcacagtgagattcagggtttgggagtaggggttggcaagatacttcatagttggtagtgtgtgttttcataggaggcacatagtgtgtagctgtcttttttttcttttctgttttgcactgtcttggaatattttcttttttttatgttagaagctatttgttgttatttcctgtaatttggtcttgaagtctgtgtctggagagtggccataagccaaaatagccactttctagcttgcaggcatgttggtcagatgggacatcggggaggcaacacaacaaaacaccctcgaggggtgcccaccagggaggctgacaggaagtctggaggcagtagggacgtttcttcatttattaaatgggagagttcaccagtctttatgctggtatcaccaatcattttggcttttcaaaagtttattctccagtagatttcttaggcagggctcataggaacaataatccttatttatatttgcagggtagtttgactggattttaaattcttgccttgaattttcttttctagatgatcttaaaacatattactccatgtcttatggcctagtattggtgttgacagttctgatgacagtttgactttctttcgcttctaagaactttgccattttccccagacattcagagctaatttgaagctttatgtagggactttggacaggtagacatcacagttgatggtcaggaactggtctagcaattttatgggttctcagattgagagtatctcttgttcttaggctagttagtttccgttgagaaaaatactattaagtataagcctggcagcctacattccagaagccaattggttgaaagaagtggaggcctcatcatttagtttatagatttttgcttaaaataaccactttttaacatggtgttttattaaccgtctttctgtacctgaagtctcctagaccacagcctttctgctctaaactctgtcgagcaaatctgttctgttgaactcggagaggaacagtcatatagtcctactcatgtgacatgcagaggctattcggtttattctaaactaatttaccagtatttatataattatatagatacaatttatacattaatatatatgtaaattatatatgtataaatactggtaaataaattaagaaaaaactaattatatatattatataataatatattttatatatacataaaattctctctctctctctctctctctctgtctccaatcacacaatcacagctcactgcagcctcgaccttccctggcccaggtgatcctcccacctcagcctcctgagtagctaggactgcaggtgtgtgccaccaggcccagctgatttttgtagagatggggtttcaacattttgctcaggctgccctcaaactcctgagctcaggcgatctacctgcctcggtctcccaaagtgctgtgattacagacatgagctgagccacagcgcctggcctatttgagatactatagtcagcaaaagataaaaagcccttctccacgtggaataaatagtagttaatcagtaatataaaacaatattagagagtgatatgtgctttgaaaaccaagaaagcagggtaatgtgacaggtaataattcacgtggcgtattaggattatcaagaaatgcttttttacagtagaaacatttgacagaaatctgagctgtggatttgagccctgttgaaagagctttccaggtggaggaaagagcaactataaaagccttgtagcaggaaggtgcttgctatattctgggaggttttagggccctcagtaacctttgggtagaattatttattagtttctgttttggtttagtttttactttttaaagtaagatttattgagacaatttacctatagtaaaacttacctcttttagttataattctgtgagttttgacgaacatatactgttgtgtaacttaccttcagcatatacaatgggtctgtcaaccctaaatattcactactgccctttgaggttagcccttctccccatcctagcaccttagaatcactgcactgtttttcgttcctgtagttttgcagtttccaaagtatcaaataaatggaatcatgcagttatgtagtctttcacgtttttttttcttagcatgtgagattataatttttgtctttttatgtcttgatcagcctggttaacgatgtatcgattttattgatactttgaaagaactggcatttgtttcaattgaatgttctctgtttttaattttatttatttatgctcttttaagattccttccttctgcctgctttggatttaatatgctcttcttaaggtggaagtttaaattattgatttgagaatgtctttctgttgtaagcatttgctgctataaattttcctttaagcactgctttagctgcttcctgtaagttttgatatgtcatatttttattttcattcaattcaaagtattttctaatttctcttctgactttcttttacccattgtttatttagaaatatgttatttaacttctaaatattttgagattttcagatccctttctgttactgatttctagtttaaattcattatggtcaggggagaaaccgtttcagttcgtttaaatttgttgatgtttgttttatggcccagaacatatatgattaatcttggtgaatgtttcaagtgtacttgaaattaatatgtgttttgctgggttgaatgttccatttgggcaagtaggttggtggatagaattattcaggctactgattttctgtttactggttgtgttgaagcctctgattataaccattgatttgcctgtttctcctttcagttctttaagttttttgctttgtatgttttggagatctcttgttaggtacatataaatgtgtatgaattttatgccccttttgtgattatgtgatgtgtctttttatctgtggtaactgtgcttgttctgaagtctactttggtagtaatatagccattccaggtttcttcggttaggtttgaatggtctatctttttctgtcctttagcttttaatggatgttttcttgtttaaagtgggtttctgttttttgatgcaaagtctcactgtgttgcccagggtggtcttgaactcctgtgtttaagctcgcctcagcctaagtagtaagtagctgggattatatgtgcatgccaccacatctggcttaaaatgggtttcttacagtcagtgtatatttagatctttcttttttatctaatctgacaatctcttggcttttaatttgtgtttagactattttataaaactaattattgatatgattggattgtaatctgatatctctaattgttttctgttctctaattttgtttatcctattgtattcctccttttggcctgatttttgattaattatcatttattttatggtttctctagggtttacaatgtatatatctttaatcatagtctatcttccaataatattttattgttgtacatatagtgtaagaatcttacaataccatgcttccaattcccatttcctatctttcttggtatcatcataatttgctttactttggtgcatgttgaaaactcacaatgtgtacctattgaatttggtttagtcagttttctttggagcaattagttttctaaagatgttttatatttttcttcattgcaactctttctgtaactacttcatgtagtttctgtctattgtttgtatttctctctgaaatactttctcatttcttttttttttttttgagacagagtcttgctctgtcgcccaggctggagtgcagtggtgcaatctcagctcactgcaacctctgcctccggggttcaagtgattcttctgcctcagcctcccaaatagctgagattacagatgtgtgccaccacacctggctaatttttgtatttttagtagagatggggtttcaccatgttggccaggctggtcttgaactctttgacctcaggtgattcacccacctaggccccccagagtgctgggattacaggcgtgagccaccgcatctggcactttctcattttttataatgcaggtctgccagtaatgacttctctcagttttttgggtatagatgagaagggagctgggaaaaacctttatttcaccctaatttttctgagtgacatttttgctgggttgtgttttccccctttccaactgttaaaagatgtgatttcattgttctttgttacacatacttttgatgagaaatctatgacatttcttatttttgttcctctgtacataattggtcatcttttttgactgctttcaggatttatatatggtgtgactagatgagtttaattgtgttttgatatttgtcctgtttgggcttttctgagctacttggatggatctgtctttcaatatttttcatttttttcttcaaatagtttctttgcctctgtctccctttctctcccccaccccctggctcccctgttttctcctcctccactttttccctgttcctcttcttgaattcctgaaattcttgctggatttctgtttatagtcccacagcctttggatgttctgttcaagttttttccccattgttttcttagtgccttttaattcaaataatttatcttgacctattttcaaatctactgattttgtccttggctctgatgagtgtactgacaaacccactgaaggtattttcatttatgttaccatgttttttaatctttaatatatccctttgactcttcttttttccattttctctgctataataatattcaccatctattcatgcatatgttccactagaagcctttaccatattaatcatagtaattaaaattaaaaattttagtttcaacattgatgttatagatgagtctgattctgttgattcctttattatttgcttgaattttttcccttgcttttatagggcatctcataattattgatcgaatgtcagacatcatatcatgcatagcaggagtccccaacccccgggctgtagaacggtaccggtctgtgacctgttaggaactgggccggacagcaggagttgagtggtgggcgagggagcattattgcctgagctccgcctcctgtcagatcagtgggggcattagattctcatagtagggtgaaccctattgtgaactgtgcatacgcaggatctaggttgcatgctccttgtgagaatctaaagcctgatgctctgaagtggaacaatttaatccccaagccatctccccaccctccaaccccccagccccacttttgtggaaaaattgtcttccacaaaacagctccctgttaccaaaaaggctggggaccacagatgcatagcataatagagactgaggtaaatatcatagtatttatgtctggaaacggggatgcctcttttctgctaagctattagcttggggtggggggttgagcttaggttggtttgaattccagattaatacgatttccttcactacattactgcttcagtttcctttagttgtaccttgtgcttagggtggctggaggctgtgttgctcagattttgctccgtgctgagcctttgacctttcttctactcttgtacctcagaaaattctctttccacattcttagctctttcctagatgttagaggctcctgctgcttgtttcttagtgcttgtgagcttgatgtatttggggagaaggcaaggtggtttggataggcttgttagtgttcttgtccattttcactcctagccagggctgtttctgtgagtctcagaaatggagtattcttggccatcctgcccctcctcctcatggcatctgattgatatctctcgtatttcctatgtgggattgactatccttcccttccccagcagagggagacctctaatcatctggccccaggagagttcttgttcttcccctagagttttattttattcttgtccctaggatactgtatcttcacctgtgccctgagggaaacaaggtttactgcccttcccctagtttcttatggctattgttttgagtagttgataatcttggtggtgctttgggccttttctgcagtggaggctcctcaccttttccagggtcataccaaggaaagccttctcttgtttcccacttgcacccatctcccgtctttctcaagagctcctcacgtgtgtggctctcagggattctgcatctcacattagtccacacttatcctttatcattttagctgaattattcttacctatattgtatagtatctgacatctctttctcctctctaccacaagtgagctggtgcttattttctctctctccctgaaggtacctgtttgtccttagatttttagggatctttgttgtcctgtgacctcagattgctaatggttttaagaaagttatgatatcatagtttatcgggttttttttccttttcttaaggtttggaggggccctcactccagctttgtgcaccctaggcagaagcaggactgtagacttcttttcagccctgtcttgtacctcagccttcggaggtcacttatacctctggttctggaggattctttgttctgtagttgtaactgatttgcttgttgatggctcttcagctccctgttcttgcttgcttctagcatttaggagaattgagaaagttatgagcttagtgctctgtccctcttccaaaattttttttaacattttacatctcctgttgtcgccaccatttttaactgttattgcagagcttgagatttttaaccactgtaggtaatttctggttggcaattaagatggccctttacaatctgataaggaacagaagtatagcaataggaggagactcctttgaagaatccagaaaaatctattcacatacctcaaatcaggaatagatttcagtaaggtgtagatatacagtgtttttcaaatttttgtcagtcaatcaagaaatacatggttactctcattacgaaagtatacttgcaaaatgaaaatgcatattcagatatttcctcttctccattaaaaaaaaaagaaaaaaagctggagccacacctactaccttgattttatgacccacaaaggaaattgccaccaccaatttgtaaaagtttgtagtgtaggttccaataaaccagttacagtagaattgttgcctcatttgtacttggcttgtgaatacttgggagattttctaactatgttttgttattttttactgttttatttttgtactgaaaatacatcatttcaaaaatggattgtgataattaaattttctcttattaaggctgtttatatcactggaaaagaagttttcagcttcaaaatggtttcttacatggatgcaactgctggttctgcatacacagatatgaatgtggttgacattcaggttaatttaatagttggttgcattgaagtagtttttgtcacgaaatttctatattctatattggtaagtattttattaaattattatttattttatactaattggaaattgctatatgtcaaatatggatgaagactagtaagaattccttgcttgagattttttctgattttttaaatcttctgggtaccatttattatacataataaatgtgtagttccttatttatataacatcgttttgacataggaatattctaattaattgaaatatatatttcatatagtaacattaagtttatgtgcattatatatcataaatatgttatatattaattagaaccttcgttttatatgtcattggcttaagtcttcgttttacctgacttgcaactataatttaaaaatactgaatatataattgaagtttgttttggtctgaagtcatcattaagaaaaggttattttaattttctagagacaaggtcttgctctgtcacccaggctggagtgtagtggcatgatcgtagctcattgtaaccttgaactcctggattcaagtgatcctcccgccccaacctcctgagtagctgagactacaggcacatatcaccatgcacataccaccaagctaattttttttttcttcaagtttttatagagatggggtcttactctgttgcccagtctggtcttgaactcctggcctcaagtgatcctcctgctttggcctcccaaagcgctgagattacaggcattatgtctggcccaagaaaatcatattttcgattgcattgtcattctgtgaatatcagggactttaaggagttagatttaacccctatatgactccaccctaaggcatttcggttcttatttcggcttttcttgtttcattttgtttcggtttttgtttttcccttgctgtcagctgatattttttcctgtgggtgtcacacctatctccataacatcactattcattcttttaaaatgctgtctcagtgttttagtgtatgaactaggtaatcaaatctaaggctgtagtggaataaataggccaagtgtggcaattcttataagcaagaaaagtatttgcgtgttcatttgaatgtatttgggaatgtggagccctcttttgttatttcaaaattctaagttaattccatataatgttgctgttttgtgatcttttaagccataacatcattttgtacacaaaaatgtaaagataaacaagtattccttgttgaatttcttctcttttaaaaaaaattagagttgggttcttgctctgcagcccagactggagtgcagtggcgtgctcctagctcactgcagcctcaaactcatgggcacaagcaaatcccatctcagcctcccaagtagattaaattagtagggacaacaggccctgctaattttttatttttaattttttttttaagacacgatctcgctgtattgcccaaactggtctagaactactggccccatgttatcctactacctcagcctcttaagtagctaatttatttttataaccaaaaaaatcatgtcacttgagccctcttgtacttatacttagaaattactaaaatgttaattttttctttgaacatgaaaattaggtataagagtataaatatagataattatattttatgtcattgaagtttttttttggaatttggaaattggaaaattattttgaaacttcttaaacatattttatttatttatttaccttacaaatataaataagctctctgtccactgaggttgtatagagaaatagggttgtttttcattagggaaagtgagataagggaagtagatatctgtaagacattccagtgatcccatttagctttgttctgaggactagatttttattttatctgtgtctttgtgtttctcagtttttgtggcagaaaattaagatttaatatagacagtaagattttgaataaataatgcttggttgtatcaagtaaaagtttttttttaaatggaggtaaaaccataaatatcaatatatatttaataagtcgtatttattaataaccttaagaatataattctgttatcttacaggcttttatagataattttcaggcagctaaacaagccttggctgaggcaactgttcaggcagctggaatggctgctactggtgtaaaagaactcgcacaaaggagttccagaatggcactggatattaacatcaaagccccagttgtggtcatcccgcagtctccagtttctgaaaatgtttttgttgctgattttggactaattacaatgacaaatacctttcatatgataacagagagccagagctctcccccacctgttattgatttgataacaataaagctgagtgaaatgcgactatacaggtaagcttttcacaagtatatttgtgtggaatgcaatatttttctaactttttaaagactttgatgtcttgagtagtctgtttacagtgagattttattttattaattatacataacttagtgattctctcttccttaagtatattttggcaaaatcaattatagtctttgcattttaaaaaacctagaaagtgtttgaaaatttctccttaggtaattaggaaaactataaaatttattatctgaggaagtatatttgtgcttttttgtggttcattataaattacatggctatggaaaaaatgaggaatttctaatgtaatatgtttattcactttgcaaatacattatcatcttatcttctctgtcggttgttgctgtggctctgatgctgtaatttaaacgaacatgcagtagcatacaaccttattcgttaacctgtattcgttaagcatagggttaggaattaggcggataaccaaatgttcaaatagttcgagagcttttatactgtgtcctctgtgtttctgtgctatttctaattgcccattctgaatttatgccctattttccaacttgaatccttctctatttatacttctcaactgccctcttccttctttctgtcatttttctttgatataattctcttgcttgtctcttcaccttatttttgtctcattttttacttaactaactcccattctctacttctctttagcttcctatgagtctgtctttccctcctgtgctttctttgatcaattgtatatttttaaagcagctttattgagacataattgacacagaataagttgcatatctttaatgttataccattttataagttttgatatgcatacatttctgacagtttatgtacagttgtattacttcttccttaagtattaggtagaatttaccagcgaagccatctcgtcttagagtttgcttgtgggagatttttaaatgatagttttcatttctttaataaatttggggctattcaagttattttttcttgagcgatcctccctaatttcttaaaagaatttatccatttcatctaagttgtaaaatttaatggcataaagattttcataatgctccttatttattaatatctgtaatgatgtgtcctccctcattcctgatatttataatttctgcctttgtactgatcaatctggttagcgatttatccgttttattgatcttaagcagtttttggttttatttttttttctttttttgttttctcattcattgatttctgattcaatatttattattctgcttactttaggttcaattttgctctttttataagtttttttaggtgatagctaagattattgatttgaaacatttcttcttttctaatatatgacgtgctataaattggagtactttataatattgtgctatgaattttaagttactctataagtctgtgtagctctcttctctctggtattttatcatataaactagctaccttggtttctcttggactctcagctcttatcttctctactctggggctttcctggccttcccctgggtcccccctccctgtaccatggcctgttaattatggtaaaacaatagtaaactgggacaatcgtagggctcacctcatttttttttccaactctttggaatcactatccatttttgatgtcttgtgtcttgaaaactatttttaagtcaattttgtctgtcttttttttgggggggcagggttgtttcaagcaggagtgttaaaccattcatgttactccatcctagatggaaggagaaatttctgtcacttgagcatttattaagcaccaaatctatcccaggcattgtgctaagaataagaaatataatagtgagcaatctttataagggattaataagtaatccctacctcattgggttgttgtggtaggtactgtttaataaatatagtgggctggtgcataaaatgggatcacattttgaaaaggttctagaaattaggtcaaaaggagacaaaactagaggttggaaggataatttggtaactattgcagtaattcacataagaattataggtgacttagtctaaggtaagggagtgaagtagtggagagctaaccagaatttatagtaactgatggttgaatgggtgtgggagttaaaggagaagagaaattaaaattcactttaggttacaggcttggaaatcagcgtttgatgatgatacacttcactgagataagacagaacaatgcagaaaaacccagtagaatagagatagtaattatttctctaatgggcaaagtagcctgaaagtggttgcatgacttctacatggagagatcttgaaagaaatccagaaggcagtggaatatatgtgcctaggtgatgcacataggtgatgttgtttagacttctaggtttaggagttcttagtaataatttgtgctagtcactgaagcctttggaatgagcacagtcacaaagaaagcttgtagagtgggacatatgaagaagaatgctgaggaataccagtgtttaaataattgacagaaagaggaaccctcaaaagagacgaagtaggagcagacagagagatgagaagccaggaaaatgtatttgaggcagcagtgagggtcctgctgatattgttaaccatgaattaatagtgtatcatttttttttcatgcagtacttggtattttgtatttggaatccaacagtcagttggattgagacaaaactgaattttttgccaagcaagtgtgaccgaaggtagtggaacaggattttaatgattgagaatcatgttgatggataatagagaggtgatatagtttggccatgtccccacccaaatctcatcttgaattgcagctcccataattcccacatgttgtgggagggacctggtgggagataattgaatcatgagggtggttcccccatactgttctcatgatagttaataagtctcacgaactctgatggttttaaaaggggaaacccctttgacttggctctcatcctctttttgcctgccgctgtgtaagatgtgccgctgtgtctcctttactttctgccatgcttgtgaggaaggggtccagtttcagttttctgcaaatggctagccagttttcccaacactatttattaaatagggaatcctttccccattgcttgttttttcaggtttgtcaaagatcagatggttgtagatgcgtggtgttatttctgaggcctctgttcttttccattggtctatatatccgttttggtaacagtactatgctgttttggttactgtagccttgtagtatagtttgaagtcaggtagtgtgatgcctccagctttgttctttttgcttaggattgtcttggctatacgggctcttttttggttccatatgaaatttgaagtagttttttctaattctgtgaagaaagtcagtggtagcttgatgtgaatagcattgaatctataaattactttgggcagtatggccatttaccacagtgagataccatctcacaccagttagaatggcaatcattaaaaagtcaggaaacaacagatgctggagaggatgtggagaaataggaacacttttacactgttggtgtgcgtgtaaattagtgcaaccattgtggaaaacagtgtggcgattcctcaaggatctagaaccagaaataccatttgacccagccatcccattattgggtatatacccaacggattatgaatcattctcctgtaaagacacatgcacacgtatgtttattgcaatactgttcacaatagcaaatgcttggaaccaacccaaatgctcatcaatgacagcatgaataaagaaaatgtggcacatatacaccatggaatgctatgcagccataaaaaagaatgagttcatgtcctttgttgggacatggatgaagctggaaaccatcattctcaacaaactaacacgggaacagaaaaccaaataccaccacatgttctcactcataagtgggagttgaacagtgagaacatatggacacaggagggggaacatcacacagcggggcctgttggggtgggaggcaaggggaaggatagcattaggacaaataattaatgtatgtggagcttaaaatctagatgacgggttgatgggtgcagcaaaccaccatgccacatgtgtaacaatgtaacaaacctgcacattctgcacatgtatcccagaactagtataaaaaaaattagaattatattgttttgtgctgtaaatagcttttttcttaataatatgctgtaagttttcatgtcattattttgagtgcataaatttttccaaatattcctgtttttagaaaatctaaatctgccttttgttagaaatttgattctaatatatatacagttttgctattataaataacactatattgatgattgatatctttattacatcagtacttttgtaattgtctactcatttctttgggataattcatttcctgaggatgagttcctagaaatagaattactcagttatagagtgtagccagtttttcctgaaataattttaaaataattgataattgaaaatgcagttgctgggcacgttggcttacgcctgtaaacccagcactttgggaggttgaggatggcagattgcttgagctcaggagtctgagaccagcctgggaaacacggtgaaaccccatctccacaaaaaatacaaaaattagctgtgtgtggtggcatatgcctgtcatcccagatacttatgggactgaggcaggagaatcacttgagcctggaagattgagactgcagtgacctgtgttaatgccactgcattccggcctggatgacaaaatgagactgtctcaaaaaaacaaaccaaaccccagaaaatgcagtttagttacaacttcttagaaagtgcataaagaaaaataggaattcatgtttgtgactaggttctttatacattaatccaacttgactgcaatttagcaaatatttattcattatatggcacatgccaatcatctaagtactgacaaaaagcaaagaataagatgaacatagttcctgccctcatgaagctttcattctaattaaaaatatagaggacataataaactattaaaatgcaatatattaaatgcagtgatggaaaaagtataaggtgcatgtgggagcacgtaggaaaggtgtattttatccatatattgggtagtactgataagaaaagtttttccagagaaagtaatcttttgacataacagttttctttctcatagtttgtccaaaggacagaaatttactcaaagatatatagatgaagatatagatatagatatataaaatacaagtatttattatggtgaagaattggaaaatatgaaattttaatcatagaaggttaattaaaatactagtatagccatttattctgatatggctattaaaattatatatgcatcctagcctaactgaaaaaaagaaaagaaaacctatgtgtgcagcattccctatggggcttttagattccttaacctattaccattaagcggagactgcaagcatgcaggcatatgtaagtttggtgtcactctatcattcattcattaaatggcttggtacaaggcattttgggagatccctgatgaactctcatatttctctcctattgattaaatgattgccaaaattctacagtcatggtgttatatcttagtttaaggatttgctgctaattaaaatataagtacattattgaggagtaacactttgagattgtcactttgaggtacaatgggaggcttctatggtcacattgttacttgaaggggttcaattgacctacatttttcttcattcctgagcatcagtcttacctttataagtgcttggaaaggcaaatatagttcaatttaaattgtatgtattcagctattttaactcatagaaataaaaattgcatatggtgctacttattttttataaagtaagggaatatgtgatattctgttacttacctaaatcagtgagttaaaatgtttttataatgatgtcttatataatgtttgtttacaaattacatagagatattttttttttttttcccgagacagtgttttactcttgttgcccaggctggagagcaatggcatgatcttggttcaatgcaacctccgcctcctgggttcaagtgattcttctgcctcagcctctcaagtagctgggattacaggtgcccaccaccacgcctggttactttttgtatttttagtagagatgggatttcaccatgttggccaggctgatctcgaactcctgacctcaggtgatccacccgctttggcctcccaaagtgctgggattacaagcatgagccaccactcctggcctacatagagataattcttattttaatggtttactatacaacttacaacttatatacttttgcactttttaccatattccaaaattgtatcgaaaaatacatatttttcccctttttttttttttttttttttggagacagagtcttgctctgttgaccaggctggagtgcagtggtgcgatctcggctcactgcaacctccacctcccaggttcaagcaattctcccacctcagcctcctaagaagctgggactacaggcgcatgccaccacggccagctaatttttgtatttttagtagagatggggtttcaccatgttggccaggctggtctcaaactcctaacctcaagtgatctgcccgcctcagcctctcaaaagtgctgggattacaggtgtaagctactgtgcgtagctctatttctgtataatatagaacactcagctcagtgtaagtcacccaggtttctagtgggatagaacatcactcaactcattttgacagataaaaaaaaagtctgatagatattttccctttatacccaacaaattattgatttctgctatttgcatataaaaggataaatttaagttaatctttttttaactacctgaatgtatatgaaacaatttaaaagaatgttatctctacttatagatctcgatttattaatgatgcataccaggaagtactggatctactcctgccattaaatcttgaggttgtggttgaacgaaatttatgctgggagtggtaccaggaagttccttgttttaatgtaaatgctcagctgaaaccaatggaggtaactttttttggatacttatcaatttttgttttgcttgttgaaaaatactgcttggggacataaggcatcatttgagtggaatttgtatatacataatcaccttggtcagaattgaaatagtgattatattaaactagaattcattttaaaatggtcttgatttattcttttaacaaatattactggagataaagtggcaaggaagcaatgacattgtctctgacttcatggaacttgccagtctaatgcaggggttggtggtgatggtgatctggaaggtatagtagtagttagatagtaaaaaagtaatcagacacataattaaaatagttataaattgtggtaaatttaatgaagtgaaggggtggcctgcacctccacacctgtgggtatttctagtcgggtgggatgagagactgagaaaagaaataagacacagagacaaagtatagagaaacaacagtggacccaggggaccagcactcagcacaccaaggacctgcactggcaccggcctctgagttccgtcagtttttattgattattattttcattatttcagcaaaaaggaatgtagtaggaaagcagggtggtaataaggagaaggtcagcaaaaaacgtgtgagcaaaagaatctatgtcataattaagttcaagggaaggtaccatgagtggacgtgcacgtaagccagatttatgtttctctccacccaaacatctcagtggagtaaagaataacaaagcagcattactgcaaacatgtctcgcctcccaccatagggcggtttttctcctatctcagaattgaacaaatgtacaattgggttttataccgagacattcagttaccaggggcaggcaggagacagtggccttcctctatctcaactgcaagaggctttcctcttttactaatccacctcagcacagaccctttacgagtgtcggactgggggacggtcaggtctttctcatcccacgaggccatatttcagactatcatatggggagaaaccttggacaatacccggctttcaagggcagaggtccctgcggctttccacagtgcattgtgccccaggtttattgagactagagaatggcaatgacttttaccaagtatactgcttgtaaacattttgttaacaaggcacgtcctgcacagccctagatcccttaaaccttgatttcatacaacacatgtttttgtgagctccaggttgggtcaaagtggctgggtcaaagtggctggggcaaagctacaaattaacaacatctctgcaaagtaattgtttaaagtacaggtctttttcaaaatggagtctcttatgtcttccctttctacataggcacagtaacagtctgatctctctttcttttccctacaatgaaggacacaaataataggcatggtgctgtagtcaattagatatattaatatagaatttattggaaagatctaggttagaaatactaattttggtgtcaccagcatatagatggcatttaaagccatggaaatatatgaaataatctatacaaaggaagagaaagtattagaagaattcataagttgaaaatgaaaatggcaaatgtgtcaccaccttagttttactttcttattggttgacattgcttcaaagatctctcatggaactgcccacaagttcatatttttttcccttgactggatgaaagtcaaaagtgtgtcataggctttgctgaagtgatagcaacatatgctctgggaggtttctttaagaaacctacttaacaaatccttctccccacctcacagtttccctttctatttctttctgtaaaaattttattgattatgagaaaaccatcattttagagatttcagactttttttcttttttttttttttgagatggagtctcgctctgttgcccaggctggagtgcagtggtgcaatctcagctcactgcaagctccgcctctggggttcacgccattctcctgcctcagcctcccgaatagctgggactacaggcatccgccaccgcgcccggctaattttttgtgtttgtagtagagacgggatttcaccgtgttagccaggatggtcttgatctcctgacctcgtgatccaccccccttggcctcccaaagtgctgggattacaggcgtgagccatcacgcctggccgagatttcagacttttaagtcaaacgtatattcagagcataaaacatgatggcattatgaaaatcttagtgtgtaagataataatggctgctttaacttacagggtaggagatggaagttatctttttaagataaatatttgaagtctatttatattggtaagataacagatagaaactcataaaacatatagaaacttataaaacataaatattatgttccacccaacatgctggggcagttgctatcccactgggcccagttattaggcatatttgtgtggggcagcaaagacactgctttctcatgctcttcccaggtagaatccatacagaatgtcctggtgatgctgccaacaatctgcaagtgcccagctgccttttgaggccaaccctctagggtaaagttggggcttcccttactctaattcacctgagtagttggttagctgctgttgcagctcaccccagagcccagatatttgttctctcctgggcctcatcttctgtgccagggagaggctagaattggttgtgaaatcatttagtctaatgcatccagaccaagtggagcagcttgtgatttctgacttgtcagattttcagtggttgcatacacagcctgtcctgacatgtagatactgcagatcagcagccccaggatccttacagttctttgaacttcctccactgagctcctggcaaaagtgaaggaagagtgccaattaataatcagtatttgaggtgcatgcgatagacagatactaactggaagacatggtttagaagttgtaatatttattttcatcttattatatgaactctttttgcagtgtctgctacatagttacaaactaagtgtcatgaataaagaatgaaggaatgaaagcttaaaaaaaaccccaaacattagtagtatgtataaggtacacatggacttaattttaaaacactaaattagtgtgtcatctttgaaatgcagtcaaagaaagcttggttacaagtaaaacttgttaaatattgtgggattcaaattatctccttggggtcataacagctaaaaattctttttgttgttttgacaaacttagaagtgagccaaactcaaagatcttttttacattatttctgttgtgttagggttctccagagagagagagagagagtgtgtgtgtgtttgtgtgtgtgtgtgtgtgtgtgtgtgtgtgtgtgtaaagagagggaaaagggagagacttattttaaggaattggtgtacatgattgcggatgccaccaagttcaaagtcagtctacagggtaggccagcaggaaggatatccagggaagaggtagtgttggagctcgagtctgaaggcagtctgctggcagaattcttgcttagaggaggtcagtctttttttattgaaggcctccaacttcaatacaaagcaattggatgaggtccacctacattatggagtgtaatctgatttacctagagtctagagatttaaatattaatttcatctaaaaaatattttcacggaaacattttatgtttgaccacatacctaggtactgtgactgagccaaagtgacatacaaaattaaccatcacagctattaaggcaggtcttatgctgttgatttgggactaaatttgtaacagctaggatttgaaattggctctttattttttttttttttttttgagacagagtctctgttgcccaggctggagggcagtggcgcgatctcggctcactgcactctctgcttcccaggttcaaacaattctcctgcttcagccacctgagtagctgggattacaggtgtgcactatgcctggctaatttttgtattttcggtagagtcggggtttcaccgtgttggctgggctgttctcttaactcctggcctcaagtgatctgcctgcctcagcctcccagagtgctgggcttacaggcgtgacccatcacacctggcctgaaattattagctctttgagttagttcctagtttatgtgtggacctaagcatattaaccatttagcttcagtgtcttataaatataaatatcaggattgcattagctgggcatgttggtacatgattgtaatcccagtttcttgggaggctgaggtcagaggttgagcccaggagtttgaggctgcagtgagctaggattgcaccactgcatgccagcctgggtgacagaatgagacccattcactaactacctaactaaataaatacatttcaggatcatattccatagacctaggactttttcgaggttcaaataaaatagttcatgtaaaacacattgtgaactctaaaatttttggtaaaccaaatgtatcattttttattctacatttgtaaaatgaggtgcttactaaccaaaaaaatccaaagtagacagataactactgaaagttcattttaaaggtttaaaattactatattatttggtacattaataacaaatagttctttattcataacttcattggtattaacacctaatttagttctatatttcacaagctactaaagagcacatggtcatttagaaaactgaatattcagtttgtaaaaatgtttaattggtgtggtagaggattgaaacagtctttcatttttctcctctgagaattttaactgcagttaaattctgcaatgaagtagcagtgctaaaaagaacaaatcttttttttttaacagttcattcttagtcaagaagatataacaactatttttaaaacattgcatggcaatatatggtatgaaaaagatggtagtgcctcacctgctgtaacaaaagaccaatacagtgccactagtggagttactactaatgcttcacaccattcaggaggtatgtttttaacttcaaatttctttctgctttcctctttctctcttttttcttctatcttcttccctccccttccttctgtcttttccctccttcctcccctctttctccctcctttccttctttctttccttctttttgtttagtttgggcaaaataagatttgtaaatctgtttctaatcagctaattccattcagacatctctaaattgtctatgttattagtcgttgtgttgattttttttctttgaatgaaagttcctagttctgttgtaacaaaattcctcagtatatattcatgttttcctgacttccctgtagctcctcattttccatttttctccctttcccccatcttctccctatccctagtgtggcatatatcccaaatgaatcttttatattgatattaggaatatcaaagtattagaggtgcaaagagaggatgatcattagtagatggtggagtttaacaaatatttgggagatggatggaacagagtagaaggaagcagaacttagaaagagccttcatctaatgttggatccagtgtgctctgtggaatgtggctggtttctgagctcagcaccagcgcatacagagggtcagttagtgctgggatgacattgctgcataagcataaagttctcattctggcattataggggatcctcagacctacctacctcaaaatgaaacctactagttcacaagactcacctttgcaaagccctgaggtgttacacagcatttttactcagggagaatcctaacagaaaaccagctttacatttacagcattgtaggaaaccccacccttactagctggaataatcaaactagtcctttattgttaaatatgaatggtcagatatgaagaaaattgtaaaaaccccaagcatgaatgaaattaagataaatagaatcatgttttctgaaggaaacagacaattgaggtgacagaaaaggaagtagacaaacaaaaaagaagctctgacattctaagaggattttgagaagataatataagaaatggatcccaccaccaccagctcacccaaggataggagagttgctggaaatccaaatattattgctgaaaatttgaaacaaaaacactgaacatgtaattagaagtattgagttggaatatttggttgaggcaatctcccaggacggagaataaaaaagcacagggatggaaaatgtgataaaacttaagagtgatgttttagttcagaaggtccaattccagaatgagtgttacagaagaaataattgaggaaatggaaggcaattctttaaagaagtatagtactctccttttatctgcagggaatatgttccaagacccgtcgatgcctgaaactttgggtattaccaaacctatgtttggatagtacccaaactatattttttcctatacatacatatgtatcataaagatgaatttataaattaggcacagtaagagttgaacaactaataaaatagaacaattataacaatatactgtcataaaagttacgtgaatgtggtctgtctctccaagtatcttaatattttcagacaccagttgacctgaccacaggtaattgaaagtgcaggtaagggtgagctgctgtaaactgtccagacctaagtaaatattgaaggaagctcttagctataatgaatctactgagtttccagcagattgggtaaactaagattccacatacaaacacattttcatgagatgtcagaatggtaaagctaagattttctgaagtttcagaaaaaaaaaaggctgcctgtcagggacttagaaaaaaaatgattgcatgattgatttttgttgttttttatttatcatcaataaaacatgatgaaatagaatccctggatggtagaagacaatggaggaatctattcagaattctaaggaaagtggtttttgaagctcagattctatacacagccaagccatcacccaaaatgtgaaaagaaaataattctcagatttcctgtgactcagttttcttagacttcttcatacccattcgtaaaagaaattagtttgaaagtgtatttcagaaagtcaggaaatctaggaaacagaaaaatatggggttaaaaaaacctaggcctactcaggagtgcactgaaaaggaatctccaaattatctatgtgaataggctagaaattaactggctttcattaaaaagtaaatgagaatgctttaaggaaagaaaaaaaaagccatatggaagaatgtcttatagaagaaaaatagcatgaattccacatagtatgtaggatacagagttagctatattatataactgatacagacaggaaagtgttttctgcgcttaagaaagaaatttctataccatggtgcagaagtgaagtggactaaattttgcataattttgagccattgttagaatgtgagaagagaacctcttatttttcagagatgcactcatcgtgacagtgtagcagcagaggcagtattactgtaaatctcattgaaaaatactacatggtcatagttaaacaacacatggaatacttcttatgtaaataaaaaagtaaatgttatgaactatgataacttagaagtaaagacattactaaccaaagctgtaaagaggaagatggatcaggggaaacaaatagtaaagccttaaagagtgagagaaaatgtctgcaattgatgtaacaagaaatagatgtttgaatatgtcattttaatcgttttcttctggaaatttttacacatataccaaagtagaaggaataaggtaatgaacccacatgtactcatcacccactttcactaattttttttttttttgagacagagtctcgctatgtcacccaggctggagtgtagtggtgcaatctcggctactgcaagctctgcctcccgggttcacgccattctcctgcctcagcctcctgagtagctgggactacaggtgcccaccaccacacccagctacttttttgtatttttagtagagatggggtttcactgtgttacccaggatggtctcgatctcctgacctcgtgatccccctgcctcggtctcccaaagtgctgggattacaggcgtgagccaccatgcctggcccactttcactaattaatatcatatggctactttgttactgcccacactctgctcttcccccttcttcctccagcccataagattattttaaagcaaatcccagatactataccattaattgctatttttccataagcaataaggacattactttttaaatatagtaacatcatcaccctaaatattagcagtgcttccttaagaccatgaaaatatccagttagggttcatctttctcctaaatgtctcattacaaggcctggttttttttaaataatgataaaagtgtcaattcacaaagaagatgcaacaatcctaaatgtgtgtatacctaataacagaactttaaaatatatgcagcaaaattgacagaactaaagaagaaaatacacatatacagaatcatagttggggatttgaacacaccactcttggtaaatgataagatatgaacaaaaaaatcggaaagaatatagaagatttgaacacagtcaacaaaattgacataattaatgtaatacaatgttacactcagttgcagaatacctttttgtttttaaacacttcctggaatgtttacaaagatgcaccattttgtggaccattaaattttctgaccacattggattaaattagaaggtagtaacaataggatgtgaaaaagcttgaacaatttctaaataacccatagatcaaaaagaaatgacaagggaaattaagaagttgtttgaactgaatgatcatgaaaataaaatatatcagaatttgtggaatgcaactaaaacagtggtgaaagaaatttgtaactgtagagtaagatattagaaatgaataagttttaaaatcaaagattaaatcttctaccaccagaaactagaaaaagaataggaaattaaacccaaagtaaatgaaaagaagacagtaataaaaataatagaatccaacaaaagaaaaacagagaaaatgtttaaatgtatattttttcaaaattttagatttctgttcattaaagatacagtaacaagataggagaaacccaagcctcagacttgatgtatgtatcttttatccagagtacattagcacttttataaattaatagcaactttttaaaagcaaaataatgaccaaaagatttggatacttgagagaggatgctatgtaaatgggcagtgaacacatgaaaacttgttcatataattttttttttttttcttttttgagatggagtctcgctttgtcacccaggctggagtgcagtggtgtggtctcagctcactgcaagctccgcctcccgggttcacaccattctcctgcctcagcctcccaagtagctgggattacaggtgcccgccaccatgcctggctaattttttgtacttttagtagagacgggttagccaggatggtctcgatcgcctgacctcgtgatccgcctgccttggcctcccaaagtgctgggattacaggtgtgagccaccatgcccagccgttcatataattatttatcaggaaaacttcacagttcaccagatgagataagttgtagaagactgacaacatcaaaggttgacaagaatgtggaacagctgcaattctcacatacgactgataggaatgtgaaatagtattaccactttggcaaagaatttgaaagttaatatgtacctacctttaacagagcaattccagacctaggtatctactcccaccccaccccaaaataagtgcatatatacacaaaatgactcatttaggaatacgtatagcagacttatttatagtagcccaaatctggaaacaactcaaatgttcatcaataggaggataaactatttcattccatagagtgcatgactagctataagagtgaactacttgtacatgcagcaacatggttgaatctcagaaacattattttgactgaaagaagccacacacaaaatagtacaatctgtattactccatttatatggaatttaaaaaatatacaaaattcgtctatgatgattgaaattagaatggtagagaggttgggaattggctagcaagtgttaagagggaactttctggagggatataagtgttcagtatcttaattgaagtagtgactatgtggaaatatacacttatcaaatttcatcaaatagttcatataagatacatgtatttcattgtatgtaaatttttatcacaattgaaaatacattacctggcataatggtacttttctctgaagttagatataatgagaattagaaagtgctgcgttttcattttaagctcatttaatatgtgcatataatgccttgattcaaaattcaaatgtagaaaacaaattttgaattcttctgattagtagaaaaattttaaaaatgtctcttggttttagttttttaaagtaaaatttgaatactgaattatgtgccagttactgtaatatgcattttacatgtgctattttacttaatctccaaacatactcagtgattagttctatttttccttggaacagaacagaagtaggaacagaagcatcaagaggaaatagaaacaccaagtgttcaattaatattcccaaattattatggaaagagtcctaagccagaagttactgagttttacatctgaattttctaatattttattttcttgaatgtcattttactatacctgtttaataattctattaaatctatttcaagggtattttaatgagctacttttcatgatattttcttttattaaataactttaattttttcaaggagcaactgtggtgacagctgctgtggtagaagtacattcacgtgccttactagttaagacaacactaaacataagcttcaaaactgatgatctcaccatggtgctgtatagtccaggtcctaaacaggtaagtccaggaagaaaagaaaatgtattttcacatgtgaaatttgcataggttgatgtttttaaagtaacaaatgttaatatttaacatttattttgtagtatctgtccctctgagaaaaatgatctttttactttaataataattataactatttcccttttaaatgagttatctatcatatagctaatgtgaaaaataaattgtaaaattaaagtgatatgtatatatttttagcctttcattagagcccttcggagacagaattttgatgtttgttataagcagaggcaataatttgtagtagttcatatcatgaaatacactttagacttgtgtttctttgtaattttgtgttggtttctcctttcataggcttcctttacagatgttcgtgatccttctctgaaacttgctgaatttaaattggagaatattataagtactttaaaaatgtatacagatggctcaacattttcttccttctcattaaaaaactgtattttagatgataaaagacctcatgtcaagaaagcaactcctcggtatgtattgtaatgatgttctaaggttttacttgagaaatcgttgatatattttacagaattcatctccagaattgcacgttcattttctgagtgcatcctaggttctttaaagcttcaattcagtcagctcgtagtactcggttaacatttaaaatgtcctggttctgttatgtactattcttactggataattgatagattggttgagtaactagaaataatcagtgcaattaaattggtttttacattctttaaattacattctctaatataaatctaatataagttattgttaatccatgctaattgcaatgggaagtacataaaaaattgaaaagaaaaaatatcctgagattcaaactcttataatttattgaacatacacttcctcatttatgatacatttgtgttccagaagtttgtaagtttgttatttggaacactttatggatcttcccaagagacatgacttcagaatgcttttttttgtcagtaaaagagataagaggtctttgagttttactcatatgtttgattacttctaagttactcatacataggaattgttgttattgtgttttccagaatgataggactgacagttggttttgacaaaaaagacatgatggatataaagtacaggaaagtcagagatggttgtgtgactgatgcggtctttcaagaaatgtatatttgtgcaagcgtagaatttctgcagactgttgcaaatgtctttcttgaggcctacaccacaggcactgctgtagaaaccagtgtgcaaacatggactgctaaggaagaaggttagttattggctaaaatatttaatatttgttttattgaagtgctacaacaggacttaaccttgattagccttttagatcatcaaagtaaatgctttaagaaattaaaattttatttttcagagtagaaggaaaaccttaatgtgttttcttggaggatgtatagtttgcattttttaaaggtgtcagtatatattgcatttaaaaattatgaaacctatgttagaataagtaattgtacttctcttcaggcagtaatttgaaggaatttgtctagtggaaaaaaacaagcagagcaaataatgaaccaaccataccttttcacaattaagataatatttcaatttaaagcactcatttatttttgttgtatttattcctagcttttaacgtacggtttctctattatctttttataatatgtgatttactgtggtatagtagaaagagtatcaagttgagagttagaaactagattagtttctaggctttccaattaaatagtggagatttcccctcatttaaaaatgttcttatgcctatagcttcttcaagtctttactaagggttgtagttgattcctttgggatctaagattcttttgttttactttttactattatttcattttaatattttcttataaataataaattattcataatatatagcaaatattttaatctatttttatttgttttagtacctacacaggaatcagtgaagtgggaaattaatgttattattaaaaatcctgaaattgtgtttgtagctgacatgacaaaaaatgatgctcctgctttagtcattacaacacaatgtgaaatttgctataaaggtaaccttgaaaatagtacaatgactgctgccattaaagatctccaagtgagagcctgcccgtttcttccagtcaagagaaaaggcaaaatcactactgtgagttaactatttgatcatctgcttaattgtaactattttggatgtagtgtataccattttaggaaacaaaaactacctacatgctttccaaccttgctctgtaaaatgtctttctctctgcttagagagcttaatttagaatattatttaccagctttgaaactctttcattcttccagatgctgctcattattgttagtatttgtgggaatattgtcactaagaagttgggttcatcttgacagttttcagttaagatctactttgactttctaaccatgtcaattccaaattgctctttggacttttaagactttctgccagttgtttgctgtgttgtttcaattttattgtttcaacttttttctcccgtttggatgtttttgctcaaataatgagtttttccttgtctccatgtaacttcatttgaaccttcagccatttgctttgacatacttcacattgatattttactctctagtaacctcttggccttcctcctcttcataactctacttaaaattcattcctttacagacatcttttcaagttaactggctgacttccagcgaatacttacaaaaatatttgagcttctgaaggagtaatagaagcataagtttttgtttgtttctttgtatttttttcctgatgcttggtatgcatctatagaagcataaatgttctaaacattgtcaccatagaaatataagatgtaattttgatacaatgaatacatatatattaggatataagataaactgttgcccaaatttgcaagacagttggccctccactaagcaaagagagagaatagaaaatggagggtataccaattctctcttagtttttgacttagaagttttaaatatatatttcttctattcacatcttttttggcttgaatatagctgtatgaccacactttacttcagtaaaggttggagactgtggtatttttttctgagctaccttgtgctcagataaaacttctattactgtggaagaatagaacagatattaggttctagatgtcctttatatgggataattaaggagtgtattattaagtcactttttaaatagttgtttttattaacttgtttatttgacatacctattactaggaaagtctttaaatagaaatatttttatatttaaacattaatttagtggtattgatttttctctcataggttttgcagccctgtgacttgttttatcaaactactcagaaaggtacagatccacaagtgatcgatatgtcagtaaaatccctgacactaaaggtaaattaaaatataatcatttgaatatttagtgcacttaaaaaaagtagtaaagcctagaaagttattatagcaagtcttttaattgttatgcaaacaaaataggtgtgtttttgaaaatacgtttttatgagatatttacaaagtaatattatttaatacacattttatgaatgttattctatattttattatttacatttgtgtggttaacatctaatatccctaataaatattattgaaattactttatacttcatcagtttaataatatctgcaattcatgtatattaataatatcatgtaattcatggaataatatctgcaagattcatgtaaatatctgcaagattcatgtaaacacataacaagaattatggtaatttaaaaaattttataaacaataaattgtatcttctattttgtggtagtaatgttaattcagtatttaatttctcataatatatatttaatatttcttgacgtagtatgtttgaaagtgttttgtatagacttattaatttttttccatttaggtttcaccagttattataaatactatgattaccataacttcagcactgtatacaactaaggaaaccatcccagaagaaacggcttcttctactgcacatttatgggaaaagaaggatacaaagactttaaaaatgtggtttcttgaagaatcaaatgaaactgaaaaaatagctcccacaactgaattggtacccaaaggcgagatgataaaaatgaacattgattctatttttatagttcttgaggctggaattggtcatagaacagtacctatgcttctggcaaagtcacgtttttcaggggaaggcaaaaactggagttccctaataaatctgcactgtcagcttgagctagaagtaagcatatttttccagttttataacagataatgatacgtatggaatattatgacagataatgatacatatggaatattatggaatcttgtgtagctatttaagcttattgtaaatatgatattgggtcaaaaacttttagaaaaaagttttcaaattttgcccttgaataattgcttttatgtatacattccttttacttttaaagtacatgtccacattaagtttatatttcaactgattttatcaacttaaagataatatattattcgacagttgttgattagattcagaatattttttttaaagagttaaattgaggccaggcccagtggctcacctgtaatcccagcacgttgggaggccaaagcagaaggatcgcttgagcccaggagttcaagatcagcctgggcaacatggtgaaaccttgtctctactaaaaatacaaaaaattagccagtggtggtggctcacacctgtagtcttagttattcgagagactgaggtggacgatcacttgagaatacctgggaagtcgaggctgtggtgagctgagatcttaccactgcactccagcctggggttcaaagtgagacccagactcaaaaaaaaaaaaaagaaaagaaaagagttaaagttgaatacccttttttttttaaggatatagacagaatttctgaatatgtggataataatctcttctaatagaaatatgaagaattagaaatatatgccttatacttttatgtaatgtagaatcaaggaaagatgcttaaaaaggggttttatctggactaaattgtgaagagcgaatatgtactatgaagttagccaggtgaggaaaatgctgagggagtgcttataggaagctactgaatggcatgtagactggtttttatatagaagaaataacagggctaaaaaacatggtgggaaacaggatggaagatcatttttaatttaaaaaattctctctgtaggtgcattattataatgaaatgtttggtgtatgggagcctttgcttgaacccttagaaattgatcagactgaggattttagaccatggaatcttggtatcaaggtatatctatatatgtctatgtgtgtatatatatatatatgtattttaaaagactttatttttttaagaacagatttaggttcacagcaaaattgagaagaaggaacagagatttcccgtataccacctacttctgcacatgtatagcctccccctttattaacattccctcatcaacgtatatttgaagactgaaaaaattttccaaaattgagaatgtttataccacactcgacactttattttaatcacaacaaggttcaggttgtctcatcatgagccttgcccacatgcttccttgtttgccctctgaatataattttcaaatctaaggccaatgttgcctatgcttctaatacaattatgtaacaagtattatgttacttgttacataatttagaacaatttagaacataatttagaacacagtttagacattgttctaaatattttaatccttacaacaactcttggaggtagatacagtttttatttaacatgtgaagggactgagaccagggaggttaagagacttcttgaagtaataatagctacaaagtggaaaagatgggatgcaaatccagctgcagaggcgttaaatccactctaaaccactatgctataatgcctgtgtcatcatcttgtaggttgttgtctatcctgagtttccttcatcctttggatgtttgcatgtgtgcaggaatgtatattatttgtttgaaatatattgtggatttatataatcatgagaatcggggcctttaggtggatgaaattttgcttctgaagcaagagactgcagaattactcacgtgtttcctacctaataatgacttggtcaacctgcagacagattttcagtggcttaaagccagttaaagtaacaacagaggtgactagcttagcatgttgagctcttttcatattagatcacttaattttattttccagatattttagatgaaggatatgaaaaggaattccttggtggtttttaggttagaatacacatggtcagcagatctgtgactcctaaaaaatggtaaagggtattgattcttatgagctctaggtttataacactgttctgctactattgtctgcctttgtaagtctctaggtttctgttctttattattagcatgaccaatacattaagttacttttttctgtctgagtttttatgttgctttgaagtatgtgcttttatattcagatcccgggtacacatagtaattttaggtttttatttttccttctaaattgtgtctgccattttactatcactgatgatgacatgatttattttctctaatacttctgtcctttatgaccttagttggctgatgtccaagtaatttcaataaggcaatagaacttactgaaattagaaaagataaaatgtactgacctttctaatgttggtattgggatttgtctagttatgttgtgttcttagaatttttccttatatttctatgatttatcattttagatgaaaaagaaagcaaaaatggccattgttgagtcagatcctgaagaagaaaactacaaagtgccagaatataaaactgtcatcagtttccattcaaaagaccaattaaacattacattatccaaatgtggtcttgtaatgttaaacaatttagtcaaggtaagaaaagaaatttgaaactttaaatattgagatacttgtctgattgatctgtctgttgaataagaagtttaataacttagttgtcatttgtcctttactgttctccttgtcatttaattttacacatttcattttatttagcataactctttcttattaggcatttacagaagctgccactggatcttcagctgacttcgtaaaggatctagcaccatttatgattttaaattcccttggacttactatttctgtttcgccaagtgattcttttagtgtactcaacattcctatggcaaaatcatatgtattgaaaaatggagaaagtttaagtatggattatatccgaaccaaggacaatgatcatttcaatgcaatgaccagcctaagcagcaaactcttcttcattcttcttagtaagtagttgaaaaattaccttcctggggctattttgttttaaattacaatttacatgttattttactcttttgtagaatcttagcaaggttttttttgtttttgtttttgtttttttaaaatatcctttctaataggtcaagaactgttttttgtctttgcagtgtcttggttactattgttactaaaactttgtattccaaactctttctttatcctctgcattatttagagcatggcaatttactgctttgttgttgggaggaaaaatattagatctcgccctcattctgcttttatagaccgtggatgtttagatgtttgtgggggttcttttattcacatttggtatccgttgatagtattccaccagttttgcaactgaaagaattctaagtgtgaattcatgcagatggcaatttttaatggctttaggatttataaatggtttttttttttttatgttctgcctgttgagatgaaggttttttcctttgtcttttctgcttcccaaaagtttttcatttttattggaggtgaaatatatacattcttaaagtatcataatatgtagtcattgtgaagttaaatagtcccagagcctcacctacaccactttttgatactctggcatttaagtaattattgaggagggcatcatttaaaagattaattagacataggggggtaggctactaaaatagcttgtgtttctagttagaaaataacatgtaacaggtgtttcaggtgttgtcatagcgttgtaattaatgttcttataaattttacgtctttttttttaacatttttatggatgggatggtaaatgaaatttatgcaagtaagtaattttatccccaatacaacatgtgttttaggtaaatatatataaaattttatttaatcaagtccaagatataaaggaaaagtgacacaagttgttggaaaaattaaaaacaaaaattgtagtcaccttgatatttaccaatgtctaccaaaaggtattatgctctggttattctgacagcaaaccagagatcagtattcttgtattttatagtacttgctctcattactcatttttgaaacgtttgctattgttgtcttgggttaaactcctgaatgggagttttttaattaatgctgtggaaatatatgctggcttcttaaaatatcccttttatggactatatccaaagactctagtgactattatttataagtttaagaatcatctgaaatttctaatatgtaacatatgtaaaattaatatgtaatgaattataataaaaacttttaaacatacttacttaatttagcacctgttaaccattctactgctgataagattcctttaacaaaagtgggacgacgtctgtacactgtaagacacagagagtctggcgttgaaagatctattgtttgtcaaattgatacagtagaaggaagtaagaaggtcacaattcgctccccagtgcaggtatgaaatgatcaattttgggggatgtcctgttatgcatatctgtgtgctaataaaattaaaaacaacaacaacaaattattactgaaagaatataaaccgtaacagtaatacagctgatatcaaaaagaagactcactaccaccagttgcgctacttggttatgacgggtggtaggaatttgttcaatatacttcttataattttttaataggaatattttgtaaaatcttcttacggtattttttataaatagtcatcagtgttttgctttaggtctttgtaatgtatttatatcctttctatttgattagataatttttagagaaataaaaaaattttacagctttattgaggtatgtacaataaactgcatatatttaaagttgatgacttttgacacaaaaatgcacctttgaaactgtcatcacagtcacggtaatgaacatatttatttcttagaaaaattttctgtttccccactttcccattcccaggcatccactgatctgtcctcattgtacattagttatatggcctaggattttacataagtggaatacagtacagatggagtttgactttcattcagaaaaattttgtatgtatgtgtcaacttatgtgtatccatgttattacatgcagttacttgttgttgctcagtagtaatctattatatgtatatgccgcatagccattttgagtgaacctttgtatacagtgtgaagttaagaattgaggttttgctttttttttcaccatatggattttttttccagaggattttaggtccttctcatttttatataaatttgagaatcagattatcaattttataaaaaatctggataaaattggcttgtcctttaatttttaaattctgattactcattgatagtatttagaaatacaggttatattaacctctacttgcagatttaactagacttacatattctagtagatttgtgtagatttagatagttatgatagctgcaaatgaagacatttttactttttctttttcaatctggatgtgttttattttatcttgtttatattgcctatcacactggctagaatacaattcgagtagaagtggtgagagcatgtttttgccttgtccattctttcacctttaaacatgatttgtgttgttttgtagatgccttttcttaggttgtaaacgttcccttctattcctagtgtgctgagagtttttatcagagttgattttggattttgtcagatgctttttctgtacaagaggaggatatattttttaatttgttagtatgatgaattacattcactgattctttttaaatattagatcaaccttgcattcctaggattaatctcacataatcatgacgtcttactaaccttttagtatattgttggattttgcatttatattcatgagggatattggtctagagtttcaatgtctgtctttctgtctttcttttcttgaatcttgctctgtgtccaggctggagggcagtggtgccatcatggctcactggagccgcatctcctgggtttaagcaatcctcctatctcaacctcccgagcagcaaggactgtaggtgcacaccaccacacctattctcccatcttgctccgcctctcattgtttaactttttaactcattaaagcagcagtacccaacctttttgacaccagggacctgtttcatggaagacaatttttccacgggtggggggctggggcatatagtctcaggattcctttcttaggaatagaaagctccacccatgtgtgttcccatcccctgcagggacaccaagttaacaactatctacacagaaaaaacaccttcataagaaccaaaaatcaggcaagtactcacagtacctggatttaaccacagatcatcaggcattagttaaattctcataaggagcatgcaacctagatcccttgcatgcgcagttcacgctcctatgagaatctaatgctctggctgatctgacaggaggcagagctcaggtggtaatgctctcaagcctgctgcttgcttcctgccgtgcagcccacttcttaacaggccacagaccggtacagcccatggctcaagggctggggacccatgcattaaagtatatttaacgtggggtttctgtagccaccatgtagttagaccttgttttttttttttttttttaacataatctgaaaatctgtgccttttaacagggataattaaaccacttatatttaaagttgttgttgatatggttgggcttaaacttgctattttttttttctatttgtctcatttgttctttgcttccatcttccctttgttttctctttttttttattaattgagcatttttgttatggattcattttatttccttgttggcttattggctgtatctctttatacttccttgtctttttgttgttgttgttgatactttagggctttattacatacatattgtattagtctaccttcaagtagtattttgccccttcacatacagaatcaaaactttagaccagtatacttccacttctcatctcccacattcgtataattatgttcatacatttttgtgtctatgtatgctagccaccccataatacaagttactatttttcttaaatgaattatttatgttttaaataggtttaaaatacaaactgtatttgatatttattatcactttttcttctttcagtaatctcacagtgtggatctgctggtgatgaattctttcagttttttcacatatatgtattacagatattttcactgggcatagaaatctagattggcagggtttttccccccatactttaaaaatgttgttctgctgtctgctgtattgcattgtttctgatcagaagtctgctttttttcctatatttgcttttctacaaaatgtgtcaatcttttcttcagcagcttttgagattttttttctttatcattggttttgagcaatttggttatgatgaatcttactgtagttttttttatgttccttgtatttggggtttactgaccttaaaaatgtggatttatagttttgatcaactttagaaaactttttgccattgtttctaaaattttttctgtctttgccctctcttctctcctttaggtaccagttagatatacgttagggtgtttgaacttgccccacagctcagtaatgctctgttcatttttacttttagctttttcctcgtttcttttttcatagtttctcttgctgtgtcttcaatttcccttctctttttcagtggccaatctgctattgaccccatctgatatatttttctcaatagtagtctggatttttttgtttttttattttccattgtctctttttaacatccttagtcttctaactttttagtgatattggatataattttaataaatgttttaatgtccttgtctaccaattctattacatgtcatttctggtttgttttattgatgtttcttttcattatggtaattttttcattcctttaatgtacctgataattttttattggttacctaaaactactgtatatatcagaaccagacttcattcttcctgtttcttttagacggatctttactgagccttagataatctacacatgtcctgatcattactcagctgaagttttgacagggaggggacactcagttttccagaattctgtccgtacagctcttgcctctccatgcaggtctctcccctcaagtacaacatgctgtgaatttcagtcacgttggcttccccagattttcagatcttgtctcttcaacttggctgcctgctcctcacacagcagactagaaactcactctccagacagcaagctgggtagtcatagggcttatgtagtttttttgtttttgtttttcccttgtgccgcctcttgccccgtatcggaaactgtggtttgatgtttgttgtttttcttcctgctttttagttgattagggtgggaagctatatctggtccccgttattctagcatggctgaaaacagatatcccttctctttcactttttatttagttaactattttaaaaggtgactaacagctgcactcattactgctgattattttgccatttaaatagttgaacatgaattttgaatttcttacaggtactatgtgtagaaatatttctgttgcttcaaatgtatagagcaaatagtttttctagaattaaaaatatagtacagttaagattattcatttatgaaattcttagttctcatgttttatatgctgctatgaagtttttaaagtagattttggtaagatatagaaagattataagataattgttttactaaacaacttgttattatctattccaaagataaatatgagtatttggaggttttctgatattattattattattattatatattaatcagaataatacatttttgcctgaccattatttgctacttactggatgagataatcttcatacttttctctctaaagaaaattgcaacaattcagtcacctcttcaggctccaattctaattctagttctcttgctatatccaccatatctgcagtgacttgctccattgaagtcctgaattcctcaaagtcgtccatgagggttggaaccagctgttaattttgatattttgacctgttctcatgtatcacaaatgttattaatggcgtctagatgatgaatcctttccagaaggttttcaatttactttgcccagatccatcagaggaatcactatctatgggagctgttgccttaaaaaatgtatttcttaaataatgagactaatattatttaagtcaaatatacaatgttacatataatattaagaagttgaaattactccttgatcaatttgctacagaatagatgttgtgttagcaggcatgaaagcaacattaagctcctgtacatctccatcagaactccagtgacaatgtgcatggccaatgagcagtagcattttgaaaggattttttttccctgagaataggtctcagtagtgggctttaaaaattcagtgaaccatgctgtaaacagatgtgctttcaaagtcagtctttgtttttccatttatagagcacagagtagagttagcatattcttaaaggccctgggattttcataatggtaaaagaacattggctaacttcaggtcactagcttcattatccctttaagaagagattcagactgtccttcgaagctttgaagctaagcattgacttcccttctctagctatgagagtcctaaatgtcatcttcttgcaacagaaggctgttttgtctagtttggaaatctgttgtttagtgtagccatcttcatcaatgatcttagctagaccttctggataacttgctgcagccacttgccacttcatcttgcacttgtgtgttatgcaggtggtttcttcccttaaacctcgtgaacaaacgtctgcttccaactttttttctgcaacttgctcatgtctctcagccttcatacaattgaagagagttagggcctatcttaggagaatgttatagctggtttgatcttctatcctgtattaggccgttttcatactgctgtaaagaactgcccaggacttagtaatttataaaggaaagaggtttaattaactcatagtgcagcatggctggagagacctcaggaaacttacaatcatggcagaaggcaaatgggaagcaaggcactttcttcacaaggcagcaggaaggagaagtgaatgcaggaagaactaccacacacttacaagaccatcagatctcgtgagaactcattcaccatcacgagaacagcatgcaggaaactgtccccatgatccagttacctccacctggtttctcccttgacacatggggattgtggggattacaattcaagatgagatttgggtgggggacctagccaaactgtatcatatccagaccactagagtattcttcctgtcagcaataaggctgtttcactttcttatcatttgtgtgttcactgggttaggacttttaattttattcaaaaacttttcctttgcattcacaacttggctgtttgatgcaagaggcctaccttttagcctatctctggttttgacatgcacttcttaacattaatcatttctagcttttgcttttgatttaaaagtgacagacatgtgcctcttctttttatttgaaagaggccattggagggttattaattgtcctaatttcagtattgttgtgtttcagagaatagggaggtccgaagaagagggagaaagtggggagaatgtccaatttgtggagcagtgagaacacacacatttattgattataacacatatagttaaaatgaaaagattgaaatattgtgagagttaccaaaatatgacagtgaggcacttagtgagcacatgctgttagaaaaatggcaccaatagacttgcttgatgcagggttgccacaaacctttaatttgtaaaaaatgaaatatctgcaattcacaataaagcaaaacattataaaacaaggtatgtgtatatatgaatttactacttttgatagtcaggagaaatggtattattcaaaataaaatttgcccacagttacacagctagtaatcagcactgccagtatttatctcaggtttttttcagtttaacatctatgttcatcctgctatcatattgctgttgtgtagtcataaactttaggaattgttccagcaggatagcttaccagcttacctgcaacacgcttctgtttctttcttacctttgtagtttttgagacacagggtcttgctctatcgcccaggagtgcagtggcatgatcagtgctcactgcaaccttgacctcccaggctcaataatcctctcacctcagcctctgcagtagctcggactacatgtctgcaccaccatacctggctaatcttttaatattttgtagagacagggtctcactatattgcctaggctgctcttgaactcctgaggtcaagtgatcctcctgcatcagcctcccaaagtgctggaattataataggtgtgagccactgcgcccacccacttttatacagacggatgcttccttttcctctgctcccttagacttttcaagcttatgctcattccgttttccagacttttgatctttccttgaaatttcaactactagttattctcagcttccaaccaactttttccgcactaaatttgaaagggaaaacaaaggaagcaatatcagactttggtaactaacttcacattccaaacaggcaccatttagaagcatgtgtttcttaataggctccatttacatcagtgataagttgaatgtgaagtttatttggaattatatttataatcagaaaatatgttggaaaacttgcagttaatgtctgttgtggaatgctctggatgttggttattggtttgatagtggactttgaagtttattgtaatacagatgtctccatccacaccatggaatttaaaaaatatagacatttaaaaatgtttccctcaaattaaaaaaaaaaatacatgaagttgaagtcagctgttttgtttccctcttagtccacattccctccttccttcttccttgaggtaatatcaatttggtgatacgttgtgtatatttccagtaccatattttaaaaactattattcctgtccagaaaatatatacttgtgtttttagtgtcttacagaaatgttacactgttcaccttgttttgctatgttctgttttcattcagatattcgaagtgtaaccatatactgatatataggtcattattttaatgatgttacatgattatatggatttgaagaaaattttcttatttttctattattgagattgttttcattttcatttttttttataatgaaagtggtgtggtgaacatcagtgtcttgaatgaatgtagtgaacctgaatgaatacacatgtgtaaacatttctctaggtatggaactaggagcagaattcctaagaagaaagtacattttcatttttactaagtttttgctgaattattcttcaaagttattttatcaatttacattctaccagtagtgtatgtgagttcctgttcacatcattttcaactgttgatatcaccatacttctgattttttttgcagtttgttggtattaaaagatactccatgaatataatttgtattttcttgattactaggaatgtcaagtatcttttcatctgtttattggtcagtttttccattctgtgaatcatgtttacattctgttcctgttttcctcttgattgcaacttttttaatgatttttaggctttttgagtgtggtggttataaaccctttgtcaagtatattacagatatttcccagcctgtagattgtcacttttatcatataaatatttaaaattttgatttttttctgtgaatttttttctactatttttatctaaacaaaaacttatctttaaacaaattagtccctatcctaaaatcaaaaagatattatcttattcccctgtaggatgcttaaagtctgtttttgagattcctattatataaaactatagagatttttcttgtatgttttaggataaataatatgtttgtttcttttctaatttatataagcaagatgaatattgcctgatagttcctttgttaagatagttacatggacatattttttttacacatctttagattcttagattaatgatactaaatattatttgtttttctttcccagataagaaatcatttttcagtcccactgtctgtttacgaaggggataccttattgggaactgcctcacctgaaaatgaattcaacataccattaggatcttaccggtattttgtctttatcattttatttactctaaaatctcttgtagaatttttagtttctgatttcacatggataactttgatcaaatccatcctgctaatagcttatctaacgtatttaggtttcagtgcacttagatcttaaaaaagaagtattatttaatttattgtaataacttataccaagcacactatatatgcttttctcttaaatataattatattttgattgcaatataaccgtcataagcatagtcatatgattatgagttttaaaaatgtctaatagatcatgcctggtggtttctgaatttatatatactattatgaagtaatttgtacttctcaaaggttttataatacaatttttttgaaattcctttagtaaacaatattttatccttttcttttcatatttgttcattgttcagggttggagttgtaatataaatagaagtatatactatattaattttaaatttttaaagtaattaaatttgatacaatatgttttaagaaaatattaaaattataacaaaatatgagctagtcttatagattttatatcataacaagtaagtattagtcaagatatgtaatctggaattgaaaataatctcttatgtggaaattgaaccttattggagaataaaactgttctcagaattaagcattgtagtttgtttaaataccattttagaatacacactagaaataggtacttacctcaatgctacagaaggacagaggcaaaactgcaaacagtgcttacctgttctcttgtccagaagttcagaatgggatcctcaatgctccgaagacaatctagcagttttaggcacctattttcacatagatcgacctgctaaacctaaagagtgttttattgcttagttcagacttgctgagggaaagaattgtattgttgagagaacaacaaaatagtcatttacagtatctgaccttgctctagagaggatttggggtgggttacaagactagattaaatatggcatgtaagatatatttaaaaatttctgtgaagaactttcattttcttcttggataataaaagttaatgatattctactttttaatacatttctgctatatattttgtatctctgtccatagtagagaaaacagtacctttatactttttccaaggctgaatattaatttgttacatgatagttaatccatcttaatgagaattagtagtgattaattcatcttaatgagaattgttactgactaagtacttcatcttaagtagaattattagtgactaaccagcttggatttctcattaggcattttttttttttttttttttttgagatggagtttcgctcttgttgcccaggctggagtgcaatggcgggatctcagctcccaggttcaagcgagtctcctgcctcagcctcctaagtagctgggattacaggcatgtgccaccatgcgcagctaattttgtatttttagcagagacagggtttgtccattttggtcaggctggtctcgaactcataatctaggtattcttttaatctagtacttcagtataggtgcacttatatttaagatgtgaggttttaaattaacaaatggctatctttctctattctatttctattcttagattaatgatacagataaatatagatgcagataaacacaggaaaacaatttatattttattaaaatatttaagtagaatttaaatatactgattcttttattcatttaacaaatatttatcaaggttttctgtgggtgagacactcaataccaagatgaattgcatgtggctattgccatcaaaagatggatatattacataaatgtataaagtaggaaacagtgggttatagagagttatagaaagtgttagagttgccaaaaactgtggaaaacataaaagggattaatgactgactcctgggcaagatacatgaagtacggtaacatctgtaatatagtaatatggagattagaaggaaaaggctatctaagaggaaggcatgcatgaacaaagataaggaagcatgaaagcatagtgttaaaaggaatagttgggaatttgttggaatgtagagtgcatgttggaagataaaatttgaaagataagttcacagttagatggttgctccctcattttcttgctccatttttataaattttatctccatctattagtttgatctgtttttttcttcttgtctcagataatttgatgttctgtttcaagaccattcacactaccatatcttctcatttaaaacctcctgtcattgattatctttctttcctgttttccttattcattccttgaactttcctttgacgttttatatttctcttactcagattttctcttcagaacaccctttttgggaaaattgtcacttggcaaataccttgcagtctgtctagaaagagccaaccactctgccctcagtctactctaaacatatgttttttggtacctatcacaatgcagtagttatcttttaacattttaacatttcccacctgattatgatcttactcatttgtttgttttcaattttgccttcttgttggtacataataggtccaataaatgttttgataaactggataagtgtattacgattagtttaatttggaaaaaattaaggttttgtctttaagtattagaagtaagagtggaaaatagaatgaaaattatagaaggaatgtagaagtagaataggctatatctgttaactgttttgacaaataatttatatgcttcagtcaggtaagaaggaagtctaattgtttcacagtccagggtgccagtagctggaagtcactgaaaaaggacatgcagaaaagtgggtagagtgggttcagtgttcagtctagcaaatttaaggtgccatcagaaattactacagaaatacatcatagatatttgacattttaggagtagagcttaggaaaataatcagggttgaagatagttttgaccattgttcatctataaaggacagtgttgtctcataactatagctaattagttttacaaatataaaaatatttatgaaatgtttattcttggctacagtgtgggttcaaaaattaagtataaaatattgctgaaatgtaaacaatgtaatattcaaatataaagattaaccatgtgacaaccaataattttgtcaccattttcttaaaactactcttctgcaatggcaaaaaaatccaaaattgacaaatgggatctaattaaactaaagagcttctgcacagcaaaagaaactatcatcagagggaacaggtaacctgcagaatggggagaaatttttgcagtctatccatctgacaaaggactaatatccagaatctacaaagaactgaaaaaaatttacaagaaaaaaacaacccatcaaaaagtaggtgaaggatatgaatagacacttctcaaaagaagacatttatgtggccaacaaatgtatgaaaaaaagctcatcattactggtcattagagaaatgcaaatcaaaacaacaacaagataccatctcacgccagttagaatggcaatcgttaaaaagtcaggacacaacagatgttggagaggatgtggagaaataggaatgcttttacacttttggtggtagtgtaaattagttcaagcattgtggaagacaatgtggtgattcctcaaggatctagaaccagaaataccatttgacccagcaatcccattactgggtatatacccaaagaactataataaatcattgtactataaagacagatacacacatatgtttattgcagcactgttcacaatagcaaagacttggaaccaacccaaatgcccatcaatgatagactggataaaggaaatgtggcacgtatacagcatgaaatactacgcagccatagaaaagaatgagttcatgtcctttgcagggacatgggtgaagctggaaaccattctcagcaaactagcacaggaacaaaaaaccaaacaccgcatgttctcactcataagtgggagttgaacaaggagaacacatggacacagggaggggaacatcactccctggggcctgttgtggggtgaggcgctaggggagggagagcattaggagaaatacctaatgtagatgatcgattgatggctgcagcaaaccactatggcatgtgtatacctctgtaacaaacctgcactttctgcatatgtatcccagaacctaaagtataattaaaacaaaaacactaaagcagaaaaaaaaataataaagtaaaatatcatactgatgtttaaaaaaaaacagcactgttccgcatctattgactacgttttaataacattaaatattgattgaaaactttcatttgattaatgttggaaagcttgcgattattttttcaatagtaattttttttagtttatgaattcagtcatggcatttatttccttttaggcccatgtatccagaaaagccaaattctttcagttatatatgcaagtcacagatgattctatgtggttttctttgcatatataactgatacgattcatgtatttttatatgaaaccatttataagtgtacttttaagatagtaagtttgtaagaaaaatattctcctcttaaaagtcaaacaacttgatgagcttccagaaagttaagatgatatctatttatctatcttttttttttttttttttttttgaggctctgtcgcccaggctggagtgcagtggcgcaatctcggctcactgtaagctctgcctcccgggttctctccattctcctgcctcagcctcctgagtagctgggactacaggcgcccatcaccatgcccggctaatttttttgtatttttagtagagacggggtttcaccgtcttagccaggatggtctcaatctcctgacctcgtgatacgcccgtctcggcctcccaaagtgctgggattacaggcatgagccaccgcgcctggccttatctatcttacttatatcgtaaaaagtatatgaaaatataaaaatgtactacaatattatgaaaggaggtaagtttgttattctaaagctgtaattatatagtttaatatgttttcctttaaaacattttaaactgtatcatttaatctcatgcagatcattcatttttctgaagccagaagatgagaactatcaaatgtgtgaaggaattgactttgaagagattataaaaaatgatggtgctcttctaaagaagaaatgtagatctaaaaacccttctaaggaatcatttctcattaatattgttccagaaaaagataatttaacatctctatcagtgtattcagaagatggttgggatttaccatacataatgcatttgtggccacctatcctgctccgaaatcttcttccttacaaaattgcttattatatagaggtatcggcaaactgatttagtgccttcctgtttttgattttgtagtttcagttttttaagattaagatcaataaaaactattttaaagatctaataaaaattagaatactagtaaagaataggtaatgcagatattcttttgcaacaagtatgagaattattattgaaataacatttaagaactagacttcagtgacaaaaaagcatgctacattatgttgtattcttttagtgctgattttcttaaaagattgtatactttgtgaagttgctttttttctttcatactctgtgtggtttcttcctgttgttataggaatccatacatcttaagattttatgtaaatatttcatttgcagtgcttatcaaatggaagaaagtagttcttcattgtcatctattataggtttattttacttttagaattaccatttgctttttaaaaaaatttttttgagactaggtttctctctgttgctcagactggagtgcaatgatgcgatcatagctcactgtagtctcaaacttctaggctcaagtgatccttccacctcagccccccgagtagctgggactacaggtgcatgccatgcctggataatattttttaatttttaattttgtagggacagggactcactatggcttgtcttgaactcttgggctcaagtgatcctcccgcttcggcctcccaaagtgctggaattacaggcatgagccagtacacccagccgtttacacttttctgatacatgtctcttttggaggaaaaagttaacatatttatggttttaaatgtgtatttccatattgaataacaaattatcatagtggttaagaatttgtactttgctgtcaggtagatttgaaattgcatcctagctctgtcatttgctagctgtatgttcttaagcaggctttattgcttttctaaatcttttgctgtggtctgtaaaatgagaataataataaaatttgcttggttaagacatgggggaaatcaaattagattgtgtatgtaaaggatttggtacagtgcctcccagacacagggttgccatttatttatcactctagcactaccaccaccattgttattttgtggaatattatttaacttgtaaagaatcaagaactccttacttttgctttaattaatttaaaatcatgagatgaagagattcctatattataataataggaaaagaataggatagagatgctggaaaaactggtgagatattcagatgtactgtcaatttatatttctgttctcatagaacttttaattggatgctgttagtgatcacattctgtctgccagtttccaaagggtgtgatcagtttttagaaagacaattgagccatggtgtggggaagggactagaggggacaagagcggttaggggactcttaaactgagacgtcatatagtgacatgaactaagataatagaagggagggtcgagggaaatgagcagtttggagagatacatatgacgtaataatataaacagtgattggaaatgggtgatgagggattgtggaggtagtagggattacttattttggattaccatcagtttttgcccacattttacgttgttttgtagttttcaaaataaaaatcacgagtggttaagattgtctttttgtcgttgttttaccaattatagtgttttatgtttataatttccaggggagtttcccattatgttatttaatcttcacagtttgtcctttgaagtaagtcatttagaccattttacaaatacagtagctcaaatctcagattaaataccgtgtagaggtttacacagttgacaaagttagaacttgaatgtaagtcttctgacttgttctgataggtatttcaaaagcattttttgcagcatttggaatacataaatagaattttgaggcatattattctgcaacattttaaattttgttttgttttttttttttttattacagggaattgaaaattcggtttttactctaagtgaaggacattcagcccagatttgtactgcacagttgggtaaagccaggctacatttaaaattacttgactatctcaatcacgattggaaaagtgaatatcacataaagcctaatcagcaagacattagttttgtcagttttacttgtgttacagaaatggaaaagactgatttagatattgctgtccatatgacttacaatactggtcagacagttgtggcatttcatagtccttattggatggtcaataaaactggccgcatgttacagtacaaagcagacggaattcatcgaaagcatccacctaattataaaaagccagttctcttttcttttcagccaaatcacttttttaataacaataaggtatgcgatgtttattctgtttttcccttgtctttagctacttgtcactttttagtttttaaagttctgagtaataaatattatgaaacttggatagaaataacttgttaaatatttgaggccaaaaagattagaatttaatattataaaggtttagtgcattaacaatataatattttgtttatgctaaaaagtaatttatcagtttaagcaggaatttttaaaggtacctaaattgtgatgtatttggaatatttttttcctaggttcaacttatggtaactgatagtgagttgtccaatcagttttcaattgatactgttggtagtcatggagctgttaaatgtaaaggcctgaaaatggactatcaagtgagttcattctatgcttatcaagaaacttttattttaaatgtttctattaactacttaattaaattttataaagatgttatacataacagtttttgagctgttaatttttttttcttaggttggtgtcactatagacctgagcagttttaacattactagaattgtgacatttacccctttttatatgattaaaaacaaaagcaaataccatatatcagtggctgaagaaggaaatgataaatggctctctcttgatttggagcaggtgggtagatgaatttcaaaaatatacctctttggattctattttctccttgaagttagatacctaaagtcaccatgtaatgttttaactctccccttactccaattttgttttagtttcatgaatctttattgaatatttgtgccctgctctagatagatgggaaggttcaatttttaataattaggtaactaggaatgcccagcttgttaagggaggtagacgtttaacaattactaaccactttggttaaataaagcagccaaagactagataagatgtaaatgcaccaaagagaaggaaattacttattctctctaggaagctattaggaatgctttcagagagtagggtaagccagactcttcttcaagttatttgaggagagtagtaacttagaagtgaaattttgattttgtgccatcattaaatctttgaataagagttttctgaatgactgacagaggttgatggaatattttatttttgaagaacttttattctaaaagttaggattagagaagtttttgctgtttctattcattattcctttttgcatacaaaaccgtccttgttgggattattcttgaagtatattctttagaatttcttttagagctggttttgaaggtaaataccatcagtgtctctagaaaaatctctctggcgggagggacaatgatcgggatataaacccaggcgttccagggggcaacggcaaccccctttaggtcccctcccatttatgggagctctgttttcactgtattaaatcttgcaattgcaaaaaagaaaaaaaagaaagaaaaatctctctggctgccttcagtcttctctttgtctttgatgttctgcagtcacactgctatatgtctatatgtggtttactttttatttacccttcttgaggtgctttacccctagatctgtggattaatgtatttcatgctttctgtaaaatttgctactattgtttctttaaatattgcctctcctccattcttccgtttttttccatctaagccgttaaatcagacatgttggacattcatactctatcctccatgtctcttaatagctcttttatattttccaactctctttgcttcattctgagtaagttctacatggacatctttcctttttttttttttttttttttttttttttgcttttgctgtgtctgaactactatttaagtcttcaactgagtatttgaataattatagttcttattcccagaaatttcaccttttttcaagtatattcattctttcaacaaatattgtttattttttatgtgacttgcaatataatagttaaagccacagtagttaaagcccatctttatgtagtttacgttttagtgggtataaggggaaacattaataataccgtaatcaattagtatatagtatgtttcaaagtgacaagtctaatgtgggaaagtctgatgtaggataagggacattgagagttcaagagccaggggtggtctctaattttatgtaaggtagttaggatgggactcattggagtgacatttgaacagtgccttcgaggaaatgagaaagttagcaattgtcgagagctcagctgaggaggagagagctgagctgccaggtgtcggaatagctgattaacacaaaccacaatgaaagtaacagtcaaacctttaatcacttactgtgatagtacagattgagcatccttaatctgaaaatacgaaatcaaaaatgctccaaaattcgaaatattccaaaatccagaacttttcaagtgccaccatgatgccacaagtgaaaaattctacacctgacactttatgtttttcactttcttaactgtcatttttttttttttactgttaagtacttatgtgtgaataagtgtaagaaaatgattgtttattggtaacacaaattgagagtcagaaatgatggtgatgccacacaaccacagattgtcaacatgggtggttgagatagtgacacattctctttctgatggtccaatatgtacaagttttgtttcatgcacaaaattatttaaatattgtataaaattacttttgggctatgtgtataaggtgtatgtgaaacataaatgaattttatgtttagagttagataccatccccaagatatctcatcatatatatgcaaatattccaaaatccaaaagaagtccagaatgtgaaacacttctggtaccaagcatctcgaataggggatactcaacctgtgtaagcaggaggctaaatcagagaaagcacaattaccacctgtgctggaatggcactggacaagggttaggtggatcagcacaaacatggggattgtctcaccgtctaggaaaccttgaacaaagtgtccggcagttttatggacctgggggatggagtaggacaaagcggaggagctaggaatggaaatatgctgagcactgagagtagacaaaaagtgtcttcactttttgtgaagtgactatacccttgttttaaactgatcatctgtgttccagttctcagctcaggcgctccctttcccccgataaagaggtcctgcaggagctctcaaggaaggcctctgccaaaaagctctcataaagagcttccgaatgaagtgcctgggctaggaatgcagacatggataaaagctttgggacagggttgcttgaatccttaagactgcagtgccctggctgtgcgcaaagtcaggttatattcctaagcatgtctcatatctagttccattaattccattttatggttgaataaaactgtctttaacaagctaagacacttagctctaacaaccaggttctgctacattgtcctcaagtcatgtgatgatgatcaggtatcacacatgagcagtctcactgaaatatatgaagggatcagtctggtcagggcctaagatggagttgacttaatagcttacagacaaggctggttcttcattctttttcttttagctctgtttccagattcttttgtccagtcttctctgtagtaccttgactatctcctattcttttagtttggtttccagatcactcacgttgaagttatttcgtacaattctgagcttctttcctactctgaactttgaatactacttttacttttttacccttatttgacaaccagatgctagatttaatacttgttttgcgtactttgatttctgcctaatttccagataatgttcatacctgattttgatttttagtaactgaatgtacacttgttttaagcctgatcatctgtgtcccagttctcagctcaggtttcttgctgatttttcaacccttctctgtaagatcatgaccacattaaagtctcttttctcgccagcagttcacttaccatagctcttcaatttgctatccactgcttcttgaatgcatagtgctgacaagtgacaatccatcttcaagttgaaagtttacagctgtttaaacaacccaataactagagcagtgttaaaacaggtttttttatagtttaagtctattctgatgggaatattaagatgatttatatatttatggtgaaatctgtttatttttataaacatatataatgtatattttagtgtatccccttttggcctgagtatgcttctagtaaacttcttattcaagtcgaaaggagtgaagatcctcccaaaaggatatattttaacaagcaggaaaattgtattctattgcgtctagataacgaggtaagtttttttttcttttttgcatgtgtcattaggaaagctaaaatatactgactagtattgtatttattttttgtatcaaataattacttctgttgatttttcccctttccccaaaaacgaacaaacatttctttttgtagaaggaaacagagatctaagataatttaattgttaaataaaaagttagttggggccgggtgcggtggctcacgcctgtaacaccagcactttgggaggccgaggcaggcggatcaggaggtcaggagattgagaccatcctggctaacacggtgaaaccctgtctctactaaagaaatagaaaaaattagccgggcgtggtggcgggtgcctgtagtcccagctactcgggaggctgaggcaggagaatggtgtgaacccgggaggtggagcttgcagtgagccgagatcgcgccactgcactccagcctaggcgacagagcaagactccgtctcaagaaaaaaaaaaaaaagttagttggaatgcctggaatactagaatataccacatctggaatgtcacctatctgtaatacagtgattgagattatagatttccagaaatgcagtacaaaattctgaattgttttctcagtcatcccaaaaattaaattatcaagttatgaatagtctgttcttaaatgttattagttaatattcttgggaaaatgattacattaaaatgttttctttttctttcttctagcttggaggtattatagcagaagtgaatttggccgagcattctacagttattacatttttagattatcatgatggagcagctacattcctcttaataaatcacacaaagaatgaacttgttcaatacaatcaaaggtaagattatcacaaatacagtaactcttgatggtgtaagtctagatgatgaggcacagttttttttgataatttcttaagagtataaacactgataatagcattgtagctgtgtaaaacagtgttccattaaaaaatgtacttgaagcatgtaggggtaaaactgacttgatgtctacaatttattttgaaatgcttcaaagaaagaaaaatggaagagctgaagcaagtgtggcaaaagcttgttcattgttgactctgatgaggagtctgtcagagtttgttaggagtctctgaattttgtctatttttgaattttttcatgtgtttaatatagtgtaaatatgtaaaatttcagatttttttttcaaacagtaggtaccctcttgttgagctgtcttggggaaaggactgcttccttaaaggctataattgaatcttcatggtttaggactactcttcaacattattcattttatttgctgttatatcttcttagtgccactacaggttatgcaagtttctgatcctctacttagtagttccaggctgtcttgaatttattttgtttcctttctttctttcttttcacctgttacttttcaacaagcacatatttatcattgcacttccactttccttccactgctaactgtacaacttctaatcattgattaaaatcaaacagacattgagtagggaccacagggctggactagcaagtacctaaaactcgtttggggtagcattctctcatctatttaagatgttaagaaagagggatgcctgttttttttaattatccatattataaaaataataagttgtttctaaacatgtgtgcaagtgtctttttaatataatgacttctcttcctttgagaagatacccagtactgggattgctggatcaaatgatagttctgcttttagttctttaaggaatctccatactgtttttcatagtgtttgtactagtttacattcccaccagcagtgtgaaagtgttcccttttcaccacatccatgttaacatctatttttttttaatttaaattatgatcatttttgcaggagtaaggtggtatctcattgtggttttaatttgcatttccctcataattagtgatgctgagcttctttttatatgtttcttggccacttgtatatcttcttttgagaattgtctattcatgtccttagcccacttttgatgggattattgtgtttttgtttttgttttcttgctgatttgtttgagatccttacagattctggatattagtcctttgtcggatgcatagtttgcaaatattttctcccattctgtgcgttgtctctttactctgctgattattccttttgctgtgcagtagctttttagtttaattaggtcccatctatttttattttgttgcatttgcttttgggttcttggtcatgaactctttgccaaagccagtgtctagaagagtttttccagtattatcttctagaatttttatggtttcaggttctacatttaagtctttgatcgatcttgagttgatttttgtataaggtgagagatgagaatccaattttattcttctacatgtggcttgcccacgatcccagtaccatttgaataggagatagtcaaagtaccagaaagaagactggacaaaagaatctggaaacaaaagagctaaaagaacaagagtgaagaaccagccttgtctgtaaaccattaagtcaactctatcttaggccctggccagactggtctcttcacatctagtcccttcactagaataaggtgtcctttccctacttcatgtttttgtttgttttgttgaagataattggctgtaagtatttggctttatttctggtttctctattctgttccattggtctgcatgcctatttttataccagtaccatgctgttttggtgactataggcattgtagtatactttgaagtaggataacgtgatgcccccaggtttgttctttttgcttagtattgctttggctatgagggctccttttatggttccatataaatttcaggattttttttctagttctgtgaagaatgttgatggtatttttatgggaattgcattgaatctgtagattgcttatggcagtatggtcattttcataatattgaatctaccatccatgagcatgagatgtgtttccatttgtttgttaaatttaaacttttaaataaatattcccttcttatgtaatctcccctgccattatcctagttcagtaaccctccatttcttatctatttgagtagatttttatgcgttgttttgttttatttgagtagatttttcttttttgttttgttttgagacagtgtctcaatctgttgcccaggctggagtgcagtggtgcgatccaggctcactgcagcctccaccttccaggctcaagtgattctcatgcctcagccttccaagtagctgggtttacaggcatgtgccaccatgcctaactacatttgagtagattttttatctatctctatatatctagtcttatctttagtaaatctcccattttccactagaatgagttttctaaaataagaaatataatcatatctctctagtttaaagtttttctttttttacccatttctttaaaaatatacttctaggctgcctttctaaacatttatctttccgtggcctaaatcttaccctatacaaagtgaagtttttttttttcctgaatgctctgggtctttccatgtgtttttacctgaataggtgtttctttcagctagaaaaatgccattctgtaattattaaaaaatcaagaaacaacagatgatggcaaggctgtggagaaataggaacgcttttacactgttgctggaagtgttaattagttcaaccattgtggaagacagtgtggtgattcctcaaagacctagaacccaaaataccatttgacccagcagtccccttcctgggtatgtactcaaaggaatagaaatcattctcttataaagatagatgcacacacatgttcaccgcagcactattcacaatagcaaagacatggaatcaacccaaatgcccatcaacgatagactggatgaagaaaatgtggtacatatacaccatggatactatgcagccgtaaaaaggaacgagatcattcctttgcaaggacatggatggagctagaagctattatcctcagcaacaagaacagaaaaccaaacaccgcatgtccctgcttataagtgggagctgaacaatgagaacacatggacacagggaggggaacaacgcacactggggcctgttgggggcatggtggcagggagaacatcaggataaatagctaatgcatgtggggcttaatacttaggtgtaggttggtaggtgcagcaaaccaccatggaatacatttacctatgtaacaaatctgcacgttctgcacgtgtattctggaacttaaatttaggaaaaaaaaaaagaaaaatgccattctatgtgatcccttcccttgccaccttaatctatgtaccccagtttttgatagcacctttacatatgtagattgcagcattcgtcacattgtgttactttcttgtgagtttgagacatgtacacacagatagtgaatagtctgaggactatggttagtttcccttttcttggaattttcattgcctgtcccaggtagtccagtacgtttttgcataaggaatactctgcaatgaattaaacagattaaaatttgtatgaattaagagcatttttaaatatttttaaaccaaatttatttgataatcaacacatttacatttgattttttttttcatggaaaaatgaagagtatgattttgttttctcctccacatttccttctcttggcttttaaaaaaatatggatgttatttcctgcatataaaagtaatagttgttaaattactgttttaaaaaatactacagaaaaaatgtgaaagaggaccataatccctgtaatccaaatactgtcaacattttggttcattgcttttcctttcctttcctccctcctttgttctctccctccctccctttcttccttccttatgtatctctcacatttgacagctattgtgagcatatcaatttgcttcaaagcacaatttttttttctttctaacttttattataggttcaggggttacatgtgcaggtttgttacatgggtaaattgcatgtcacggggttttggtatacagattgtttcattacccaggtaataagcatgatacccaataggtagtttttcgattctcaccctccttttactctccacccccaaataggttcccgatgtcagttgttccttctttgtgtccctgcaaagcatgatttttactgaatgcgtgatattctatcatttagatgctctacaattaaataaatacttaattgttcagaatttttatttcaacttttataattttagaatcagtttatcttctttttttgttgttgtttatttgttttttgagatggaattttgttgttttgcccaggctggagtgcagaggcgcgatctcagctcactgaaacctctgcctcccaggttcaagcgattctactgcctcagcctcctgaatagctgggattacaggtgcgcgccactatgcccggctaattttcatatttatagtagagacagggtttcaccatgttggccaggctggtctcaaactgctgacctcaggtgatccacctgcctcgacctccgaaagtgctgggattacaggcatgaaccaccgcgcccagcccagtttatcttctaataacgatcctcaacccatttgtaatcattgtaataactagtttataattccttaccatatttttttgtagtatattgtcttctaatgattttttggaaaatacatattctgtttcggttatggataattccttttttgttattgaaggtttcgatacatttaaaatcaattttaagattgaaacagtatctgctagcttacccataaaaaattgtaatgcttttttaccttttcttcaacctctttccaaattcttactttcttgtgaatataatttggtatgttttcaaacagattaatataaaatggttagcttttcaaaatatgtattatttcattcaaggcccttttggtatttgcattgattttaatgttttaacaaaaaaatgactttcttaaactggtttaattgttcactacaggttcctcaatatttctatatcctagttgttaaaatgttgttctgagttcatctctagcttggttggaaaaagtctgagttatttttttagtaaagatttgtggatagtgttatgctattgcttgttcgaaatgtcttattcttacaaatttatgacaatttgacataaaattttaagtgataacgtttttctcaaaattgtataggtattgtgccattgttttttgatattaaacatcattgaactgtgagagtaacatttttattttcttgcgagtgactatgattttcctagatatgtgttagggttttttcccccctattttcttacaaagatatgtctagaatgatactgttttcatttatgtctgatacccagtgaagtcttttaaatctgcagagttaattccttcttctactcagaagagctatattttattacttgtttggtttataacttttgtaatgtttttttctttctgagcatctttttgtgagtcaactgaatttcttagatgtgtatttcatgttttgtgattttaaagaataatttagttactttgtttttgctctagtaagaccaatacttaggaaagagttaccaattaaattatcttagaattggtataaatagggtaaaatagttggaataattttccataattaatttgtattaaaaaattgacaaaacagttttaaagacttgaagacctttatttcctaagtagaacatgtattttctaagtgggaaaataatgagaaatattcattagtgaacccttttttaattgtataaggtaagaatttcagccttgttttaatcagaacgatcacagatctcagtgaactaagaattaatgaagtattattttagtttttttttaatctcttcgtgtacttgcatttaatttaacgcgtatttttgctactgtgtcagttctctcagtgaaatagaagattccctccctcctggtaaagccgtgttttatacatgggctgatccggtgggctctagaaggctgaagtggagatgtagaaaaagccatggtgaagtaacacagaaggatgtaagtattgggttattatggtgttcccagcagccttttttaaaaaaggtatttgggccgggtgcggtggctcacgcctgtaatcccagcacttttgggaggctgaggtgggccatgagttggagatcagcctggccaataaggtgaaaccctgtctctcctaaaaatacaaaattcactttgggaggccaaggcaggcggatcaccaggtcaggagtttgtgaccagcctggccaatatggtgaaactccgtctctactaaaaatacaaaaattagcctcgcatggtggcgggtgcctgtagtcctagctactaaggaggctgaggcagaagaatcgcttgaacccgggaggcagcgattgcagtgagccaagatcacgccactgcactccagcctggcgacagagcaagactccgtctcaaaaaaaacaaacaaaaaacaacagtatttgattttcagccttcctagttttaaggactttttgtggccacacttctgaaaaactgccaaacgtcttcaaaatagtattcaagtatttacttaaccaaaaatgtttaaaaccaaaagtagtcttattttgtttacatcatttgcttctactgtgttataaagaataaagttgtgtttagagaagtgctttcagcattcacctgaaaaacaaatatgttctctgcattgacaatcatactaggtagatttagcttctgtaaggaacatttaaggatccactgagtgaactaaaacaaacttatttctgagtggcaagctatgatgataaagttatgcacatatattttctggtaacattttaaatactttcagaaaatttttaaaagtttttaatccttcaagattcatcttaatttgactcctgatgtttttttttcttaccactggtgattttttcttcctgcttatcagtaggtggtattttctcattgtctttcagtgctgctgttgaggagtctgctgtgggtattgtttacattgtatttaagaggattgcctataagtggcctttcagttttaaaaattcattactattagatttattcaggaaaaaaaattgtactttgatataaaaagtcttattcatttgatctgttgattagtactttgcatatttatatcatagtgatagtttgaagcttataaagataaatcagacattcactgtaaaatattagaaagacttcagtgaaataagttagtcttcttgattctcaatgtggttttagtgatatacatatatatacttagaaagtattacaagtaaggtaagtatccccagataattattttatggtaacaactcacagtttttaatttctgtatattgcaacgtgaaggtatactatatagtaaaattttctgaaaatcagaatattaactagaaattaatggctgaatattaattatgagaatttgctatgtttatcttgtcattgaccctcaaaaccctgatatcagcacatttatgtgagattcctgcagaaatagcctcatgatgaatatacatgctttgtagaacatacaattgagatacaagatattttttatcctgtttgattcagctatgaaaggaaatgtgaatttcaaactgaaacaacttttaatacatatcacattgctgtagtcttagaataaagcagaaaaaaatactttgtgttacagattagcctacgtgggaaggttcaattttattaaaatgtttaaattaaaaaagtaaacaattggcctgtctttatgagtaataattttataacagataacatcaaatgatttcaataatgtaaatttgcaagtattctacaaatattaattcatttagttgccactaaccccatgaagtaggtgccattaatagtctcattttataaatgtgaaatctaaatttcatgttctttgggaccaaattctaattttttggtttttttttttttttggtggttttattctaggatatgatgatgcctatagatttgggggaaaagacaatatatttagtttcattctttgaaggtttacaacgcattattttattcactgaagatccaagggtatttaaagtaacatatgaaagtgagaaagcagagttagcagagcaagaaattgcagtggcattacaagatgttggaatttctcttgtcaacaattacacgaagcaagaagtagcctatataggcattacaaggttagatgcattaaattttggatacatttaaatgatcagtttctaattgttaagaaattgttattgtaaaatctcaaatgatttagtttcagttttgtgctttgactattcattgatactgtggtagtgctagttttaaatgtgcttgagggaattttttgccttttgaaataaagatatggcagaaatcaaatttataaactccttattatgttaatccttccacttatctaaaaagttatatttattcaacttgccaaaagtatgttttgcatatcatacaaaatgcttagttcattttccattaccatctagcacagttcagggtacatatgctgtagctgttggaggattaacatagacaatcactttctaatttgaccttggcactttaagatctaataagatctaataaggtgatcactgtatttatcatttctcgtataagacatcaccattaaatcttttatctctcccttatgtccttattattcctattcataaacagttgttttaatttacatatattagtgcttaatgtgagaatatttcttctgtataaccaggataatgtaattttaatccttttcttgaattaaattcttgaatatatataaaggtatatgatacagatgtaaatttagttttctatgtacattaatctatacgtgtccctgacctcttattgaattgaatcaatgccattttaaaaggaatattaaaatctatattcttaagaatttttattctcaaaaaatgtttttactatttaaatagatcaaatacaccatagatttttaagacctttagacctattatatgttatcttctaagctaagtgatgttaatgcaaagatgaataatacatggtctctacctttctgtttcttaaatgaatataagttctataaggaataaacaaatagaatgctttaataaaattaaacaacttaaatatttaagtaacatatgaaagtaacatatgaaagtgagaaagcagagttagcagagcaagaaattgcagtggcgcactctatatcctagataactattttatacttgtctccccttaaacccccattgtgtcagcttactaccttgcattccacttcactgaaaaaattgaacccatcaaaagcaaacttccagagacccatctcaccccccaatatcacagcttgctatctaccagcgtttgcatactacttgctgtactgacatactctcaacagtttacagtagatatatgtgctcctgtttaaacagatttttctctacttttgcactgtacttcatttcctcttacctacttgaggacattgttccagcagtcctcttcttcatctctcctaagtcaacagcttttgggtctctactgaattgtttcagtgttacttctctcaacataaaaaattctcttgagcctactttccttgctacctgttgctcatttctttctttgcatttataaccaaacacctcaaatgtactgtctgtttcaaaggaacttaacatatcctgtgttctccaactatttttcatccattttctctttaaccactccaaacagggttttgctttcaacacaccatgaaactggttttgtcagcattaccagtgacctccataatgccatatccagtgtagaattatcggtctttacttaataacatttaacacagatccctccttgatgtagtttctttcacgtgacttccagaatacctcaccatcttggtttttcttcctatccagtctcattcattggttccttgtcttctctcaactgcttacattggctaaatgccttgaggctcttagacctggtccttttctcttgtggatttcagttttatgatttcaaatactgcccagaatttctctcttaggtatgtcttctgtcacacctgtcatctgaccttaagacttcatatatccaactgtgcatgcaaaatctctattcagatatctaagagacttcttaaacttcatatgtgtacactaaaccttttatttcctccttctaccaaaactccagctttccaatcagagttaataaaaaatagctccttctagttatgcagcccaaaaatattgaaattgtcttcgattcctctctttatcttacaccccagacctaattcatcaagaagatctgtgctggttctaccttcaaagtgcacatagatctgaccacttttctagtatctcactgttaatagcctcatcagggccatcaccatttttcaactggcttactgtagtacactaacaagttttcctgcttctaatcttgactccactcttttttctttccatccacttcaacacagagtgtattcttaacgaaatgtaagtcagattatgttgttagttgtcttataaccgatcagtggtatctcatctcactcagaataaaactcagagtctacagtggtctacaatgctttacattatttggccccccactataagtcttactttattttctattcctaatgtgttcctgacatgccagcctccttgctcttcttcatatactgcaagtgtgcctcctgctttagctggcctctctacctgaaatgttttcctcctcttgtctgctggataattctctcagctcatttaaggttgccaaaatctcactttctcaatgaatcccccattgaccactctaatattgaagaccccaccactttacatattgcagttctccggatcccccttgccttgtctacattttcttctttcaaaagcattttcacctcctacatattaaattttactaatttattttgtttactatttattttcactcccccactaaaatgaagctccagaatgacagagatgttcactgataacggctgtaacacctagaatagtgcctcagtagtagcttaataggtagtagttgaatgaattcatgtttttaaatttgtaatatgctcacttgtaattgaggctgttctgaaattttagtgaaggtattgtaattcatgtaataaaccagttaaaataaatgttaataacttagtattaaatactatgatttttgctttcttaaataagttctgatgtggtttgggaaacaaagcccaagaagaaggcaagatggaagccaatgagtgtaaagcacactgagaagttagagagagaatttaaggaatatactgaatcttctccttcagaagataaggttattcagttggacactaatgttccggtaatatttttaagtactgatgtgaagttttaattttttgcctgtcgtagtttggtgaatcactagtgaaatttaaggaaagtttggcttccttataaaacaaaataatcctgtcatacataccttgtataaaatgttttaaagaggtgtttatctatattaagaaatcaggctgggcgcagtggttcacacctgtaatcccagcactttgggaggctgaggcaggcggattacttgaggtcaggagttcgagaccagcctggccaacatggcaaaccctgtctctgctaaaaatacaaaaattagccaggcatggtggcaggcgcctgtaatccccgctattcaggaggctgaggcatgagaatgccttgaacccaggaggtggaggttgcagtgaaccaagatggccccactgcgctccagcctggctgacagcaagactctgtctcaaaaaaaaaaaaaaaaaaaaaaaaaagaaaagaaaactttcttttaagatactagatgctaatgatctgttctttgggttagcaggaaacttaaaaatgttttattttttcactgtactttctttaaatattttatttttcctttattcatttttattgtggtaaattttagtacatttatgtaaaaagtaatgcagtgaagctttgtaagaattatatgaatatgtgaattttatggacatgggatattaagatctaaatctaaactaatacaaatatgtagcttactgttttaaaaagtttttggcattaatttctaattctagtcatttatagataaattaattttttcatttggggggacatatttttcaggttcgcctaacccctactggtcataacatgaaaattctgcagccgcatgtaatagctctacgaagaaattatcttccagcattaaaagtggaatataacacatctgcacatcaatcatcatttagaattcagatttacagaatacaggtaagtctttctgaaaatataggcaaaattgtattctaaaggaatgcaataagaaaccagatctattcccatggtctgctttatctagtattcagtttcaatgttgtgctagcctttttttttttttttttttttgagacagagtctccctctgtcgcccaggctagagtgcagtggcggaatctcagctcactgcaaaccctgcctcccaggttcaagcgattctgctgcctcagcctcctgagtagctgggattacaggtgcccaccaccatggccacctaatttttgtatttttagtagagacggggtttcaccatgtgggccaggctggtctcaaactcctgaccccagatgatccacccgcctcggcctcccaaagtgctgggattacaggcgtgagccaccgtgcttggtcaccgctagactttttgattctttttgttcctcaaatcctgttattctggtcaggttgtataattgacatattaatatactgatgtgtttttattttcttagatccaaaatcagatacatggtgctgtatttccctttgtgttttatcctgttaaacctccaaagtcggtcaccatggattcaggtttgtttttatttttagatttccataaaagcagttgtattagctatttgatttactttactataaaaatatgaagtgaaaccattcttgggtttaatttttataggataattggaaaattaaactgcttgaaaaaggaccagcaagtactatacacaactaactttgataagattttgagtgaatcttgaagaaaagattgattagaaacatatattgaaatttttagaaatactaatttaaaaagcagataatctgtaaacctgcgatttaaaaacctttaaagcctttgaatgaacaataaggaagttcaaatctagagtgttttctaacagcagaaactgtcctatgttctccaaataagaataacggacaagtcctttctacccttttctttccctttgcctttcttgtttcctgcatatccctcttccccctactttctcttccctcctcactaccctacttaactttcttctccccttgctttcccacctccaccccacaccacttcttctaaactatcctggggggagtactctttataactcgctcagaagctttttggccagtataatgcgtaagcccttccacctagaggtctggagcaagtccccagaatctgttttcacaaagtttccctgatgattctaatgcatacttctaaactgctaattgtagaattagttatcttcagagtaactatagatagttttaaaaacaatgctagagtctgaaattaagattgtagtagattttgccaatatcagtaattttaactgatatttattatttagtaaatgatttaattttccattgtggtgtatattggaagaaaatgcctagcttttgcttaaagcatcatgggagtaattatatttataacctttacagcaccaaagccctttacagatgtcagtattgtcatgagatctgcaggacattcccagatatcacgtattaagtaagtgtcttaatacatttcttgtatatttatttaatgtttgatttaaatatatgaattgtttgtactctttaaatgttggacaagtcaaagatttaagcataaaatattaattataaacgtcaaataaaaaaatataatgttgtggctcacgcctgtaatgccagcactttgggagacctagacaggctgatcacttgaggtcgggagttcgagaccaacctggccaacacggtgaaaccccaactctactaaaaatacaaaaattagccaggcgtggtggcacgtgcccagagtcccaactactcaggaggctgaggcacgagaatcgcttgaacccaggaggcagagcttgcagttagctgagatcacaccactgcactccagcctgggtgacagagcaagactgtctcaaaaaaaaaaaaaaaaaggcggctctggatgaaatacatctaggtatttataatcattgtttctggattttggatattttattattctcttgtacttgtatttgttttttgtttggggttgtctataatcatatattgttttgaaaaaggaaaacaataatattttcgtcttcactcactacccattccaagaaacagaagatggactgaaacatctatgtaataatctcctgtctaatttcccttaccttgtcaccaagataacctatctttatttccttgctgtttaaaatatagttttattgttcatgtgtacctaaacattatgccttttagttttaatttttttctaatttttagaaaattgtttcaggccggaaatagatgttgggacttgcttttgttcattcaacatttttattaaaatttattcattttgttgtatgtagccatagtttattcattatcactaatatataatattctgttttatgactctgtatgacagtttacttatctggttcctctttatggccattttcatattttgactttgttgctgttattaacagtgttccatgattttttaaaatttagtcaactaaatagtcctaagtttcaaagttctaatattgatctcatacttttttctcatctaatttttgtaatacagttgttaattgatgatttttaaaaaatgttttctactttgtaatacaggtatttcaaagtattgattcaagaaatggatctcaggttagatcttgggtttatctatgctttaacagaccttatgacagaagctgaggtgactgaaaatacagaggtaagacttaaaataataacatttgatggaaaggattagggaaaagatattattataaatttttaaaggtattaaaatgactttgttgcattttaaaaatacaattaaataaattttattactctcttgtggtacatacctttttagaaatcttattttctgatgatagaaaattagcaaacaggaggaaaggcttggggtgaatagcagggagaaaaggataatttgtcatgttcacatcacttttttcctcttttattttcctggattactttggctttgctttcactttaataatttagaaatttagggtatgtccaggatatttaatgggagaaaggataggaaaattaaaaggtggtatcatctgggtgactggaagaccataaaatcatagttataaagtgggtcagatatagtctgtttttcacttgccctcatagattcatggatggagaaagagcaaattagtaacagtctattgaggtatagatcacataccatacatttcacccatttaaaagatagggttcaatgacttttaatgtattcacaaagttgtacaatcatcatcactctctaattccggaacattttcatcatccccaaaaggaactgcctgtgcagccactgatacactttgtgtctttaggtttgcctattctgaatatttcatacaaatagaatcatacactgtgtagtcttttgtgaagggcttctttgacttagaataatgctttcaaggtgcatctatgttgtagcatgtatcagtacttcattcctttttatggttaagtgatattccattatatggatgggccacattttgtttatccatatatctgttaatggacgtttgggttgtttacacattttggcttttatggataatgtaatgaatactggtgtacaagtttttattggacaaaaactttattaaaagtcttaaactatttaaacttaatcaccatgtgattaagcaattccaatcctaggtatatagccaaaagaaataaaattttattagaagtggaattgctcaatcacatagtaaccttatatttaatcatttgggactgttaggcagttgtgcaaagtgcctccaccattttacattcttaccagagcatatgagggctctgatttttccatattatccccaacacttgttactatctgtctttgattctagcaatcataatgggtgaatgtgaaatagtttgtcattgtggttttgacatgtaattacctgatgactaatgatgttgagcatctttgatatgttgattatcctttaatatgttaagtagttaatttgcatatcttatgtgaagaaatgtccattcagatcctttgcttattatttaatgagttatttgtcttttttcttataaaagttatttgcatattctcgatacaggtctcttatcagatacataattttcaaatattttctctcattctgtgtgttgctttttcactttcttgatgttgtctattgaaaatcaaaagttaaagttaatgaagttcaaattattttttattttgttgctcatgcttttggtgtcatttctaagaatccttagccaaatccaaggtcatgaatatcttacgttttacgaattttaaagatctagctcttatgattaggtctttgatcaatttttagttcatttttgtatatgatgtataaggatccaaattattctttggcatgttgctatccagttgtcctattaccatttctttaaaagactatttgttctttgaatggtcttgacaccctagttgaaaatcagttaacaacacacatgtgattttattccgtcgatctgtgcatctgcccttgtgcattgcacactgtcttagttattgttttgtattaagttttgaaattgggacatatgtatcttcctactttgtccttctttttcaagatgggtttggctgttctgagtcctttgaaatttcatatgaattttagaatcaacttgtcaggttcttcaaagaagtcagctggacatctgatagagactgcattgaatctgtaaatcaatttgggaagtattgccatcctaacagtattaggtctttcagtccttgcacatgacatgtttatccatttatgtagatttttaattttttttaacaatgttttgttgtttttcagagtgtaagttttacacatttttcattaaatttattcctatgtattatattcttcttatagtattatgaataaaattgattttttaattccatttttggattgttcattgctactgtataaaaatgcagttgatttttttatactgatcttgtattttgcacccctactgaattgttagctctatttgttgttccgtatattcttttgggatttctatacataagatcgtgtcatctgagaggagaggtagttttacttcattctttctgatctgaatgcctttgtttcttcttcttccctagttgttgtgtctagaaattggtgacacattaaacagaagtgccaagagcagacattcttcttttgcctctgatcttggagggtaaattttcagtctttgagtatgatattgaccctgggtttttcctagacatcctttttcaggttgaggaagttcttttcttagttggttgagtgtttttaatcatgattatatattttgtcattctttttctgcatctatggaaatgattgtacactttttgggttttgttctactgatatgttttattacattaatttttttttttttatttttttttttttttgagacctaggctcgctctgtctcccaggctggagtgcaatgctgcaaaagcaatctcagctcactacaacctccgcctcgtgggtttgtgcaattctcgtttttcagcctccctcccgagtagctgggattacaggcgtgtgccaaaatgcccagctaatttttgtaattttagtagagacagggtttcaccatgtttctgtgtttttttgttctgacctcaggaaaactcctatttgtcactttctctgattttctcctgcaaactattaggtctacaggttagccagtatcttctgtaaatcaatgactttccttttagttgtctttcaccacatctgctgtttctgagagcccttaggctcgaactgcactatatgttataagtgaaattagttcctttgggaagagattaatagttacctgttttaaaacctactttccccatcagcaaaaatccctaaaccaggcctctgaagctggcggtgggaacagttgtgacacccttctatttgagtaacaccccagtttaggagctgagcactatgtgtggtggggtaagaggggcagtggcctgagatgatctcagcttgcctttgctggcatggaaccaccacattacaggcctgggcaagagtgatcagaactctagtattctcagtggtactgtacccaaggcagagcttttttaccctgcacagaggctggacagagaaaggaagccctgccaagtacggtggctcacgcctgtaatcccagcactttgggaggccaaggtgggtagatcacttgaggtcaggagttcgagaccaccctggcaacatagtgaaaccccatctctactaaaaatacaaaaattagccaggcgtgttggcaggtgcctgtaatcccagctactcaggaggctgaggcaggagaattgcttgaacccaggaggcacaagttgcagtgagccgagatcgcgccactgcactccagcctaggtgaccagagcgagactccgtctcgaaaaaaacaaacaaacaaaaaaaaacccataaaggaagcccccgcctcacagttgcactcaaccataacttaacctcagcagcaggtagctgggaacaggatgagaaatgctgacgtcctgttcttcccaggaaggaagtcctccaattgaggactgggccaagaaggagctctgtgttcttgggtatactagtctagagtagaattctggctcattagtctgggagaggggacagagggaatggcctttgttaaaacaccacggattcgcttttcttaccaaattctttaggttttcttaaatagatgtttcttcatttgcttatgaccttaaaaccattcctagaggccttaaatttgttgttgttgttgtttaaattttatcagtttagctggggtgctggtttgaagagcttcccactgtcatttcagaaattgatttctaaatatactttttataaggctatcatttcttatgtttttatgaatatgttaaaatgtgaatcttggggctcatttttcaacacatagaagttacttccgtctgagcatttaaaggagaagtattgatgaatatcaagaatgaaaccaccaatcaattaatgcaaaattgttttcaacaccttctttattttattatattactgatctgtgtaggatgcattaaagcaattacaagtagactacaaaatacaagttgactgtatgattatgtttaaagaaacaaatatacccaagagagtgttgatggtatggattaatgtcattttgggataagatttatagtcacatggagaaaagcttagtgtcttttaatggtttggatagaaatatagaagataatgcttgttggtttgtcagtggcagacagaactgtcctatagatagagatgttactttcccttctgaggcaatcataagcaatgttgagtctggatcttatagaagagttttggcagtgtgtcttctatttgcttaaatatctcatgcaggtaggtccctttagttttaatattttgtgttccttttataggttgagctttttcataaagatatagaagctttcaaagaagaatataaaacagcctcattagtagatcaatcacaagtcagcctctatgaatattttcatatatctcctatcaaggtaggagaaagtcatttttattgtccttgataatctaggtaatagcaaattgatgtagcatttatattgtgttcttcagtaatatataaaatctgtaaatatacaattaaactaagtaacaaaggaattacccttttacatttttatttatttttaaataactttttatcatgtggagccacctatagcatgtatttatgtttataatttgacctaacattattttaccttgattttctgttaagctgttaggtgacaattttcaaaattttgcatatgatgatttgtgtattagttttaaagtaatttataaagtagccttaagaactgaagactgaatggtatcaaatctaagttagtttttagtgcaaaattcctataagctaattatacaataatagaagaaaattactaaacaaccatatatgtagagtatatatgcaatacaatacaaaagtgttttttaactggctattaacttctgaaataattgaaacatatacttttggagatacaaatacctttcagcttatgacagagttacatctcagtaaagccatcatgagttgaaaatcttgtaagtcagaaatgcattgaatacacctaacctactgaacattaaagcttagcctagcctgtcttaaacatgctcaaaacagctgggcaaaatcatctaacacaatgcctattttctaataaagttattataaagaattttgaatcaaaattcaaagtacagtttccactgaaggtgtattgcttttgcagcattgtaaagttgaaaaatcataagtgaaacataagtcatataagttggggaccatatgtatttgagtcattttcaacagcttcaacttttagatttttaatgttattaacaaatatataaaaattaatattttcttaggtttgccaaaagaatgggataggattaaatatcatgctatcttaaattgttgaattgaagatttaaatagagctatgttagattttaaatttcttcatatttctacttagtgattttaacataatccagataactttgaaatcttatttatggtgtagtgaatttaaaattaaactgattttttaagagttaaaattgtcaatatgaagaaaatacttttaaatatttatctctttatctttttagttacatttaagtgtttcactgagttccggcagagaagaagctaaagattcaaaacaaaatggaggactgattccagttcattctttaaatcttttgctgaagagtattggtgccacactgacagatgtacaagatgtagtttttaagtatgtttagtattcaaatctgtaaattgatggaaatatttctattttatatgtccctaaaaatttcgtaaatgaaaaagtgtgtgaagtacgttgcagatcataggcaaaatgaggtttttgcattcaagtgaagtgcaatctgaataacaccaacgtatgatttgctaacccctaattgctaaattacagaattattaaacaatttccttaagaaaaagagtcataggccatgcaagtttcacattttaaaagatctttctggcttagggaaggataggatgtgtatgcccaaagatatggtgcctgaaatgtatggatttgaagctaataggaataagactcttcaaagcatttgcaactagaacagaatgaatgcgataataggggaaatgaaaggatcaactttaagtgttgtaatcaggaatttatattttaatatgagtcataatgaagcttatagagtatctgaccaaagagattcagaatgtctgagttgagactttagaagagaataaccctttcaagtagcatctagaattgattattaagaacagtcgtaagaatcaataagtccaacacgaggtaacactgaacctgaagttaggtaagtgtcaaataaaagtacacaggtatgatgttagcagaaatagtattctacttagcaacaagaagcatagagcttttcagttactgtatcaggtatatgctatggatgggttataagtaagctaatcttagtatatattctgtgaatggagttataagtaagcaggcaaaacctgctgcagctgaacctggccattcgtgagcaacctctttatcagtgtgtcagacattttctatgtgggccatgataggacagaattgggaaataaagttctagtggtacatgaatgggattcacaggatctcagaactctcgaatttacatgaaaatttatgtgtactggtgacttgtctgaagataagatccatgtcttttatcagattcttagaaggttctttgattaggatatgcagagatgtatgtaaaaagtaaatttcctgattggcatgggaaaatgtactagaaggaaaggtttggagaaaagattctaaagaaaataaagccactcattaatattaaaaatactttcttcatacacatgtacagacaatatatttttacgcttttttcaggcttgcattttttgaactcaactatcagttccatacaacatccgatctacagtctgaagtcataagacactattcaaaacaggtttgtctaagattatattacagagggacagagtgatacagactggtaaaaccttttgtgtctatacatatataatgtggaactattgaggaactaaatagccattttcaaattattaaagcatgggtattttcctcagaattataaaaagaaattaagctcaatcactatttgaattttttgtccttatattttttagccactgagagaaattttttgtggatcagcaggactggaaataaataaatctttaaataaaatattaactaatttatcacacttaattaaaaaatgggttcatggaaactattagtaactaactgatgaacacgggatatttttagtgtaactagttgttaagtcagccagatgtatttttttaacagatgtttttccacttctagagagactcttgggttttaggatataacttagagtatctgatatagctgtggtatgacagatcactgagcatgactcaggagatttggatttctcccacttttgccatatacccactatgtgaccctgagtatcatctgacttatatgtttctccaatctataaaacggtggtggtaatgacagtggtcacagataattgtaaaagtgaaagtattttaaatattctagagctttacatgaatataatgtcatattatttttaatactataataccaaattactttttaaaagctaagaatagcgatcaataagcctggcatggtggctaacgcctgtaatcccaacactttgggaggctgaggctggtggatcacttgaggccaggagttcgagaccaccctggccaacatggcgaaaccccatctctactaaaatcacaaaaattagccaggcatggtggtgcatgcctgtagtcccagcttgggaggaggaggcacaataattgcttgaacccgtgaggcagaggttgcagtgagccgagatggcgccaccgcattccagcctgggcaacagagcaggactgtctcaaaaagaaaaagaaaaaaaagagtagtgattaataaaatgagatggtttaggagttgaaattggcattaaaggtgttggcctgagaaaactgggcgtgtgttttaaataatgtataagaaaaaatagatctaattatctgaattgattaatgttcatattttatttttaggccattaagcagatgtatgtactcattcttggacttgatgttttgggaaatccatttggcttaattagagaattttctgaaggtgtagaagcatttttttatgaaccttaccaggtaaaatagttatttttgtggttgtgcaatatgtcactaatacttttgaatagataatacttttctattgttaagttgagttaataagtgcaaacagattttggaacacacacaaaaggacatcattttgcagcaaacaatggtaagaggttttgggggacatttttacccttttcctcaaaatttaaacttaagattttgttaagctacgctgaattgtaagtgttctcttggaatataaaaggtggataaagtagaaagaagatcaccacatcttgctttgcacagtagtgtggaactataaaaataatcatgcaaactgacacctggccaagcaatcttaaaaatcagtgggaaaaattatgattgttctatgtcctttaaaactttttcccaaaagactcctacttccacgtataaatgtatagggaaataaaaaataaagttaacattaattttgcacattgtaattaaaaacattaaaagcattaagaattttaaagtgtttatttgaaatttttattaaagacttatcaagagtagtttgaactgtgcttgcattttgctcataaacttacaatatggaccaagcacctttctgtactttggtgagttgccgtactcctttctaagggtcagcgtctaacattatatccttcacactttcagcgtccagaaatatccctaggaattcttttaatgtgaaactttttgctgatattacttcctctgggacaacattatccatttttgttactacctctttcgtcgtatatatccgtaagctcatctttaaaagtgaatataactcactcactcatttatttactatttggccctttagggagccatccagggtcctgaagagtttgtggaaggaatggcactaggacttaaggcactagttggtggagctgttggtaagaaacagaatatctaccaagtatttttgtgctagaaagtaatggcatcattacttttactaaagataatttctgtcaggtggattggctggtgctgcctccaaaatcaccggtgctatggctaagggggtagcagctatgaccatggatgaagactaccaacagaagagaagagaagccatgaataagcaaccagctggttttagagaaggcatcactcgtggaggaaaaggcttagtttctgtaagaaatttcacagggttgtgaagattttgggaaatatcttttaaacaaacctacatttgcgaataaggaaatagacatgattctcactccttaaattattatttggatattttaagagcagtgggtggtagcatataaaacatgtcagtagcctctaaaacattctgtttaaataaaatacttaggagatctgttaattcttatgctatataaaaagcagaactctgtattttttgtgtaatccaaacttggttcttctaggcatcataaaaaagtattgtaaattttcagttgtgttttccttctagggatttgttagtggcataacaggaattgttacaaaaccaatcaaaggcaagtatagtagttcctttgcaagtctttctaagttgattctgttttcattcttggatgcaattgtcaaaaactcttttttctttccaggagctcaaaaaggaggagcagctggtttctttaaaggtgttgggaaaggtttagtaggagcggtagcaaggccaactggaggcatcatagacatggctagcagtacatttcagggaataaaaaggtaaatcctctttggtgtaagatatgagttaaaatgctgaagccatgagaaatggaatttatctgctctttggcttcaggcatttagttattgtctttgttttgtgctgctataacataccacataataccacagactgggtaatttataatgaacagaaatttattggctcacggttctgaaagttaagaagtccaagattgagaggcaacatctggctagggcctttttgcggtgtcatcccatggcagaaggacaaaaagagggcaagagaagaaaaaagggaaccaaagtcacccttttataaggaacccactcccacagcaacagtattaatgcattcatgggggcagatcctcatggcctaattacctctaattaggccccacctcctggctggggataaagtttccaacacatgctcttggagggacacattcaaaccatagcagttaccagcactacaatatggcaggttgcatatggtcttcctaattcattttgattttttttttttattattatactttaagttttagggtacatgtgcacattgcgcaggttagttacatatgtatacatgtgccatgctggtgcgctgcacccactaactcgtcatctagcattaggtatatctcccaatgctatccctcccccctcccccctccccccaccccacctgtgatattccccttcctgtgtccatgtgatctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacgttttcttaatccagtctatcattgttggacatttgggttggttccaagtctttgctattgtgaataatgccgcaataaacatacgtgtgcgtgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagttttcctatttctccacatcctctccagcacctgttgtttcctgactttttaatgattgccattctaactggtgtgagatggtatctcatagtggttttgatttgcatttctcggatggccagtgatgattagcatttttgacaaaattcaacaacccttcatgctaaaaactctcaataaattaggtattgatgggacgtatttcaaaataataagagctatctatgacaaacccacagccaatatcatactaaatgggcaaaaactggaagcattccctttgaaaactggcacaagacagggatgccctctctcaccactcctattcaacatagtgtcggaagttctggccagggcaattaggcaggagaaggaaataaagggtattcagttaggaaaagaggaagtcaaattgtccctgtttgcagacgacatgattgtatatctagaaaaccccactgtctcagcccaaaatctccttaagctaagaagcaacttcagcaaagtcttaggatacaaaatcaatgtacaaaaatcacaagcattcttatacaccaacaacagacaaacagagagccaaatcataagtgaactcccattcacaattgcttcaaagagaataaaatacctaggaatccaacttacaagggatgtgaaggacctcttcaaggagaactacaaaccactgctcaaggaaataaaagaggatacaaacgaatggaagaacattccatgctcatgggtaggaagaatcaatatcgtgaaaatggccatactgcccaaggtaatttacagattcagtgctatccccatcaagctaccaatgactttcttcacagaattggaaaaaactactttaaagttcatatggaaccaaaaaagagcccgcatcgccaaggcaatcctaagccaaaagaacgaagctggaggcatcacactacctgacttcaaactatactacaaggctacagtaaccaaaagagcatggtactggtaccaaaacagagatatacatcaatggaacagaacagagccctcagaaataacgccgcatatctacaactatctgatctttgacaaacctgacaaaaacaagcaatggggaaaggattccctatttaataaatggtgctgggaaaactagctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtccaaaacaccaaaaacaatggcaacaaaagccaaaattgacaaatgggatctaattaaactaaagagcttctgcacagcaaaagaaactaccatcagagtggacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaactcattttgatattttttaagttgctgccattgcattgtttcaactttatgaagttcccctttatttttcattcattcctagcaggcttgcaggagcagtttggcaagttaagcaagcttttcagttatcttagtttaaatacattaatgctatatatcaattataaaattagcaaatataatctgtatcctttttatgaaatgaagaatggcattttgtatttcttggttcaaactcagtttgtcttcacccttcctttattatcttattttgttataagttgttatagtagtccctcttgatctgcagggatctgcagtggatgcctgaaaccttggacagtacttagccctatatatactgtgttttctcctgtacatacatatccgtgatgaagtttaattttaaattaggctcagtaagatattaacaataataataaaataagacaattataacaatatactgtaatgaaagtaaaataaacgttacttgaacacaagcactgtaataccgcaatagtcaggatgataactgagacagctactatgtcactaatggactggtgatgtataaagcatggatatgctggacagagggatgattcatatcccaggaaggacaaagcagggtggcaagaaattttatcatactactcagaatggcatgcaatttaaaatgtagggattgtttatttctggaattttccatttaatatttttggaccacagttgactgtggataactgacactgcagaaagcagaactgtggataagcggatactagtgtatatgcatatcctttctcttcctttatgcaggtaattttaatacacattgttttttactccaaatgaaatttagtgtaagggtgaaatttagtagtttctttattgttacctgtgtcttagaaatttgtaacacatataacagatgataaaattaatgttaattagacccatcttagaaagttaggtgggtggctgtcttcctaatctttttcctttgtgttttctcttgctttctgctctatagggatatgtattgtcatcatatgagctattcctcttaagccagtatttcatactggttaccataattgggtgtttctggtttcggcatttagaattaaggtgggggaaaaaggaatcattctcctctacctgtaactttaagtttcataaatataatgtgttgagtcgtagtcatcagagaagctcaaaagtcaatgaaacgtaaggaatttgaaacatatgaaggcttctttcaaaagctgctagaattaccttctgtttatctaaaaccttataattctgtacccaggtatattacctttagggattgagggcacaatgaaacatttttagaaaaaataataaagactaagaactattgaaggatgtacctgtgaaaaaagacactgaaagtaaaaggaggaatgggttacaagattcaaagataaaaatataaattggataaatctaattgagctacatgaaagcaacattggaaacattattaaaacataataaaatgcaatttggggagagaatgattggcattaaatattgtcctatttgtaaagaggatgtatttactaatattaggtgaaacagacattaaggcaataaaagcattatttgggataaataaggtaattaggtaatgataaaaagaactaagtaggaagatagtaacaatttcaaacttctactcagttcataaaatagccttaatttttaaaagcacaacttgacaaaactgtaagaacttttcaaatgtacaacaaaggtggaagaacttaatatttttctcaataattgatagatcaggaagacaaaataaaagtaagtaaataattatctgaatagagttaacaagctacctaatacaaacataaataattattcagcacattttagggagcattgtctatgatctagacacttctctaatcacttgagggaccagcaatgaacacaattggcaatggtcctgtgttcatacagcttacattctagtgggagagtaatagacaaaaataagtaactgataaatatatgatatgctaaatggtgaaaaatgccatgaagaaaaataaagcagattaaaggaggtaaggagatgcaaaatggtagggaggagggttgctattttacatattcagtgatcagggatgcttaactcataagattatatttgaggagagacctgaaagaagtaaagggtgagccatgtgagaagaatgtcccaggcagaaggaacagcagttaaaaagccctgatgcaagaatgtgcttggcctatttgagaaacagcaagactagtttgcctggagtagagtgaggaacggggaaagttgaagaagatgttaccagggaacatgcggggaatcacatctcgtagaactcggcaagcccctgtaaggacttaggcttttgcttaagatgagaggccattgaaaggtttcaagccagagaaatgatgtgagctggctgctgcattgaggcgtaaccacaggggattagggcagaaacaacacttaaaaggcttttgcagtaatccaagtgagtgacaatggtgattcgactattagagtactagagattatgtcctgcatgtattttaaagatagtggcaatagcattagttgataaattggatgcaggatatgaaagaaagagaatcgtgaagaataattctaaagtttttatgtgtagtactggaagggtgaggttgtcgttctttttagggaaagggtattagacatttccttttgaatatattaagcttaaaatatctcttagacatccaaatggagacatcacgttattgttgagtagaggagtttgaagtatagagaaaggtccaagctagaggtaaaaattcaagatttgtgagcctataataaggtatttgaaaccatgagattggatgagatcaccaagggaatgagactgaaaagagaaaaataaggtccaaggacttggctttcaggcacaccaactcttagaagttggggaaatgaggaagacccagaaaaggaggctaaaaagaaatggtcattaagttacctaaaaaattttagggtcagtttgtcaatttctacaaaaaaggtagctaggattttgatgcagatggcattgaatctgtagttcaatttggggagtgtagccatcttaacagtattatcttttaacctgtgaaaatgcaacgtctttccatttatttaggtcttcttgaattgctttcaataatgttttatagtttgtaatgtacgagtcttatacttctttttaaaaacttattcctaagtatttttgatgctgtttttttttttttttttttttttttttgagacggagtctcgctctgtcgcccaggccagactgcggactgcagtggcgcaatctcggctcactgcaagctccgcttcccgggttcacgccattctcctgcctcagcctcccaagtagctgggactacaggcgcccgccaccgcgcccggctaattttttgtatttttagtagagacggggtttcaccttgttagccaggatggtcccgatctcctgacctcatgatccacccgcctcggcctcccaaagtgctggtatgctgttttaaatggaattgttttcttaattttattgttggattgtttattgctggtgtgttgaatacaactgtttttctttatatttgagtttctgcaatcttactgaacttgtttattagctctaatggttttgtggattcttttgggttttctatatgtaagagtatatcatctgagaactgaggtaactttacttcttcctttctgatctggatgctttttttcttgcctagttgtcctggctagaacctctagtacaatgtgaagtagaagtgctgagagaatagacatgcctatattgcttttaatcttagggggaaagctttcagatgttcaccattaaatgtgatgttagctataggtttttgtgtctttatcatgaaaacatgttagattttatgaaacgctttttctgtataattaagttgatagttggtttttcctttgtttcactaatgtagtatattacattaattgagtcagatcttaaactaatattgcatacctgggataaatcccatttggacataatgtgtaatcgtttttatattttactggatttggtttgatagtattttgttgaggatttttgcatgtatatttataagggatattggtctgtggttttcttgtgatgtctttgcctggtatgggtatcagggtaatattgtcctcacagaatgatttaggaagtgttccctcctcttcaaatttttggaagactttgtggagcgttgatgttaattaaaaaaaaaatttggagaattgatcagtgaaaccgtctgattcttacttttatttctggtgagttttaaaatgacaaattcactctctttacttggtaaaggtctagttaggctgtttcttgagtcattgtcagtagtttttataggaatttgttcaattcatctagatgttctaatttgttgatatatatttattgatcatagtaaatatttactagtattctcatataattatttttcccttatatagtatttattcctagtattcccttataattattttttgtttccataagattggtagtagtgttccctctttaattcctgttattcataatttgggtcttcttttttttcttggtcagtttagtgatggcgtgtcatttttgttgtccttttcaaagaaccagtttttagtttcattgattctattttttctattctctatttcttttatctctgctctaatttttattattttcttccttctgctagctttgggattagtttgctttttctactttctcaacttgtgaagttatattattgatttcagaccttcttttttaatgtagacattcacatctataaatttccctctgagcactgtctttgctgcatcttataagttttggtgtgttgtatttttgcttttatttgtttcaaagtagtgaatttcttttgtgatttttttctttgacattttgttatttatgcttctatgttttaatttccacacacttgtaaatttcataaatttctcttatttacacatttctagttttcttccatgtggtcaggtatcatacttgtatattttcagtccttttttttttttttttttttttttgtgagatagagtctcactcttgtcacccaggctggagcagtggcgtgattttggctcactgcaacctctgcctcccaggttcaagagattcccctgcctcagcctcctgagtagctgggattacaggcacacaccaccatacccagctaattttttttttttttttttgagacagagtttcactcttgttgcccaggctggagtgcaatggcgctatctcagctcaccgcaacctccgcctcccaagttcaagctattctcctgcctcagcctccctagtaactgggattacaggcatgtgccaccacacccggctaattttgtatttttagtagagacagggtttctccatgttggtcaggctgatctcgaacttccgacctcaggtgatctgcccgccttggcctcccgaagtgctgggattgcaggaatgagccaccacgcccggccatttttgtatttttagtagagatggggtttcaccatgttggccaggcttgtcttgaactcctgacctcaagtgatctgaccacctcggcctcgcaaagtgctgggattacaggcatgagccaccacgcctggcctattttcagtagttttatatttacattcaatgttagccaaaaggccaagaagcaaacagtaattttatattattgagacatgttttatgacctaatagatagctaatactgaataatgttccgttgcacttgagaagaatatatattctgttgttgttggtttgaacgttctatagacatctgttgggtctagtggattatagtgttattcaagttctcttttttccttgctgatcttttatctagttggtatccatttttgaaagtaggttgctgaaatcttcaactattatggtggtattgcctttttgtcttttaaattcttagtttttgttttgtgtatttggggcttcttttattagctgcttatatgtttataattttttatctttttgatggattgacccttttttccttataaaatgcccttctttgtgtctaataagaatttttttaaaggctgtttttttctgacattagcatggccactttagctttcttttagttactgttcactttgcatatattttctcctttttagttgcaaccagtttgtgtctttgactctaaatcaggtctcctgtggatagtatattgttagatcatattttttttatctattctgtttttatttttttacttatgtatttattttttgagatggagtctcgctgtgtcgcccaggctggagtgcagtggcatgatctcggctcactgcaacctccacctcccaggttcaagtgattcttctgcctcagcctcccaagtactgggactacatgcacatgccaccacgcccggctaatttttgtatttttagtagagacagggtttcaccatattggccaggctgatctcgaactcctgacctcatgatccgcccgcctcgggctcccaaagtgctgggattacagacatgagccaccacacccggccctattctgttttcagttggagaatttattcatatgtatatgcccatgcatgtgtatacattatgttagcggtccccagccttttaggcatcaaggtctggtttcatggaagacaatttttccacagaccagacaggagggataatttcaggatggaactgttccacctcagatcatcaggctttagttatattctcataaggagtgtgctacctagatcccttgcatgtgcagttgacaatagggttcgccttcttatgagaatctgatgccgctgctgatatgacaggaggtggagctcaggcagtgaaacttgcttgccactactcacctcctgctgcacgactcagttcctaacaggctatggaccggtactggttcaagtcccatgggttggggacctcttaataaatatttgttgaatatgtgatacttgttgagtgaacaaattgagtggtcacttatgaccaaataagcaaaaatgttaaatataatactaccatacacaatttagccgtatgtggtatgtgttttttggttttttgtttgtttttagacagggtctcactctggcatcctgattggagtgcagtggcatggggctcaaactatcctcccacctcagccttctgagtgtctgggacttctgctgcataccaccatgtctgactagtttttttatttttttgtagagcagtgtatgctgcccaggattggggtatgtgtttacagtaatacacatcaagcccagtaagaatgtgaggactgtgagagtatttgaatattagaaaactatataatgtgatttataacattaatagattaaggaaaatataccatgtgatcaaaacaatgccagaaaagaaattcttatttaaaattcattgcctatttaagattttcaaaaacagtaacaaaaaagaactgttggtaaactaaaagtagcaatgaactttcttgacttgttaaggggtgctttaaaaaaaaaaagttgctgataactatacttcacagaaaactcttagaagctttccgtagggtcaggaatgagacaaggatgcttgcaatccctttttgtttatagcattatactaaagaaactagacaacgtaataggaaaagaaaaagcaacaattgctaatattgtgattattatcacaaagaaagttctagagacttaaacttctctatagttctgtatttttctagagaacttacactgtttatgttacaaaaacaatttaaaattagagaatgttgtaatatttttaatctgaaataagattgtttttagtaattgcattttatagtttatttacaagtttttgaataatttttaaaataaagttatattttttttcctctagagctacagagacttctgaagtggagagtctgcgacctcctcggttcttcaatgaagatggagttatcagaccgtacaggttgagggatgggactggaaatcaaatgttacaggtaaattaagagctatcttataaattaagattaatttagtcaagttagattttttttaagtagccatttaatatatattaaattatttgggcttttatctattttgcttaattccacttataagtttcttatatttacttagattttaaagtacatttatttactataagatttttttttcttttttacaggcatcaaaaagtttgatatgaaaagttaatgcatgactttgcaagtgaaagccaacagtagattttagtcttaaaatttacaaactacgtacagctgtttcagtattttgaatacaaagaaaaccttttgtattggtaacttttaataggaattttaatgaatctggtttttttatagggtgttcttagttctgcactggatttgctagatttgttggaagcctttgtaccttatgtatcctcgtcattggtggtacttacttaaccaattaaaccatttctgttgtggggttattaaaccactggtagcttttataccagatatataatccttatatccaattacacatgaagaaggaaaagcaaaactcaggaacactgctattgtgaattactcttggattcttgtgctttgcctttgaaaatgcttaaatggccatgaccctcttcctgctttattctagtgtagtctttataaaacttgtgggatttgataagcagttcacatgcaaaccagtatcttttaataatacaaagtagcatctggaacaatagacagtttgaagttagaatctgcttagacaactttcttacttggtaaattcgactttttaaaacctggattatgctgtaggtaactagtaatcatatataggctataccagtgtcatgttgtttctgtggtttagaggtggaatactaaattaaatcatttgtttgaaaacaaacaaggaatcattatgttatgtaggcttgcagatactcatggtagcaataaactgttggaatatgaagcttcctttatggctttaatattttaaatattgtgatatttaatgtgatcagagtaaagatttaaacttcagtattttacctattgcagggcatatagtattgcataaaatatacttctaactctttctctgaggcttctaatatacaaaaatgtaaccatagagttaatatgcaatatttagttaagtgattttatactgtatttaaaatgtttttgaagcatcaaaatcattgtatattgggatagaactggtaatctattaagaggttgtgctctaatggacagattgtgcagtctctacaatgacagtgtatcgttctttggaagatagtaaatttgcagaagtcacccatggctgatacagtcaaaacatgtatttctacccaatacctgccttcccttgttagaacgcatttaacaagttactaacattttactagactaaaaatcaaatatagtacgaagtaaggatgagtgttgaggagagtttaggaatatatcctcattataagtgagcacgttatgatacccacaaggaagccatgagataccaataatttctcatggttgataatttgattttagtgaagcttctcattgttttctgaagctttaaactttgagatgtaaaaacatgacttttgactgtgtacttttaaagatacatatttatttttaataggtcagtctcatcattaatcactaaaagagctatttaaatgactaaaaaccacagcacttgtcagccattacttgtttttcagcaagcatttacacagtattagctgaaatatttgtagggattcaccaagtaccttgggatgttgcagttagcatttttttcttacaggtataaaaagtggattgttgttttgatggtggtgggttttgtttttttttttttaatcaaagctctagtgtattattagcaaacacttaaaaaatatgtaaataccagtactgtggaaaataattagatgacacataaactggatttaaaatccatctcatctgcctagattttatgtaagtgatataatgaaggtgccttaaaatatttgatactttcaaatgtttctcatgttattttcttattttctaaaaaagatgtattcactaaattatatacactcatataataattaaatataaaatacattcttttattgtgtacctttctatctagaaggtagcacattattacagtgtttcctgctggtcaaagttgcctattagagaaatagaatggtaattttaatatattcacaaaataccttattgatatcatcaaaccaatttatacattgagtttgtaccaactagtggaattgtcttaggtctattaagttatggaatattatatccataattacagtctgagtcatagctgaaaaaatctgctttaaaattattctcactctttgaacatttcataatcttacatgttttcaagcaatttgccatactctactaacctttgtgcttcttttttcctttgccatgcttacagaaaattcaattctacagggagtggattatgactcacagtagcagtagtgatgatgatgatgatgatgatgatgatgatgagtcagatctaaaccattaaaattcatatgttctttattttacttggaatgtttcattaacatgttttgtatgacttataccataatgcccatatgtccatttatagggaggtaaaacacattttcttttaaaatgttttcctacacattttcataaagcaaaataattgtattatttaagcacagaaaaaaatgtatcttacatccaaagtagggagggcatccaacatattatagatttgcttttatatattttatagctttgtattgcatagtttgtctttaagagttcaagttagacttaaatataattttgatgttcactggttttattttaaattgccttcttatttgttagcaaaatgcctttttttaatggtctctgtaaattttctgggctttaatgtaatgccactgtgtaaaaaaaaaggaagaaaatagtaatagccatttaatgttttatatttatcattttaaagatatttttgtcaaatttcttttaataataataaacatatgtaatctaaaggagtgtgaatttgttgttctatccccaaatcatatagattgaactgctattataaaaaacagtcatggcctctcatggaagagtagatagtaaaataatttatagtctgagaatgaaaaagaccgttcttttatgtctttgctttactttttaccgttttgtttcacatattttttgtgaaacaatgaacaaagttggttttaatagtcattatattcacttattaatttgtatatgcatctactatatttctattatgaattcagaatatttggaaacttctatcgtaaacataactatatatattttttctgtgtaatattagggaaaatgttacatatatctctgaaagatccattagtaaatctattttatgttttgtgtaataaaggtttttaaaaaaatttcaacatagatgaaactgtcctatttctctaacatatcagacgtactttaaaaaattctctaaaaagtatatgatctttggtagttagaatgtttaatccctatgactgctgtgcttttggatcaacaaaggaatatttatcttgactacagcagaagctcagtataagcaacaggtgatttaatttaactgattcagcacatgatttctgagtctcctctaattcttaggtttatcaagttttatttctataaatcattctctatgttttttgaaagtgactactttaaatttgaaaatattgagattactgcaaaaaaaactgaaaaaaatcagcttttttgaaatttcttcctatgcagaattcattcaaattaaatagaaatcaaggttatgtatgtaaaatttgtttgaaaacaaacttactaatatgtaaacatcataaagttgttttaaaaaactgttatgtaaacatcaaaaaattcaattattgttttaatcacagtatttttatctttttagaataagtacatacaaatagtgaccattaaaatagtcattgctttattggaaaccaactttgtatttgttgtgcacccactcctctctcacccttggccaaaatcaaacaaaacttactgctccttctaaaatctagaaagaatactgcctatttttgtattttgtatatgcttaaggaaggaagagtctggaagtttcttcattggcttcttacattccaactttgctagtcacaaggcctttgtaaaagagactgtggaaactacttgtttgcaagacatttcccaaatttactgtgcttggcctgtgacacttaatttcatggaatgggattcataaagatgatcttaacctttcattccttaagaatttatcggaaaaaaaaaaagttgtggttatcttagcagtgatttaccattttcatgaaaagaaaattggaggtaggattacatttatttaaaatttcttcagtaaaaatattttaaataatatgctagtaactagtaaacattgcttgtgtggtcttagagtttcatcattcttcagtttttagcccttagagatgagatgtgctctttattttttttttttaattttttttttttgagatggagtctcgttctgtcgcccaggctggagtgcagtggcgcgatctcggctgactgcaaactccacctcctgggttcacgccattctcctgcctcagcctcctgagtagctgggactacaggctcctgccaccacacccggctaattttttgtgtttttagtagagatggggtttcaccgtgttagccaggatggtctcgatctgacctcgtgatccgcctgcctcggcctcccaaggtgctgggattacaggcgtgagccaccgcacccagccgagatctgctctttgacagtgtaattgcccttgtttttctgccacagtgaaattatcttttcaaacctcttgaggacaggtattaattgtgttccagttttgaaaaaaaacttgaatttttctctagtaaaagcaaaaaaaaaagacagaattgctcttttgttttacaccattgttctcttgatggagatagaggatctaggcaaaaatatattcttatttcttatcaaatatatagaaaatgaatttatatttggattttaataagatgaactcttgtttatcaatggttctataattaactagaacttttaaaatggtagtatctaacaggaaagtctagtgagaaagctgtttgaaaattatgtaatgccacacctttccatatgctttaacttcatttatgttccagatttctgcacgatcattgcttatgtatagaaaatgggaaggaaggttcacttccctgaaggagtgattacctggagattccttattttcctttgtgtctacctgacgcttgaataacatattgaaaacgggcaggaagaaaaatttgtaaaaatctgtaattgtggacactcataaccatagataaataatctaagcctgtaaatgaaattaattagtactcacatgggatataaataaaacaaatgtaaattcagaataatattgccaattttcagtattatagaaaaggaagtcaaattttgtttccttatttaaaataatcagtattttataaatttgtttttgaaactattcaaaacacatatcactgatgcagtgttgaatgttgattttaagttcatgttatttaagtgtacacctggagccactgcatacttatgacatcaatattcaatgtgaaaaatactgttgtttctgtgtctcaagattataaatgactgctatagtagctactagtttgtctgatttaagtcttgtaatgaaattttgcattcagcttttttgtggtgatgggagaaggaccagaaacaaccatcccagctgttactgcgtattttctactgcatcttcaaatttcagctttttgtctcttagatttccttgcaaaatagtaaagggtcttatggatcaaaatcaggtgatgttaagtgtacacacattatttagctcaaataataatgatgatggatatgtgaaaatgtcaatttattccagcacctttggaataaatggagatcaattaagaatgcttacactgttaatttaatcattaatattagtgagtgaatttgtgagttcataaagtacagtgagtacagccagcattatacaaaacgtagaaagtccatcaaaggaaagtaaaacaaataatttcaaataggtctgtgttaagagaactaattagaataatttatgattttcatagggatttattgtccggtttgttttaacgtggcagaatatttatcattctcaataagtatgataaatttatttagcaattattccatatcaaccgatatatagcaacagtctacctccaaatatcaattttaaaacacacgtttaacagtgttataaaactggcttttgatgaatcttcttcattgcttacacatgttttaagcaatgaacttgtaaagatttctcctgaattgtattatgctattcttctggatcttagagatcctcaaatacatgagcactgaaaatattataggcattgtttttgttttttaaaagcaaccaggatagtcagagatttagctaagtatacccagtttgtcgtaattgggcatgttatatttttctactataaattatcatttatcagtaacctgttaactacattatgtctacaaaggttttctgagtatattcaataaaacttggcatttctatgaattaaaaattttacagacctgcatttctagggaaaaagctaaaaacctgtggatccatttgctgacattgattctcagttgacaactttagtattttataaagatacgaaatttttcaacattagttattttctacattaaatagattattttctacattgaagtatgctcattagagaaaagcaggaaactatagaaaaggaaacaattatcctgtctccccaccatttatggtatatttcctttttaaattttttattcacctggttatgactcaaaagtataaattgccattttatgttttactacgtatttttataagcagcattattaacttctaaagattaaaaaagcataccactcagaaatatccgtaattgggaaacctagtctttatttatggagcacataaagagtaagcagaactctttttttttttttttttgagacagagtttcactccattgcccatgctggagtgcagtggcttgaataagctcactgtatcctcaaactatggactgaagtagtcctcctgctccaccctcccaagtagctgggactacaggcatgcaccactatgccaggctaattttttaaattttttcgtagagacagggtcttgctatgtggcccgggctggtcttgaactgagctcaagcgatcctaccgcttcagcctcccaaagtgttgggatttcagacgtgatccattgctctcggctttttgtttgtatacctgatgtagaagcttttttctttttcgttaaacatttctaccttttgactctatacttttttaaaaacatttcttccctttaagtaaatcttttaaaatgtgtttgcatgggtatgtgtgtgtatgattcctgtgtccttcattgtgtctgaatgttgacagctgagttgttgtcctgtgggtgtagtatagtgtgttcttaaacatttcaggtatttttgaatttatctatgttgtctttgaatcttttacagggattctataactgccgtcatgtaagttgttacagaagggaggctgtttttgtgtcttgtatatttcttttctttcagaaattacagatgtttataattagcttcaaacactgccttaatagcaattggaagataactgccgtcagccgacgtggtctttccctttacttcaggaggagaatgactactaatctggaagaaaggtcttactatagcagtcagatcaccagagtagtgccgaacacttcctggcttcatctgaaaatttgagtaagtggacaagaactaggagacaaaggctattggacttcactcttcattttatagctcttcctctccagaaggatacttctgaatgggatgagaacactgaagagagccaaattgtgttatccaggcaaattagaattcttagcatctcaaataaagcagatttcatggaaaagatttccatggatttttggatacaattatcataccttactagtttagcaggaatctcttggagagactgtcacattatttccaaaggcccaaatgttgaacatttaatagtgtgtaccactatattttggaccagtagagtccaaaatagagtaaggaaccccacttagaaccttccagtgttatataaaaataattttagaataagattttgaaataaattatgtcttcctctggtggtgatgattccacttcgtggaggttcaggttttttctttcatctcaagtgtaaaatttattcatttcccaccgcccgccacccctccccccaccccgtccctctctttttgttgttgttgttgttgttgttgtttgttgttgagacaaggtctcactctctcgcccaagctggaatgcagtggtgcaatcatagctcactgcagccttgaactcctaggctcaagtgatcctcccacctcagcctcccaagtagctgggattatagacatgagccactgcgtctggcctaattctcttttttaattcaggaacttaaatgagactaatttgatttctagatctttcagtttgtcatcattgcatcccttaaatttgtaaatatattaagaaaggataaatgctactgtaatagaaaattcaatacattataacattaaaagaaatcctcaaatgttaagcccaggtacgttcaatttgagtcttacatctttttaatcaaagatctgtcaatacagctaaaagtgcagtaagtattagctagaaggtcttcagccttaattaagcaaagttgctaaattctgatacaggactcaactcatgatttctctactgatgtgatagagctctacctagtaactttccctagttaccttggacacaaagattctcagcataaggtgagtgtagtaaagctcattcagaaatatttgtgtgtgtgtacgtgcatgctgtaacaataacattgttagaaaactagtatacattatgaaaagtctattttttattagccaaatgtcctgtgaaaggatacattcacttgccgaatgaaagttatcatgcaaaatcagattagaggcctcttttcactcatccaaaaacacaatttaatgccatctattaaaggaagcaccatgttttttggtgttttgtttttgtcagttaagaatcttttgttttaaattcaaatgaaattgatatcctagtcacttctaatgatgactctaatgaattgtaatggtaatttttcagtgaaaatttatcactgtaaagaaccctacggaagcactataaagaaatatagatttagacatttctgtggtacttcaagtctaagtagtttgagttagagatcttatgaagatgcagtgttggaatacaaatatgggagattgaacatttcatgtaaagttaatctttatggaataagttgccaaaagaataaaatatatggatagatatagatatataaaattgaatttttgctggctttatttggtagcatagtttatatgaatacaaagaaaagaattaatgccatgtattcatttgttctacaaacaaattcagttctgttcattatgtgttcagacactcttgtagatagtagagttacagccctgaagagagtattgaaggttcctgctcatctctcatgagtttataattgtaatgagctttattgttctggtgatggggcataaaacacatgccacgttagaggccaaccctgtaatgtcggatcttcacactctcattcctgtttgttgtttagccggtatatgcaaggctgtaaagaacattaggaatcagagacacctaaaatatgacccatcttccacagagacagtgatccctaggtattatatgaacttgaagcattgcaagagacatgataacagtttgtgagatatctaaatccatataccaatgaacggttaaaatgagatcccactgagtctactggaatatatatagttcttctgtgctaactcgttttgttaataaaaattattttgagatatagcaataccctgtgcctaagggcctggactctggagccaagtaaacctgagttcaattgtagcctttttccttttactagagttattattttttattatgcttatctgacgtcagtttccaggttgtaaaagagagataattgtagtgcttatcttggtgttgttgctagggttagaacaaatgaggtaatgtatgtacagccatacctcagagatactgcacgttcagttccagaccaccagaataaagcgaatatggcaacaaagcaagtcacacgcatatatttgttctccagtgcatataaaaattatgtttataatgtagactattatgtacaatcacgtcgttaaaaaactatatatacactatataaaactatatataactatataaaactatatataactatataaaactatatatatacacaccttaatttaaaaatacataattgctaaaaaaaaaaaaaaatcctgatcatctgaagccttcagtgagtccatctttttgcatgcctggtgttgatggttgctgactgattaggatagggattgctgaaggttgggatagctgtggtaatatcttaaaatgaagtttcccacattgattgactcttcctttcacgaaagatttatctgtagtatgtgatgctgtttgatagcattttaccctcaatagaacttctttcaaaattggaatcagtcctctcaaaccctactgctgctttatcagttatttttatggaataatctaaatcctttgttgtcatttaaacaatcatagaatcttccccgataatagattccatctggagaaaccattttctttgcttatccataagaagcaatttctcctttgttcaagttttatcataggattgtaacaattcagttacctcttcatgctccacttctaatccccttgctatttgcaccatatctgcaattacttcctccgctgaagtcttgaaccctcaaagtcatccatgatggttgcaatccactttttccagacaaactcctgttactattgatattttgacctcgtcttattaatcacagatgtttttaatggcatctagaatagtgaatcctttccataagttttcaatttactttgaccagatccatcagaagaatcactccctgtggcagcccaacaaaatgtatttcttaaataataagacttgaaagttgaaattactgtttgatccatgggggctgtagaatggatggttgtgttagcaggcatgaaaatgacattaatctcgtacatcttcatcagagctcttgagcccgagtgactaggtgcatggtcaatgagcagtaatatttttctgagcgataggtctcaacagtgggcttaaaatatttagtaaactttaagtaattcttaaggactctaggattttttctttttcttttttttgagacggagtctcgctctgtcacccaggtagcctgcaatggtgcagtctcggctcactgcaacctccgcctcctgggttcaagcaattctcctgtctcggcctcctgagtagctgggattacaggcgcctgccacaacatgggctaattttcatatttttagtagagatggggtttcaccatgttggccaggctggggacgatctcctgacctcaggtgatccacccacctcggcgtcccaaagtgctaggattacaggcatgagccaccacacccggcacttttttttcttttgagataagagtctcactctgtcacccaggctggagtgcagtgatatggccttggcttattgcagcctcgaactcccaggcttagttgattctcccacctcagcctcttgagtagctgagactacaggcatgtgccaccacatctggctaattttttttttttttctgtagagatggggtttcaccatgttgcccaagctagtcttgaactcttgtgctcaagcgatccgcccaccatggcctcccaaagtgctggaattatacacgtgagatgcctcatgtggccagggctctaggatttttggaatggagtcttggcttcaacttaaagtcaccagctgcaccaggcatggcggcagccacctgttgtcccagctatttgggagactgaggcaagaggatcccttgaacccagaacttcaagtccaggttgagcaaaacagcaagaccatgtctctaaagaaattaaataaagtcaccagctgcactagcccctaacaagagaatccgactgtcttttgaagctttaaagccaggcatttacttctctctagctatgaaagtcctggatagcatctttcaatagaagtctatctcatctacattgaaaatctgtagtttagtgtagccactgtcatcagtgatcttagctagatcttctggctaacttgctgtagcttctgcatcagcacttgccccttcaccttgtgcttttatgctatggaggtgaattctttccttaaacctcatgaaccaatctctgctagcttcaccttttcttctgcagcttcctcacctctctcagccttcatataattgaagatagttagggccttgctctggattaggctttggcttgaagaaatgttgtggctggtttatcttctatccagaccactaaaacgttctccatatcagcaatcaggctgttttgctttcttataattcttgtgttcactggagtaacactttcataatactttccttcaagaatttttcctttgcattcaagattggctgtttggtacaagaggtactacctttcagtctaactcagcttttgacatgtctttctcactaagcttggtcgtttctagcttttgatttaaagtgatagacatataactcttcatttcacttgaacacttagaggtcattgtagggctgttaattggcctaatttcaatattgttgtttctcacgtaatagggaggctcaaggagagggagaggatttgggaaacgtccaatcagtggggcagtcagaacacacatttatagattaagttcactctctatggctgtagtttatggcacctcaaaaaggactataaaatagcagtatcaaagatcagtgatcacagatcaccataacagatataataatgataaaaaaagtttgaaatattgtaagaattaacaaaatgtgacttagagacacgaaatgagcatgtgctgttggacaaatggtgcctgtagacttgcttgatgcagagttgccataaaccttcaatttgtaaaaaacacaatatctgggaaatacaataaaatggagtataataaaattagatatgcctgtaattattagcatggtgcctaataataactcattatatttttattattccagatgaataccagtttatgcaagttcttagtcatcattatataaattcctcatttttgtcctctttggcaagacaaaatctattctatttaagagtagattttaagaatttaaaagaatagattttaagaatttaaaaaagaatctttttttcctttcaaggttaacagagtagttaaaacaccatgacagttttccacacatgctaattggcaagcagttgaaacagtaaaacctcagtgatttgaactgctctgaattatacagtattttaaaagaaatgttactgctgctttcagggatatgtagtatgatggacccgtaaatgttgatccattagaggttctgctgaactttagtgagacttttgttactgtgcacctacattacccttgatgctctcactctggctcttctcctagaatatattaagtacgttaattgatggtctgctgttgtcagtacatataactatttgatgagcatagttattttccttctccaggcttttggttgtaccagttgatgacaacaattcgtatctcttaagatatagtagtttcttacacttgattttatgtcaaaggttatgctcagctttcctgccctgtctaagctgtcagtatagcctatacctatggttttgctgacagtcaagatagcatattagcatgggagaggatgaagttatgagggataaaataagtgctggttgctcttcagatttgaccatatagtcagtaagattttatttttttaaaaccaacttacctcagacaaggtaagctacctgtcacttctttattcttgtttacatttattctcattcaagaatatgaaatcattaagttttgaggtaataaatttctactatatttgattgtgaagtttgcttgaataccttctttttcctggccatggcactcgagtctgaggtttgaagtgaattagtaaaactttctttatccctaaaaattcatcataaaactctaaggaagttatacttattaagttttctctaaagataagattgttttgaacagtttgtctatttacttcttaaatagttttaaaatggcagtatttaccattttacaattaacttcctgaattttgttggttttagaaataagcttaaattttaagtagaatctattcataaatgcttcctctttcccactcatctccggaaccctcaaattaaccagtctataaaaccatttgttatctatatattttcttgcttgatagtattcatttttatctttcatttagatgaatttcatggttttttgtttttgagacggagtctcgctctgttgcccaggctggagtgcaatggtgtgatctcagctcactgcaacctctgcctcctaggttcaagtgattctccttgcctcagcctcccaagtagctgggattacaggctcctgccaccacaaccagttaattttttgtatttttagtggagacggggtctcaccgtgttggccaggctggtctcaaactcctggccttgggatccgcccgcctcggcctcccaaagtgctgggattacaggtgtgagccaccgtgtctggctgaatttcatgtttttaatcccccatttttgctatttttttttaaacgttcatacctctttgcaacacttgtcttccacatgagtcagatattgattagattttggttttttgttttgccgaacaacatgttcttgtcctttaaccaattttcttaaatatatttcctattaatgattaacacattctttggttgggacttaaagccttttattttagtgatttattcctatttttaatcttttcatattttgcattatttttcagaagtatttttgttaagggattctgtttcttcataacatttggatgatttgagagtgttagaagtgtctctgttaccatggctctgtccttcaagttccactttctttgtgtttccaaatgtatcattaatttggtttgaatttatttatgtctaataaagtatggtttatgtactcatcttttctaaatgcaaaaggacctgtttaccagtaaccatgtattttaattattacctatagattctgacaattgtatataatgaatgcagtttccattgtgtttctgtttcttttagtaattcttaaactatgataggtaatttatatatatacttttaatgaataaggcgaaaaaaatgtttttcctttaacatttaagcatataaatgaggctaacatgtctaaagtactggcattgttaattccttcatagttcagccaaatcttggtctttatgtaaaggccctacatgatgattcccaaaccctgattttgctaattcttcatttattttaaaggctatcacaaattattttaatagaaccatttatacctagcatctgtttgggatggaggaagataggatttttgacactaaattatttgaatactgttgacctggaaaaaattagcagcctacctcagcaactatcagtatccagggatatcaaagacattttttgaggtaccatgaggaaagtatgactgataccatgaggaagaaacatcatgatatgtttggtatagtgaaacgcactggaattagaagtgaagaatccagttttctgagcccagttttgcaactaaccccaagcaagtcacttagatgtactcttacctaattacacaagatggtgaaaatttagatttagaagattcattagacacttactgatcctcagtttctttgtgtgtaaaaggaagagattggtttggatgagcaacaggagtttttcggttccaaaattctggggttttttccccccaaaaatgatgttttgagtagtctaaagcttcttatataatgcattcataaagtcaggcaggaatttgtgactacaacgtgacatttgtagactttttacagcgtgacgttctctcccattaacttctgtggattcagtttgaaagttttggattctgtttataatgttcttattccgtattctcatgtttataatggagactgaccagcaagattttgctgtgcgatgagttatctttgacgctttgacgtttattcaaatacagtcactctaataacaaaggatacggttggcagccataaaaaatgatgagttcatatcctttgtagggacatggatgaaattggaaaccatcattctcagtaaactatcgcaagaacaaaaaaccaaacaccacatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaataaaaaaaaaaaaaaaaaaaaaaaacaaaggatacggttgattacgtttcaaaacagactactatgaccataaagctcattcatctatcaagtgtgttacatttaaggttttggatggaaagcattatatgaattactttctctggattcttttagctcttacttataccagatgctgttgtgactgttgaaactggtttaactgcttatatgcacagattagatttgatttaagttgggtctggaaagtagaaagtgatgagaggtaggcttaattacaatgcccaaacttagcataatatggaaataaaagttaggtacttggaataaaccatagcttttaaactattggaaggttacgatctattaatggtgtatgtaggctcttgaattctattagcagtggcattcttgagatcaacatttgtattcttcatttttaaacttcgccatatggaacaaaagaaaatgaatctttgaaagccagtttcttttcagatatcaaaaaactgaaacagaataaaagaatgtaaaattaaaaataaaagcttaacttctgcctccaccattatgcttcagaagcccagtgatcagtgctgttaatagattgatgtgtaccttccagaagtttctacatgttgaaactggtttaactgcttatatgcacagatacatgtacgtacaaatatatgtacatgtatgcatttctacttttcattctatacattctcttgtaatataattttatttactatatcttatacatctctctatgtcagtatgcacaggttttttatgacttcataatgctccattgtatggctgtacatgaatttatttaaccagtacccttttaatgaatatttagattttgtgcttttaatacaatattgctgtgaagattcttatatgtatattttggcatacttttgcctaagataaattctagcagtgtaattgctgactcagagggtatgtttaattgatttgcattttcctaattttgagttatagtgaatattttctcatgtttatcagtcagattttttttttttttttttttttgctgaactaccttttcatattcttcacacatttttctactgctttactcatttttttctgtcggtttcttcaaattgctagaattgtctatattttgaaaatgactctatatctctgtattgacaaatattttcccaaattgtcctttgatttttctgttattttactttattactgtttatttgcttatcgttttgccattcagtagtggttaagttctatgtacttaacaattttttatgttgtgttttatggactctgttatattttggcctttcccacttcaagattattaaaatgggccgggcgcggtggctcatgcctgtaatcccagcactttgggaggcagaggcgggcagatcaggaggtcaggagatcaagatcctggctaacatggtgaaaccccgtctctactaaaaatacaaaaaaaaaattagccgggcgtggtgatgggtgcctgtagtcccagctacttgggaggctgaggcaggagaatggcatgaacccaggaggcagagtttgcagtgagccgagatcgcatcactgcactccagcctgggcaacagagcgagactctgtctgaaaaaaaaaaaaaaaagttattaaaatgttactttttatagtacttttatagttattttctatacttaaatcattgatccatgtagaattgatagggtatatagagagaaggatacagctttagccagtgagttacttaaaacgccatttatttgataatacatgtgtttacccactaatttgaagtgctgtcttcatttaataaatttccgtaattggataggattttataatgtcgtatatgcatagtggtcagtttctgtaatctgtattctttcctttgatatgtctgcatatactttaccaccaccaaactatttcactactgcagctttataaattgcattaatgtcttccagagtagttcttctcattcttctttcataatttactggatattaccacatatttttcctagctacattttagtataattttgacaaatcacttcttacctcctaccccatgctccaaaaaccaccatcttgggatcacatgaagttgtgtgtgtgtgtgtgtgtgtgtgtgtgtgtgtgtgtgtgtgtgtaaaaattgggagggagtcaataacatctttattatgataaatttttatatccaagaataagatatggatttccatttccaaaatttcttttactcccctgaatagagtggtatggcttttatcacctatattctgcacagtatttattaaacttacatgtaaatatttatctttttattacccttgtaaacgggatttctttctcttccatttccaaattgattactgggttttgtgtgcttggattttccagatgtactgtcatccacaaataatttctactcatgatgcttcttcctcttaatatttcttaaaacagttcttttcatctaagttttcaaaattatttgcataatttataaattatctaatacagtagtcctgtcatttccacagttgctttctgcagtttcagttacccatggccaaccatggtttgaaaatattaaatggaaaatttcagaaataaaccttcacataccttttattacagtataattgttctattttattattggttattgttaatctcttactgtgcctaattgataaattaaactttatcataggtgtgtgtatataggaaaaaccatagaatatatgtagggctcagtgctgtctgtggtttcaggcacccactggaggtctaggaacatatccccctgcagataagggagaactactgtaattcatattatttttttctgaatctgtatgtatgtccctttttcatttgtattacaaagtgtttgtgtttatttgccctacctactacagtaaatagtaaagatattcttttcctcaatattttataatcattgaagttaggaacttcttccatgcaattaatctgtatgagtcatcctgctattttagttttttaacttctttctcagataaaaatgaaaactatcaattttctatacgaagatcatcatgaagtcacttcttagctttcttctaagctaaataattttagttttttggtacagtttcatggaacacaattttctaaaacctttatatcctcttttggatttctttatgatttttcacatttggctaaattcataacatgcctcttcttgagggaacttagtcataattacattgcttgccttgcctgtaaaaacagtaggctagcctgctatgtactttaaatagctgaagtacgtccatcctcagagcaaatattactgaaaatggaatttaaaatggtaaatcttattttgttcatatggttatatttacatttcttgaagcaaacaattgttaataaacagtgtcatggatagacagtgtttcaacagtcttgaaaataaagattgattcaaaggctaagtaagccttggggtccctgtttgtccagaaactctctgctctttattttttactaagttgtgagattgacaaagaaaagcatatttgttacatacgaaatttctagcgcaaggcagaagctaataagtaatttatgtgatgcatatgtttagatttgtgttagtatttacatgtgtttttgtacaaatattattaaatactaatgtgttttccaatataaagtcactgtaatagttaaatacctcattagattgaatttaaactttgtaagataacatcagcttctaaaagtctagcattaaaggctggcattgctgcaactgagtaatgttaaataaagtagtgcaagtagatgcttttaaaaaggaaacagcaatgattttacaaataattaaatgttttctctatgttaatggtttgccccattgagaaatggtttttagaggactataaggcattgtttgcattacagtaggaaatactatcaattttctcattgtctctcacttttttcttttaggtcatggaaaatggaagatttgcaaaatacaaatattttacccatgtcatgatcaataagacagatatgctaatgataaccagacggtaacttgctttctttctcttacgtaattttataaggggttaactgacagcgactcatgaggtgaagatttgttattcaccttttgttccatatagtcacactgattcttgggtcttcttgctccacaagcctaactcgctaaacattacataaatttcctgcatagctttgtgcatgcatacagataaacacagtcatgcacagacataaatattttagtatttgtttcaactaatttaactggatgcagaaattccataaagctatcctcttaaaagtaagctttctcctctctgaagaagtgtacaattttaggttatcccagaagtcagcagtcctctggtagtatctgtttgttagaatatatatagattgacgtaagtggatatactagtagaagcagataaaattttaggtggatactccagcgacttcttcaagtagacagtggaggggtacatgtaaaaatacacaggggcatagcctcagaggggcaagtgtgcagaagtcattgttaaactagggaaaaaatgagcaagtgcattagtaagatggcagtctctgggtggtggagagtgaaaatacggctagcagggagaagttagagctaaatagaaatgaattgtcaatctatggttttgttcacttatgaaaggtaaagttatatgagcattgtgttggttcaaggtgactactaagcagtcacttttaatgttgtaatctcaatttctgaatctaaaatgtatagccctattttaattttcttatttaaaaagtaacaccaagtggaaaacttccacaatattagaagttatacctgtaaaaagtaagtcttcattccaccccagatactggtccctctgttcccttccaagaggcagcccattttttacttgtttcctttgtatccttcttgaaatattctatgcctctacaggtagacatacacacacattttaatgtagatgaaattctcttatatataccattatgtacttagttttaatttttcacttgagatctatattttgaagattattacatgtcaacgtatggacagctgtcttaatttgtaaattcctgcctaatatttatttaggagtatgtacgaatttacatgtaacttgtttctagacttttgtaattaattacagacattgcttcagcgatcatttttgctcataaaaattttccatcatgtttttagtaactcactttcccattgactaaaggaaaggtaactaatcagcattaagcaaaatcagttgcaaagtttggttccaaatcttgcaacattttaaaagttatcttttttctcaacacagtggacctctttagatgaggccatggtgccttgacagaataagggaagtgaattagttgtagttgaataaaacgtgatggttatacttgagattccctttccaagtttcgggtttgaggataaaggatctttgaatcaggactgggaatagctgctacattggccagcctgtctgtgatttttcacatggttggagatgtcctggggcaccactaggtttgctccatcagctcctgtaatccaggactggtaaaagaggggagcagggacagaagatggaagtgagagatagatataaatcctggctagctctctccttttccatcctagccaggagtcagacctttttttttttaactcaatctaatacaaacctctggttgcacctacaattgatgtttcaatcagaaagaaaaattaagaagaaagacatttgaaggaaggattaaatagacttcttatagacagaaggtattttcatttcttggtttctttcttcaaaatgggaaaacaagaatttatttaaaaattagaatgatgctttttgaagtcttcctctaaaattggcagtaatgggacttgattttacctgtgaacatcctgaggccctcagcatgatgattctgttcaacatggttagaaaagcttttttctgatgtagttgggaaatacgttacatggagccttagaaatgaaagtatttattctaaggcgttaattatatgaaagttcctccaaatattggctgatagttggttctgtaaatgtaccctgtttcttatgaagtgccttacatatttgattttgtaagaagtgcttcagtttttctaatataaatatgttgtgttataaatttcccattgagcattatgttagctgcatcccacaaattttatggtgtattttcattcttattctgttcaaaatattttctaatttcctttgagattctttgacccctggattatttggaagtgttacttttaagcatttggaaatactattgttatctttttgtttgggtttctagtttagttctgttatgatctgaggacacactttatggttccagttcttttaaattcattaagaatatagaatatagtctatgttgatgaatattgcatttgcacttgcgattcattcgtatcctgttgttattggatataagtgcctcaattttaaagcgaattctttttttgtttttctttttgcagtggtgtattgtttgtaacaaagggaacatttggacaactcacgtgtgagtggcagtatagttttgatgaatttaccaaagagccattcattgttcatgggagaagattgcgcattgaagcaaaggtatgttgaatagatttattttttgaaaacttggaactgaaaataatgctttgaagtagtcctttttatttgtataatgctctacctcttttatagatgtcactttgtcctggtgtggttttcccttatacctgctatcttacccaggcttaaaggaaaaaaaaaaaaaaactaggccaagaaaaactgtgctttctgtgctattgcactgacaataacattcctgggcccttgctgtatattcagtaacagagccccaccttcccacatatgaaataatggatagtggctattagcctgtgctgcagtccatactgctttcctggctttttaaatatattttccctttctaacattaatacattctcttatctctttgatttcttccccttcccccttttcatgagaccttatatctacaattctgcaatcattctttttttcttttttgagacagagtcttgccctgtcgcccaagctggagtgcagtggcgctcttggatcactgcaacctccacctcccaggttcaagtgattctcctgcctcagcctcctgagtagctgggattacaggcatgtgccaccatgccgactaatttttgtatttttagtacagacggtgtttcaccaggttggccagtctggtcttgaattcctgggctcaagcaatctgcctgcctcagcctcccaaagtactgtgattatagacgtgagccactggacccagcctcatcttttttttttttaattagaagaaagaatgtaattcttctagtgtctgtatttgcatggatagttgaattacttatagaacatgtttgactagtaaaacctttactttgccctctatgacctcacccatatgtacagaggaaaacatcatccttgtcctcaatagtttcacttctgtttgcccctgatatgcttaatatctgctctgagacagtcccactccccactaccaatactaaacataataccaacggagcataaatagtggaggaaaatcatctaggacacaacctgatctctctttgattctaaactatattcttactgtatgactggtttaaaatggcagaagtacatacatgcacgcacacatgcacatacaatatatgtatgtgtttatgtacgtatgcatacacacacatgtgcatatatttttaacctggactcactcatgattctatggccagataacaactgtgtaagaaattatttggagacgaaaaacagtggcactactccccaacttacctccttcccatcctttatgtcgactctttatggcattagcaattaaaatatcaccttaagctttttaacttaggtttagtgataatggttgtgttattaatagaatgtagtctttttttctattggttttgattcttcttgcttcctcattcttgtcttttttaaggtgcatgatttgtataagagggacactttaggcatacagtaataaagctttgtggcatttctttatggatttttacaaccagattatctttttaatgaatttacatattctgtttataggaacgagtgaagtctgtatttcatgccagagagtttggaaaaataattaacttcaagaccccagaggatgccagggtaaatataataaatcttttatttaaataggagctgctcacttcaaaatcatgtaagtggactattttttaatgcagataagttttgtttgggggtttttgtttgtttgttttgcttttgtgttttggcaggttttaaaagtatatgtaaccagataatatttaccccagacttttttttctaccagattcaattcggcatacctacttgcttttcaaaccagattgctccatcttattttaaatgctaactctaattaattttttttaataaaaaagtcaacaaacaaaaattaattattttgttttagtgttaatccatcagctccaacaggaaagtgtagccccacattgttgatttttctactgcatagctaccgtgattttttaaaaagttgccatagctgacacagaccaaagggagccaagcccaacagaaaatccaagtttgaatactgattttgtccttcttgactatagaatcttgcagaaggtcaactaagcacagtttcctcaagatgagaatggtgtgaactgaaaagcatggtgtgtactttagggattatggcaatcaatcacaaggatgtgcactgtcaagaaaatgaagactatgaattgactgtctgacctcattgatcacaactgaagtgctattcagaatgttgagttgtactcattatatcatgaaacttacagtaagagggtggagccaagatggcagaataggaaaagctccagtctacagctcctagtgtgagcgacacagaagatgggtcatttctgcatttccagctgaggtactgggttcatgtcactggggagtgtcggaaagtgggtgcaggacagtgggtgcagcgcaccgagcgtgagccaaagtagggcgaggcatcacctcacccaggaagtgcaaggggtcagggaattccctttcctagtcaaagaaaagggtgacagatggcacctggaaaatcgggtcactcccaccctaatactgtgcttttccaacggtcttagcaaccggcacaccaggagattatatcccatgcctggctcggagggtcctacgcccacggagccttgctcattgctagcacagcagtcagtctgagatcaaagtgcaaggcagcagagaggctgggggaggggcgcccgccattgcccaggcttgagtagctaaacaaagcagctgggaagctcgaactgggtggagcccaccacagctcaaggaggcctgcctgcctctgtagactccacctctgggggcagggcacagccaaacaaaaggcagcagaatcctctgcagacttaaatgtccctgtctgacagccttgaagagagtagtggttctcccagcacacagctggacatctgagaatggacagactgcctcctcaagtgggtccctgacccccaaggagcctaactgggaggcaccccccaagtaggggcagactgacacctcacacggccaggtactcctctgaaacaaaacttccagaggaacaatcaggcagcaacatctgctgttcaccaatatctgctgttctgcagcctccgctgctgatacccacgcaaacaggtctggagtggacctccagcaaactccaacagacctgcagctgagggtcctgactgtttgttagaaggaaaactaataaacagaaaggacatccacaccaaagccccatctgtacatcaccatcatcaaagaccaaaggtagataaaaccacaaagatggggaaaaaacagagcagaaaatctggaaactctaaaaatcagagtacctctcctcctccaaaggaacgcagctcctcaccagcaatggaacaaagctggatggagaatgactttgacaagttgagagaagaaggcttcagatgatcaaactacaccaagctaaaggaggaagttcgaatccatggcaaggaagttaaaaaccttgaaaaaaaattagatgaatggctaactagaatcaccaatgcagagaagtccttaaaggacctgatggagctgaaaaccaaggcacgagaactaagtgacgaatgcacaagcctcagtaactgatgcgatcaactggaagaaagggtatcagtgatggaagatgaaatgaatgaaatgaagcgagaagagaagtttagagaaaaaagaatagaaatcaacaaagcctccaagaaatatgggactatgtgaaaagaccaaatctacgtctgattgtcatacctgaaagtgatggggagaatggaaccaagttggaaaacactctgcaggatattatccaggagaacttccccaatctagcaaggcaggccaacattcaaattcaggaaatacagagaatgccacaaagatactcctcaagaagagcaactccaagacacttaattgtcagattcaccaaagttggaatgaaggaaaaaatgttaagggcagccagagagaaaggtcaggttacccacaaagggaagcccatcagactaatagctgatctctcagcagaaactctacaagccagaagagagtgggggccaatattcagcattcttaaagaaaagaattttcaacccagaatttcatatccagccaaactaagctccataagtgaaggagaaataaaatcctttacagaaaggcaaatgctgagagattttgtcaccaccaggcctgccctaaaagagctcctgaaggaagcactagacatggaaaggaacaaccggtaccagccactgcaaaaacatgccaaattgtaaagaccatcaaggctaggaagaaactgcatcaactaacgagcaaaataaccagctaacatcataatgacaggatcaaattcacacataacaatattaaccttaaatgtaaatgggctaaatattccaattaaaagacacagactggcaaattggatagagtcaagacccatcagtgtgctgtattcaggaaacccacctcacatgcagagacacacataggctcaaaataaagggatggaggaagatctaccaagcaaatggaaaacaaaaaaaggcaggagttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtccttagagacctacaaagagacttagactcccacacaataataatgggagactttaacaccccactgtcaacattagatcaacgagacaaagttaacaaggatatccaggaattgaactcagctctgcaccaagcagacctaatagacatctacagaactctccaccccaaatcaacagaatatacattcttttcagcaccacactgcacttattccaaaattgaccacttagttggaagtaaagcactcctcagcaaatgtaaaagaacagaaattataacaaactctctctcagaccatagtgcaatcaaactagaactcaggattaagaaactcacttaaaaccactcaactacatggaaactgaacaacctgctcctgaatgactactgggtacataacgaaatgaaggcagaaataaagatgttctttgaaaccaacgagaacaaagacacaacatagcagaatctctgggacacattcaaagcagtgtgtagagggaaatttatagcactaaatgtccacaagagaaagcaggaaaaatctaaaattgacaccctaacatcacaattaaaagaactaggccgggcacagtggctcacgcctgtaatcccagcactttgggaggccgaggcaggcggatcacgaggtcaggagatcgacaccatcctggctaacatggtgaaaccccgtctctactaaaaatacaaaaaattagccgggcgaggtggcgggcgcctgtagtcccagctacgcgggaggctgaggcaggagaatggcatgaacctgggaggcggagcttgcaatcagccgagatggcgccactgcactccagcctaggcaacagcaaaactccatctcaaaaaaaaaaaaaaaaaaaaaaaaaggaactagagaagcaagagcaaacacattcaaaagctagcagaaggcaagaaatgactaagatcagagcagaactgaaggaaatagacacaaaaaacccttcaaaaaatgaatccaggagctggttttttgaaaatatcaacaaaattgatggaccgccagcaagtctaataaagaagaaaagagggaagaatcaaatagatgcaataaaaaatgataaaggggataccaccaccgatcccacagaaatacaaactaccatcagagaatgctataaacacctctatgcaaataaactagaaaatctagaagaaatggataaattcctcaacacatacaccctcccaagactaaagcaggaagaagttgagtctctgaagagaccaataacaggctctgaaattgaggcaataattaatagcttaccaaccaaaaaaagtccaggaccagatggattcacagccgaattctaccagaggtataaggaggagctggtaccattccttctgaaactattccaatcaatagaaaaagagggaatcctccctaactcattttatgaagccagcatcatcctgataccaaagcctggcagagacacaacaaaaaaagagaattttagaccaatatccctgatgaacattgatgcaaaaatcctcaataaattactggcaaaccgaatccagcagcacatcaaaaagcttatctaccatgatcaagtgggcttcatccctgggatgcaaggctggttcaacatatgcaaatcaataaacataatccagcatataaacagaaccaatgacaaaaaccatatgattatcgcaatacatgcagaaaaggcctttgacgaaattcaacaacccttcatcctaaaaactctcaataaattaattaggtattgatgggatgtatctcaaaataataagagctatctatgacaaacccacagccaatatcataccgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagagaaagtcaaattgtccctgtttgcagatgacatgattgtatatctagaaaaccccatcgtctcagccccaaatctccttaagctgataggcaacttcagcaaagtctcaggatacaaaatcaatgtgcaaaaatcacaagcattcttatacaccaataacagacagagagccaaatcatgagtgaactcccattcacaattgcttcaaagagaacaaaatacataggaatccaacttacaagggatgtgaaggacctcttcaaggagaactacaaaccactgctcagtgaaataaaagaggatacaaacaaatggaagaacattccatgctcatggataggaagaatcaatatcatgaaaatgcccatactgcccaaggtaatttatagattcaatgccatccccatcaagctaccaatgactttcttcacagaattggaaaaaactaaagttcatatggaaccaaaaaagagcccacatcgccaagtcaatcctaagccaaaagaacaaagttggaggcatcacgctacctgacttcaaactatactacaaggctacagtaaccaaaacagcatggtactggtaccaaaacagagatatagaccaatggaacagaacagagccctcagaaataacgccgcatatctacgaccatctgatctttgacaaacctgacaaaaacaagaaatggggaaaggattccctatttaataaatggtgctgggaaaactagctagccatatgtagaaagctgaaactggatcccttccttacaccttatacaaaaattaattcaacatggattaaagacttaaatgttagacctaaaaccataaaaaccctagaagaaaacttaggcaataccattcaggacataggcatgggcaaggacttcatgtctaaaacaccaaaagcaatggcaacaaaagccaaaattgacaaatgggatctaattaaactaaagagagcttctgcacagcaaaagaagctaccatcagattgaacaggcaacctacaggatgggagaaaatttttgcaatctactcatctgacaaagggccaatatccagaatctacaatgaactcaaacaaatctacaagaaaaaaacagccccatcaaaaagtgggtgaaggatatgaacagacacttctcaaaagaagacatttatgcagccagaagacacatgaaaaaatgctcacatcactggccatcagagaaatgcaaatccaaaccacaatgagataccatctcacaccagttagaatggtgatcattaaaaagtcaggaaacaacaggtgctggagaggatgtggagaaataggaacacttttatactgttggtgggagtgtaaactagttcaaccattgtggaagtcagtgtggcgattcctcagggatcttgaactagaaataccatttgacttagccatcccattactgggtatatacccaaaggattataaatcatgctgctataaagacacatgcacacatatgtttattgcggcactattcacaatagcaaagacttggaaccaacccaaatgtccaacaatgatagactggattaagaaaatgtggcacatatacaccatggaatactatacagccataaaaaataatgagttcatgtcctttgtagggacatggatgaagctggaaaccatcattctcagcaaactatcacaaggacaaaaaaccaaacactgcatgttctcactcataggtgggaattgaacaatgagaacacatggacacaggaaggggaacatcacacaccagggcctgttatgggatggggggagggaggagggatagcattaggagatatacctaatgttaaatgacgagttgatgggtgcagcacaccaacatggcacatatatacatatgtaactaacctgcacgttgtgcacatgtaccctaaaacttgaagtataattaataataataataataataataataataaaaacttagagtaagaggacatttctcctatacttgatccctgggcctcctggccagactcagaagagatccctggcctcctgcactcatacaacactctgcgttgatcctggctgtggtgactgtttaccagttcacctgtcacatctgaacccaaactaggggcctctcccactgtctcatacacataccttggaccagttaacatgtcctatgcaattttctatctagacattctgatataaggcgacactgacacactaatagtggaaaacacaaaaggagcaagttacaaagaaagaggaataaagttaccagtcttcatatgcttgtcacctggaacagggagacagataagcatgacttttaggccaccttctttcatgtcactgaaggacagtaccacctgtttcaatttacctgcaataaagttttcttttaattccttcaccatgtgactgactttatcccagaaggtttgtttttaatcctcctgcttggccaggaacatccagagaaggctactggattcagttatctttgtctccctatcttagggctattcttactaggctcttttaagttaaagaggtacaaacatctctgtgaaatctttatatattagaataagccctgtatcacctccgtggcttttatctgtcatccatgcccaataataatagacattactggtagaaaggttgtgtattacatttacattttatttttgtaatttcaaattattttagaatagaaaatatattgtgagagcacctaaaatgctcaagaatgttgcttctactaccctctctggaattgtgtgtaagtatttctactccattagtagaatcctgtatctggatttatggaagttcatgatacaaaatcagcacagattggaaggaatttttttctttcaggctggctcatttcacttaattctgaagatgaacatccaaagaccttagaagaactgcattcctactattaaaccaagtactattgtccctgagccatctgggccattgaagtgaatgatctcttttgcaggatgaattttatgtattggctgtcagtattacacctaactaaactataaagctaacttctagatctccattcattacattttgtttcattacaagttcactgaagtaagcaaatgttcatttattttcccaccgcagtggatcctcacaaagctacaagaagcaagagaaccttctccgagcctctgacagagaacactgcctgaagacacacagcaataagtgattacagctcctagactaccttccaaaacctgtttgggaagcatattacagaaatgatttcaagtaccctgtattctggatgctaaaaaacaaaaacaaacaaaaaaacaaaaacaaaaaaacaaaaccagaatcaggtaaaacagctatgtgattaaaatattttaattcttcagcaattacccggttttctaaattgaatcatgcatctatttataattctaattattttgtaaaagaagacaaaattatgaatcttaagtatttgctccatctttttctctgtaatggtggagaggctgcccataattcatctccacatggagccaagtttaatgtttctagttcacattttgtacttctgtcatgcttatttcaaactccctgagtgatgggtaagaaatcaaacattgcctcagtggtatcaagagaactttggtggtggtttcttcagaatcatgaagttcttttgccagataaatattttgatattattttcctttttaatataaaggataggtttgaattgtacttaaaatgcatagcattattaaaaacaatcttttaaaatataatttataacatagattgaagcctccccttaagaaaccttaaagaaataagtatcctactcaaaaaaggaagtctgtttcagaactttagggcctttgaaatatttcctcaagcctatttcatgagatctacttggtttacccaagtcatgtttttaatagactgctaatatcaaaggagaatttttaaagccttaacaatgcctactttccattcactgttaacatggaataaacacaattcccaacatcttagatagtgtattatgcttccaacagacagtccctctcatataaagtttatgtaccctaaaatctaacccaataacctgtcccgttgccaatagattgagaatttctggtttgcttactctacagttattcaaatgagagtcacgcttttaaatttacagctcatcacagaaatcatcagctatacattagtaaaaataaggacatgaggttttctttcttggtttttgtccaagatctttgcaccttaatattaatggactgtttcaggtaaaagagaatgaatgtatgattgtgaactgtgaagagaatgatgcaggatcctatttagttactgaataatacagagtattcaatgcatgttgtatgtgccaccaagttactattaactgtttttggaattgaagactctgtatagtcaatagttgtgaaattcttctcaggctccttaaaccctcgctttgttgtaaaagctaaaataaacagcatgctatattgtaattgtatttcttgctgaccaaatctactaaatgctattgatttctctctgattactaaaacacattgtttattctcagtagtttcccccaaaatgcttttttctttgctgaacttaa

SEQ ID NO: 1483 - DNA, 205561 bp, Homo sapiens
ttcctccctctcagggctgcgcgcccaggtctgcgccgcgctccgcctccagccgcgcgcagacttgcgcacgcgtcgtgagagcgaccgcctccgtctctcgctgggctcgctagggctgcgcgttgggccagcgggggcgccgcagctgaagccgccccggagccggtgaaccgaattacctcgagggaggggcgtggggaaggcggcgggaggaggagcgcacgggccggctgccgtgcccaccacggctgaggaacatggttttcgagtcggtggtcgtggacgtgttgaaccggttcttgggggactatgtggtggacttggacacgtcccagctctctctgggcatctggaaaggtaaggaggccgccgccgccgctccccggcctctcgtgcttcccggccgtctcgctgcccgagcggcgtcctgcgttctcggggcttcgagcaccttgctcgccgggtgcagccacctgccgccgcccgcctgtgggtcaagttacgtaaagccgggcggcagttccctggcctccgccctcgagttgtttatattttgggggaaaggagagggtcatgagtgcgggatgaaaaggtctatattttccgagcggagcggacttgccgtgggctccgtgggtctggcgttcaagtcccggcgaggggccgttctctacccctggccccgcacggtccggctttagccgcgcggggcgaggaggcgagacgacgccttcctgggctgggtcccatccctgtcctttgcccccctgggtttatgacgaaggccccagaaatcccccgcgtgttgcatgctgcctcgcacgtgaaggcagggcgctgtgaccggggacgcccgcttccttgcttccccagcctcaattcctggcttcacccgtggtgctttctgctctcccccttccggccctaggacccggacgccggctctctctcgcctgggttcggcggataacaaaaaggaaactcaagtgcaaagtaactcaaacagttgcttgtgtggttgcagttaacagcctgacctaggaatgtgtaacattttcaagactttaggatatgtgggtcagagtgaattgccgaattttaaagaaaaaccagggcgtgcggtgcaacgtctcagacctgcaaaagaccgggctgaacagggccctacgctgcctaggtggtgaaggaccgagctttccttgtgtccgtttagtgtggtattctgccttagtgagagcctcatttttagtgtttccatctgtttttgcattatgcgcttgtttattttaaacacccgctagaaattagactcctttgtgaaatgaatttcccaggccaaagtgagggttaattttgtgtgtgaagtgtgtgtgtttaaatatatatttaaagtaatttattcttgtctgtgcacacacttccagtcttcttctaaaatacttaccttgactcttctcgtttatgagataatgtaaacaggtagtttagtttgattttaaagaatgttactaccgtggggacctagtatcatgatggagagtgagtggactacaaaagctagggatatagtgatagctgctcagcctgtttgattagtacaagaaacttgcagtctgtttatgctgcttcttagttgcaaagtgaaaataaaatttgtctcccatgtacctcagaaggaagccttaagaatacttgaggtgaactttgatctgtagtggagtcttgcttccacattcagggtggaggtttgtctagagtgtgattaatcaacttatttatttgtttaaaatttacatgcagtaaaattcactcttgtgatacagttctgtcttgacaaatgctaagaggcatgtatgcaccaccacaataatggcacataaaaggttcatcaagcctcccgaattctctcagctgctcctttgcagttgatctcaccccgccaccacgcccggctaatttttagtagagagggggttttgcaatgttggccaggctggtctcaaactcctgacctcaagtaatccgcctgcctctgcctcccaaagtgctgggattacaggcgtgagccactgcgcccgcctgactgtaagtatttatctgtttgctggttgaagaatatttcagtttttggaggttataaataaagccgtcataaacattcacgtacgggtgtttgtgtgaacataattgttatttctcttggataaatacctaagagtggttttaaattgggttgtacgttttttttttttttttgagatttatttcatataccataaatttcactcttttaaaatgtacaattcagtgttttttagtatagtcacaaaattgtacaaccatcaccactctctcattccggaatatttcagcaccccaaaattaaatcgtatgtccattaggagtgactcccaatttcctcccttctcactactccacctctggcaaccactaatctttctgtctttatggatttggtaattctggacatttcatttaaatggaattatatgatatgtggccttttgtttctggcttctttaacctaatgtattttcaaggttcctccatgttgaaggatgtatgactatttcatttgctcttagggttgaataatattccattatattcatagaccacaatttatttatctatactcaccagttgctggatgtttagattattcctaaacatccaccttttggatattatgaataatgccactgaacattcatgtacaagtttttttgtggatgtatgttttaaattctcttggatatatacctagaagtggaattgctgggtcatatgctgactttgtgtaaccttttgaggaacagccaaactctttttccagagtgtttgttttcttatggttgagttttgagagttctttaaatattaaggatacaatttcttcatcagatatgtaatttgaaaatactttctcagtcttttcccattttgtcttttgcagagcatacatttttgattttgggaaaagcccagtttataaaacatttcttttatgaatcatggcttttggtattcatatctaagaaatcttttcccaacccaaagtcaaagatgttctcctgtgttttcttaaggaagttttgtagttttaggttttggatttctttttgtataaggtgtgtgatatgtgttgaaggttgaggttcatttgtttgcatgtggatgcaaatatccaattgtttagcaccacttgctaagaaagaggatcctttctctattgaattatctttgcatttcgtaaaaaaaaaatcagtagacttaatattgtgtggctttagtctgtctcaatctgtgtgtctatcatttcaccaatactacactgtcttgataactgtgtctttgtagttagtctagaaatcaggtaatgtgatccctctaactttagtctttaacaaataatttaaaaaataacaagtcattgtccaggtgtggtgctcattcctgtaatcccagcactttggaaggctgaggcgggaagattgcttgagcataggagtttgagattacagtgagctctgatcatgccactgcattccaacctaggcaacagacagcgagactctgtctcaaaataaaataaaataacatgtcagtgttttatttatagaaattggttatgttttgataaatgaaactttaaataatagctggagtatttttttaaaatattctttgagaatttcaaaagtagtaatttgataaatttggaggattttttaaaaacattgtttgaaaatttctgtaatagaaactaggtggccaggcatagtggctcatgcctgtaatcccagcactttgggagactggggagggtggatcacttcagaccagcctggccaatgtggtgaaacctcatctctacgaaaaaaataagatacaaaaattagctgggtactgtggcgctcgcctgtaatcccagctactcaggagactgaggcaggagaatcacttgaagctgggaggcataggttgcagtgagctgagatcacaccattgccctctagcctggccaacagagcgagaccctgcctcaaaaaaaaaaaaaaaaaaaaagaaactggatgctgcataggaaaattttaagataatattttatggtctaacgtgaaggacctattggtagttgtaaatgtgtgcttttgctaggcttctgaaataatccagcaaatttcaatattagcatgttactataatagtatcaattagtattcagtcattgctaataatggatggtgctctgaaaatttgttgctgagatggattctttggaaatcagaatgcatttttcccatggaagcattcttatatatgaatgaggacttttccaaaaacctgtttaactataatgcagcagaagagtgctactgtactgggttcaatacagtaagtagactcactgctagaagactctgtcttacaggggatgaaaaaggaattgagcttcattccaggactgactcttggcaaattttgatgttggtaaggtatactttttatacacttctatttataattctcccttcccatatatcatctagttagagaggtggtaatatttcatagactcatctgaaatttatcttcccaactttctccagcaattttctttttctttttcttttctttttgagacggagtctcgttctgtcacccgggtgggagtgcagtgacgcgatctcggctcactgcaacctctgtctcacggcctcaagtgagtctcctgcctcagcctcccgagtagctgggattaaaggtgcccaccatcatgcatggctaatttttgtatttttagtagggacggcatttcaccacgtcaaccaggctggtctcgaacgcctgacctcaagtgatccacctgccttggcctcccaaagtgctgggattacaggtgtgagccactgcgtccggccatttcacatattttctttaagagctaggctgcatcagaatcagccataggtgcttattatgaatacagaacctgcccccagagattataaattatttatctggagtaggacatgaaaatatttttttaaacaaatgacactggggacttgatgcacagttgggtacattttaagagaacattaaggggaaaagtattagaattttaaatagacaaaagcagtagtaaaagtggcttgtgtgatagaattatcatttgtaacacaggaagtacctgtacttcatagccccttcttaagttagcctcctttgtctctattttgttttctccgaaatcacaatacttggacaaatttgtaatttttttttgataatgcctgacatctttatgtaacattagaagttcagatttcttgtctattaactaacatacgtattctgtttttgaaatgttaatctcccagttttccctttataatagaatcatgtgtttagtggccacttagctggataccgccatgataccagaagcagtacaaaagatgaagattcagttaggatacagttttcgatttttaaggagtcattcttctgtgcccagaatacactagggagccaaacaaatgattcttacagtctggtgttaatgaccaattctaattccttatgtattatttttatatttatgttctaagatactttaataaaactttaaagactatgaaacattttattataaaaagtgttaggagattttacagtgcctctccatatacccattatctagattctgtcattaatattatgtattaacagctttattgacgtataattaacatgcagtaaaatacacgttaaagtctacaatttgataagttttagcatatatgtgcatgcaggtaacaatcatcacatgataatgaacatatctgtcatacctagaagtttccttgtgcctttttgtaaaccgtatcttctaaccctccttgtcccttatacccttcttgtccccaggtttttgctgatttgctttctgttactgcatattagcttgagttttctagacttggataaatgggattgtacagtttgtattctttcagtctggcttatttcagcataattattttgagattcatccatgtggtagtacaatcaataatttattcctttttattgctgaccatagcaagtggtggtgaggatgtgcaaaaactggaactctgttaatatgtctcctggggatgtaaaatgttaaacaacttgggaaaacagtttggcaatttcttaaaaagttaaacatacatcaaccatgttatcaagccattgtgcttctacatgtttacccaagagaaatgaaagcatatgttcatacaaagatttgcacacagatgtgcatagcagctttatttttaatagccccaaatgggaaacagtccaagtatccaccaacaggtgaatggataaacaaactggcatatccatataatggaataccattaatatttaaccacacatgttttgtcacatacctgtccatctgtccatctctctatccatgcagcaattcatattattaaatgtatttcagaataagttgtagagatgagctcatttcctcctaaatacttcagcatgtgtatcattagagtgcaatatttgcttagtttttttccttttgaggtaaaatttatgtagaagaaaatatacaaatcttaagtgtacattgactgagttttgacaaatacatacacacatgtaactcaaacccagtcaagatatagaacatgaccatcaccccagaaagtctttttcctgacctttcctaatttattcctaccctcatcttcagaggcaacaaatactctaatttttttctttctgtcatacatacacatctattctgctttgctgagagtgttttcttttccttcaagaatgttggagccaggcatgatggctcatgcctgtaattttagcactttgggaagctgaggtggccagatcagttgaggccaggagttcgagcccagcctggccaacatggtgagaccctgtctctactaaaaatacaaaaattagctgggtgtggtggcgggcacctgtagtcccagctacttgggaggctgagacacgagaatcgcttgaacatgggaggcggaggttgcagtgagccgagatcgtgctactgcactccagcctaggtgacagagcaagactccgtctcaaaaaaacaaaaacaaaagaatgctggattttgtcaaatgtttttttctgcatctattactattatcacaggatttttttcttttttaatctgttggtgtgatacattacattaattgatctttgaatgttgaactagccttgcatacctagaataaatcccatttggtcatgacgtgtatgtttagcactcagtatctccaggggtttagttccaagacctgtgcagataccaaagtccacaacagggagggcatggaagctccccaccaccttactttgctctgtccatctctttatctgtatcctttgtaatatcctttatgataaactgttaaatataagtatttccctgagttttgtgagttatcccagcaaattatcaaaccaaataaaatcaggtgcgaaccctgatttatagctggtcaatcagaagcacagatcacagcctgcgacttgtgactgacatctgaagtgaggggcagtcttatggaactgagcccttaccatgtgggatatgacattatctctttttttttttttgagacagagtctcgctctgtcgccaggctggagtgcggtggcgcaattttggctcactgcaacctccgcctcccgggttcaagtgattctcctgcctcagcctcccgagtagctgggactacaggcgcctgtcaccacaccaggctactttttgtatttttagtagagacggagtttcaccatgttgaccaggatggtcttgatctcttgaccttgtgatccacctgccttggcctcccaaagtgctgggattacaggcgtgagctactgcgcccggctcgatatgacaccctttctaggtagatagtgtcattatttaattgaattatagttagtgtctgttggagaattgtttagggattgggggaaaaacttcacatatctggttatctaagggttctgtgtcgaatatgagagtagagagaaaaacctttattttcctttgacagtgtcttatcatatttatagctgttttctgttttgttatacttgtttcctttttaaacagtcttcccctcctcttttgccctctctggttttaattgatcatgtgatatgatttaatttttttctcctgtcttagcataccaattatgcttcttaaacaatttatttaagtggttgtattacagtttgtgctgttcacttaaaactagtccaagtccacgtccaaataacattataggtcaggtatagtggctcacgcctgtaattccagcattttgggggactgaggctggcggatcatttaaggttaagagtacgagacctgcctggtcaacatggtgaaaccccatctctactagaaatacaaaaaatttgctgagcatggtaatgtgcgcctgtagtctcagctactcaggaggctgaggtatgagaatctcttgaactgggaggcagtgagccgagattgtgccacttcactctagcctgggcgacagtgcgaaactctgtctcaaaaaacacaaaaacaaaaatcccactatactacttcatggaaaatggaggtagtatatgtaatactctatcttacaatacagtatacagattcctcccttctgcccattgtaacattgttgtcattaatttcacttacctataagctgtaataatccaatgcattgctgctattagtattttagacatttttctattaatttaagaataaggaagaaaagacttaatttaccttcatctcttaattctctaatgctcctgtgaatctgagtttttggtttaaatcattttccttctttctgaagaactcctttatttatttgttttttttaatttttgagatggagtcctgctgtgttgcccagcctggagtgcagtggcgcagtctctgcttactgcaacctctgcctcctgggttcaagcgattctcctgcctcagcctcctaagtagctgggactacagatgcatgccaccatgcccagctaatttttgtatttttagtagaaatggggtttcactatgttgaccagaatggtcttgatctcttgacctagtaatctgcccgcctcggcctcccaaagtgctgggattacaggtgtgacccaccacacccggcctatcttaaccattttaagtgtacacttcatgtcattaagtacacttacattgtgcaaccatcaccaccattcatctcctgacttcaccattattcatctcctgaattcttcatcttgcaaaactgaaccacttacccgttaagcaatgactacccattccaccgtcttcccagaccccagtaaccgttattctacttttgatgtctgtaaattcgaatacttgaagtataagtggaattatacagtatttgccatttgttattggtttcttttacttggcataatgtcctcaaggtgcatccgtgttgtaggaaatgtcagcatttcaataatttttcaagctaaatagtatcccattgtatgtatatactgcattttgtttctccattcatctgttgatgaatagttgggcagcttccaccttttggctgttgtgaataatggtgttatgaatgtggatatttttctttgaagttcagtctgtgctgtcagatttttgggttacatacccagaagcagaattactggatcatatagtaattccattatcaatttttttgaggaattatcatactactttctatagtgactgcaccattttacattcctaccaacagtgtacaaaggtcaccatttctccacatcctcaccaacatttattttctctttttttgatagtagttatcctaatggatatgaggtggtatcttgtagttttcatttacatttctctaattagtaatgttgaacatcttttcatgggcttattgaccatttgtatatcttaattggagaaacatctatttaagtcctttgtccatcttttaatcaggttgtttgttttttgagttgtaagagtttacatacaaacatacacacacacacacacacacacacacaatgttagctgcttatcagatatatgatttgcaaatatttcccattttgtgtgttaccttttcttcctttttttccctgctaacttttattttaggttcatggggtacatgtgtgggtttgttgtgtgggttaattgtgtgtcactggggtttgatgtataaattattttgtcacccaggtagagagcatagtacccgatagatagttttttgatcctcaccctccccacaccctccaccctcaagtaggccttggtgtttgttgtttccttctttgtgtccatgtgtactggatagagtttgaatacatgtccccaccaagtctcatatttaattgtaatccccattgttggaggtggggactggtgggaggcagttgggtcataggggtggatctttcatggcttggtgctgtccttgcaatagttcttgcaagatctggttaagtgtgtggcacctccctatgcactccccctcttgctcctgctgtgaccatgtgatgttctggctccgcttttgccttctgccatgattgaaagcttcctgcgtcctccccagcagctgggcagatagatgctggtgccatgcttcctgtacagcttgcagaaccatgagccaattaaacctcttttctttgtaaattacccaggctcaggtatttctttatagcaacacaacaatggactaacacagtactcaagttttaactccgtcttgtgagaatatgcagtatttggttttctttttctgtgataactcgcttaggataatgctctccagtggcatccatgttgctgcaaagggcatgattttgctccttttcatggctgtgtggtagtccatggtgaacatatactgcattttctttatccagtccactgttgacagacatctatgttgattccatgtctttgctattgtgaagtggtgctgtgatgcacatacgcatgcatgtgtccttatggtaggacagtttatggtcctttgggtatatacccagtaatgggattgctggttctaatggtagttcttaattctttggtagttcttagttcttaaatctccagactgcattccaaagtggctgaactaatttacattcccaccagcagtgtgtaagtgttcccttttctctgcagcctcaccagcatctgttatttttgactttttaataatagccattctgactggtgtaggatcgtatctcactaatcattaatcctctaatgattagtgatgttgagttttttttttccatgtttcttggccgcatgtgtcttttgagaggtgtctgctcatgtccattgcccattttttaaatggggttgttagttttctgcttgtttgtttaagttccttatcgattctggataattagatctttgttggatgtatagcttgcaaatgttttctcccattttgtagattgtctgtttactctgtggacagtttcatttgctgtgcaagagctctttagtttaattaggtcccacttgccttttttttttttttttttgtagttctggaattttcatcatgaaatctttgtcagggcttatgtccagcatggtattccctaagttttcttctagggtttttatagttttaggttttacatttaagtctttaatctatcttgagttgattgttgtatatggtgaaaggtaggatccagtttcagtcttctgcatgtggctggccgttatctccacaccatttattgaatagggagtccttttcccattgcttgtcagttttgttaaaatcagatggttgtaggtgtctggctttatttctgggctcttgacctgttccattggtctacatgtctgtttttgtatcagtgccatgttgttttggttattgtagccttttagtataggttgaagtcaggtagtgtgatgcctcaggctttattcttttggtttagggttgctttggctattcaggctacttttttgggccagtatgaattttaaaatagttttttctaattctgtgagaaataacattggcagtttgataggaatagcattgaagctgtagattgctttgggcagtatggacattttaacaattttgattcttcctgtctatgagcatggaatgtttttccatttgtttgtgttgtctctgatttctttgagcagtgttttgcaattctcattgtagagatcttttacctctctgattagctctattcctaggcattttattctttttgtggcgattgtgaatgggattgaattcttgatttggctctcagcttggatgttattggtatatagaaatactactgatttttgtacattgattttgtatcctgaaagttggttgaagttattagttctaggaacctttgggcagagactatggagttttctaggtatagaatcataccgtctgcaaacagggatgatttgacttcctctcttcctatttggatgtcttttatttctttctctttcctgattgctctggctaagacttccagaactatgttgaataggagtaagtgggtatccttgtgttgtcctggttctcaaggggaatacttccagattttgctcattcagtgtgatgttagctgtgggtttttcatagatggctcttattatttccaggtatattcctttgatgcttagtcttttgagggtttttaacatgaagggatgttgaattttatcaaaagtcctgaatctgaaaagatgatcatgtggtttttgtttttagttctgtttagtaatgaatcacacttattgatttgtgtatattgaaccaactttgcataccaggaataaagtctacttgatcatggtagatgtgctgctggatttggtttaccattttgttgaagatttttgcatttatgttaatcagggatataggcctgaagtttcctgtttttgttatgtctctgccaggttttgttatcagaatgatgctggcttcataaaataaaatgagttagggaggagtccctccttctcaattttttggaatagtttcaataggattggtaccagctcttctttatatgtccggtagaatttggttatgaatccatctggtccagggctttttctggttggtagactttttatacaatttcagaactcattattgctctgttgaggtattcagtttcttccaggttcaatcttgggaggttgtatgtttccaggaattcatccatttcttgtagattttctagttagtgtgcatagagatgttcataatagcctctaaggattttttgtatttctctgggtcggtggtaatgtcccctttgccatttctaattgtgtttatttggatctcctctctctctttttttttctttgttagtctggctggcaatctatcttatttattctttcaaggaaccatcttttgtattttttttgttcagttcaactctaattttggttatttcttttctgtggctagctttggggttgatttgctcatttttctagttcctctaggcatgatgttagttgttaactttatatctttctaacattttgatgtgggcatttagcactataaactttcctcttaagactacattagctatgtcccagagattctggtatattgtatctttgttttcattagtttcaaataattcctttcttttcttttctttttcttcttcttttttttttttttttgagacaggttcttgccctgttgccgaggctgaagtggagtggcatgaacacggctcactgcagcctccaccttccaggctcaagcagtcctcccacctctcagcctcctgagtagctgggactgcaggtgtgcactcctacacctggctaattttttttgtattttttgtaaagacaatgtttcaccatgttggccaggctggtcttgaactcctgggctcaagtgatccccccacctaagccttgcaaagtactgggattacaggcatgagccaccgtgcctggcccaaagaatttctggatttcagtgaaattaagatttcgttgtttacccaaaagtcattcaggagtggtttaatttccatggaattgtatggttttgagagatcttcttggtattgttacctatttttattgcactgtcatcttgagaacatggttggtatgattgtgggatttttaatttgttgagaattgctttatggttgagcatgtggttggttttagatacgtgccatgtgcatatgagaataacgtatattctgtttttgttgggtgaggtgttctgtagaactctgttaggtccatttggtgaagtgttgactttaggtctgtctaatactgtcagtgggtttttgaagtctcccactattattgtgtggttgtgcaagtctctgtaggtctctgagagcttcttttttgaatctaggtgctccagtgttgggtatatacgtatttaggatagttaagtcttcttgttgaattcaaccttttattgttttgtaatgcccttctttgtcctttttgattgttgttggtttcaagtctgttttgtctgaaataagttacccatgcctgcccttttttgttttacttgcttgatagatctttctccattcctttactttgagcctatgggtggcattgcatatgaaatgggtctcataaagacaacatacaattggttcttggttcttcatatgaattgccattctgtgcctttgaagtgggatgtttagcctgtttacattcaagatgaatattgttatgtgctgatttcatcctgttatcgtgttgttagctggttggtatgcagacttgattgtatagttgctttatagagttagtggtctctgtacttaagtgtgtttctgtggtagccggtaatggtctttcatttccatggttagtactcccttaaggacctcttaaaaggcaagtctggtggtaatgagttcccttagcatttacttgtctgaaaatattttatttctgattcacttatgaagtttagtttggttagatatgaaattcttggttggaatttcttttctttaaggatgctgaattaggcccccaatttcttctggcttgtaggatttctgctgaaaggtctggtgctagcctgatgggattccctttgtagtagacctaccccttctctctagctccctttattatttttttctttcacattgaccttggagaatctgatgattatgtgtcttggggatggtcatcttgtatagtatcttgcaggggttctatgaatttcctgaatttgcatgtcaacctctctagctaggatggggaaatttttgtggacagtatcctcaaatatgtttccaagttgcttgttttctctccctctctttcagggacaacagtgagttgtagatttgatctcttcacataatctcatgtttttgggagatttttttccattgaaaagttatttttcctttatttttgtctgagttgatactgaagaaccagtcttcaagttcttgagattccctcctcagcttaatctgttctgctgttaatacttccagtgatattgtgaagttcttgtagtgagttttttagctctgtcagatcagtttggttgtttcttaaaatgactatttcatttttcagctcttgactcattttactggagtccttaaattccgtggattgggtttcaactttctcccgaatttcggtatcttctgagttttatgcccatcatttcagtgtgattaagaaccatcactaggctgggtacagtggctcacacctgtaatcccagcactttgggaggctgaggcgggcggatcacttgaggtcaggtgttcaagaccagcctggccaacatggtgaaaccctgtctctaattaaaatatagaaattagctgggtgtggtggtgggcacctgtaatcctagttacccaggaagctgaggcaggagaatcacttgaacccggaaggtggaggttgcagtgagccgagatcatgccactgcactccagcctgggcgacagggcaaaactctctcttcaaaaaaataaatatataaaataagaaccattgctggggagctactgcagtcattttaaggtaagaagacactcaggcttatagagttgctagaattcttgccctgattctttctcatctttgtgggctgatgttcctttaatctctccagttgctatcctttgaatgaggctttttgcttttatattcttggatgccccaagggtttgaccttgatataagttgagtttagtcgactggcatagtttcttgatgatttctgggtaccaaggctcagctcagcactcctggcatgcatgctataaccctggggtgttaggactaggcacatgactttgttctctgtctcctcgaggttaagcacccattgcactggtggggccaaggtgttcccggtctgctgggcaacaacactctgatggtggggccggcaaaagtgcttggttggggtggtgacagtagggtggtaaggcctgcatatacattggaaaagccgtcgggggaggctgtgggtgacggtgtcctggcaaaacagtgcggggaagctgtgcgtgggtggatgctggtggaggcccatgtgcaggtgctctctggtggttacctggggcttgccagcaaaggagctatagtggtggctgtcgggaagtgctgcggttgggcatcagcgtccattgcaattggatgtggccaggcagggactgtggaacaggcaaccagggatgggggttggggggggcgctcaaatctgacaagccctgtgccatgggcaagatagttctgttctgtctaggtccaatagtcagcaaagaccaaagctacctagaggtgtgtggtgagctttgggagatggacatacctggccatgctccactgcagccattcccacaccaggccttctgggctccgtgcagactggagtcctgtttctgccaacttcccaagcagctgtctttgcaacctcaaatgtctgtaggggtcatggagcctccttcagctaggattctagaggtccatgacaagaacaggctactccatgcctgtttaactcatcctttccccaggagcatttggggtcagaatgagtcatggtgctaggggagctccctgtaaggttcccagctttctcctccttcagcccaggatccgcatcctccttctgttcactctcagtgccttccttccaaagatctgctcagagtgtgctggtcttcttgatggcctggtctcttggtggtggaagctcttcctgactctgtgtctacttggccaccctgactcctctctgttgtctgttcactgtatatagtgtcatgtgaggaataaaagttttaacatttgacgaagtccaattcacctattttttttcttttgttgcctatgcttttggtgttatatccaagaaatcattgcaaaatgcagtgtcacagaactttctccctatgctttattctaagttttatagttttcagttttacatttagctcttggatccattttgagttaatttttgaatatggtataagcctgtcacacaggctggagtgcagtggcgcaatctcggctcactggaaactccgcttcccgggttcacgccattctgctgcctcagcctcccgagtagctggtactgcaggtgcccgccacaacacctggctaatttttttgtatttttagtagagaccgagtttcaccatgttagccaggatggtctccatctcctgacctcgtgatctgcctgcttcggcctcccaaagtgctgggattacaggcgtgagccaccttgcccaacctattgatctttttagaaaactaacagtcggtgtcccggtgcagtggctcacgcctgtaatcccagcgttctgggaggctgaggcgggtggatcacttgaggtcagcagttcgagaccagcttggccaacatgacaaaaccccgtctctactaaaaatacaaaaattagctgggcatggtggtgggcccctgtaatcccagctactcaggaggctgaggcaggagaatcacttgatcccaggaggcggaggttgcagtgagctgagatcgtgccactgcgctccagcctgggcgacacagcgagactccgtctcaaaaaagaaaaaaaaagaaaacgaatgctttatttttatttttattttttttccattctctttcacttatctttgctctgatctttattattttctcccttctgctaggtttgcattttgttttgtttttttccctatttccttaaggaataaatttaggtggtgatttgggatgtttcttctttttaaacataaacagttacagctttatgttccttctagcgctgcttttgctgtatcatactaattatgatggtacagtctttttattttcatctcgatattttctaatttttcttggggttacctttttgacccgtttcttatttaagagtgcttaattttcatatatttgttcattgttctgtttccatctgttatttccttatttattttatttatttattgttactagaaaagataccttgcataacgtcaatcttttataattttacaattttgtttttaattgacatgtattgtgcatatttattaggtacagggtgatgtttcaatacatgtatacattgtataaaaatcaaattggtatttagaatatccatcaccttatacattcatcatttccttgtggtgaggacattcaaaatctttcttctagctatgttaaaacatgcaatacagtattgttaaccatagtcactctgctgtgcaatagaacaccagaacttattcttcccatcttactgtaactttattctcattgaccaatctttacctatttcccctctcgccagtattccccagcctctggcaaccactattctatacactacttctatgagatgtcaacttttttagatttcacacgtgaaatcatgcagtatttgtctttctgtgcctggcttatttcccttagcattatgccttccaggtgcgtctgtgttgctgcaaaggacaagattatattgttttgttttgtttttttttttaaatggggaatagtatttcactgtgtatatatataccacattttctttagcagtgcatctgtttgtagacacttgatttcatatcttggcttttgtgaaaagtgctgcaataaacataaagtccaggtttctcttcaacaaactgatttcatttctttgggatatttatacattagtgggaatgatggatcatatggtaattttatttttaaattttttgaagaacttccatagtgtgttttataatggctgtactaatttatactcccaaaaacagtgtgtaagagtttccctttctccacagtcacaccagcatttatttttttgtctttttgatgatagccagtctaataggttgaggtaatatcttcttgtggttttgatttttatttatctgatgatgggtgatgctgagccttttctcatatatatacctgttgaccatttgtatgttttcttttctctttacaaaaattttgacacttgttttatgacctcacatatatcctggagaatgtcccatgtgcacctgagaaaaatgtgtattctgctgttggtgggtggagtgttctgtatgtgtcttttggtccagttggtcaatagtattaagtcctatatttccttattaatcttctgtgtggttgttctgtccattactgaaagtggggtattgaagccttctactgctaatgtagtgctatctgtttctctcctcaattctgtcagtgtttgcttcatatgttttgctggtctcatgtttggtgcatacatgtttataattgttacatctttttagtgaagtgtcggttttatcattatataatgcccttctttgttttttgtaacagattttgacttaaagtttatatgtctaatattagtataggttgaatatgccttatctgaaatgcttggaatcagaagtgatatggattttggattttttttttcttcagattttagaatacgtacatatacataatgagatatcttggagatgagacccaagtctaacacaaaattcatttatgtttcaaatataccttgtacacatagcccaaagataattttatacaatattttaaataattttctgcatgaaacaaagcttgtgtaccttcaaccatcagaaaggaaaggcgtcactgtctcagctgcccatgtggacaatctgtggttgtttggcatcatcgttattcttgactgaatttatatgctgatcagcaataattttctcacatttattcacacgtaagttgttaacagtaagacatatgaggtaccattaattcagtgaaaatacagtgtgttcagggtgagtaagcagcacagtagcatcactgggaatatatgtatccactgttaaacagcagcagcaacaaacagtggcaggcaggctctcagtctccacctacaatgctgtgttttgattaaaaggtaactgtagaatgtactgtatttatttattttttttttcaagtgagaagaaacattagaagcagttgaggggcccggaattggatcctcaggggatgaggaggcattttgctagatggcttttaaaaatgtttcctccagaaccatctgcctcactaactcttttttgtctgagaagtctctgattttataaactgtcataatttattgttctgttatgaatgcctgctgctccagtcctttaataagcccatcacacattttcaccatgtaccatgtggtctataggtacctttttgcattggtaacatcatcatctttatcttcatcatccacttgtggtattatgtctgcactcagaaagtttccgattttggagttttggattagtgatgcccaggtatctttgctcttttggttatttttgcatgggcttacttttttttaaatctttttgcttttgacctatgagtgtccttagagccaaagtgagtttcttgtagaccacgtacttttattttttttgtctctctctctttctctctatttatttattttgagatggagtctcactctgttgcccaggctggagtgcagtggcgtgatgtcggctcactgcaacctccgcctcctgggttcaagcaattctcctgccttagtctcccaagtagctgggattacaggcatgcaccatcacgaccggctaattttgtacttttagtagagatgggatttcaccattttggtcaggctggtctcgaactgctgacttcaggtgatccacctgcctcagcctctcgaagtgccaggattacaggcgtgaaccaccgctcccggctgggatcctgtttattttaatccattctgccaatctgtctttttgtaggagagttaagccatttatatttgaagtagttacagatagggaaggacttaatattgccattttgctaattactttctatgtgtcttacagcatttcttctttctgttttaccccttagtgcctttcctttggtttagttaattttttatagcaactttgattcattttgtgtttaattaactaataacataattaatattaacatcaagatagcaatgaggtctcgctgtgttgcccaggctggacttctaggcttgtgtgatcctcccacctcagcctcctcaagtagctgggactacgggtgcctgccaccatgcctggatgacttttgtgtatgttctaaaggtattttctttgtggttacgatggggttacatgtaacatcctaatgttatagcagtgtattttaaactttcattaatcccattacctgtatgttacagcttttgcaattgtcctatagttcttagacattctgttctattatttttctcattttctttttttattggctttgaattgggaagtttttatttacgtatcttggggcttactgattttgcattaaataattttttctcaatggtttattgcaagtatatttaaatgtagtttactttttgcatgttgatcttgtatcatgctactttgttagactcatttgtataattctgattaaaatgtttgtatatattaacattgagctacaattgcagaggtcaaaagatacaattagtgaagatttggtcaagcatactctgttagactatgtagaagaatgaaggtgagataataagattataggcagattatattatctgttatgcacattatttatatatttttcctgattatgacaggaatgaagcatacatattaactttttaaaatgaaaaatatttgattgtttgaatcttttttttaatcttttttaggagctgtggccctcaagaatcttcaaattaaagaaaatgccctggtaggttttgactatgaaaaatttgtaaagttattgcatttaattatgtataattcttcctgattcagtttgtcaccttaaattatttaaatttgagaaagttttttgtaaataatttttgcaaaatgtaaattttgctaaatggagttttaatctccctgaaagcacaaatggacagtgtgattttttttctatttaaaaatacatattgttttaggctgggcatggtggctcatgcctgtaatcccagcactttgggaggtcaaggcaggtggattatttgaggtcagtagttcgagactagcctggccaacatggtgaaaccccatctctactaaaaatgcaaaaagcttcgccaggcatggtggtggacgccagtaatcccagctgccagggaggatgaggcaggagaatcgcttgaacccaggaggtggaggctgtagtaaatggagatcgtgctactgcactccagcctgggtgacagagtgagactctgtctcaaaacaaaacaaaacaaaaacaaacatacaaaaaatacagatgtttttatttcaaatttttaacttgttttctgattttttttttaagacaggctcatgctgtgtcaccccaggctgcagtgcagtggtgtgatcatagcttactgtaggcctcagctcctaggctcaagctgtcttcccctttcagcctcctgagcagctgaaaagtttttaatctgataaagactagttcatttttttaattgcttgtgcttttattgtcatattcaagaagtctttaccgaatctaatgtcgtgaagattttcccttatgttttcttctaagagttgtatagttttagctcttaggtttagatcttagatccattttgaggtaatttttgtatatggtataggataagggttcagtttcatgtttttgcgagtggatatctagttttcctagcaccatttatttaaaaggctattctttgaatggggagaacgttttgaaagtttattttttacaaaacgcgtattttgcaaaatagagttttaatctccctaaaagcataaaatgacattgtaattgccacttctttttcttaaaataatataaaattggtaatgatttgatatgagtagattttctggtcatttttactgtagacctttatccccaattattattaaaagagcagcttccctggattttatggatttgatagtaatattgcagttatatgtttatatatttaaataaatgttgatgataaggaaatgtgtaagtttattaaaaaatcccttgaaataatttttggaagtaaagagtattcatttatgttgttaaactctatatctactaatgttttgtgtatatataaattttttctgtagagtcaactggatgtaccatttaaagttaaagttggtcacataggtaagccatattcattattgggatatcctccttcctggacatgcagccagaataatttgcctaatatatctattatgtgatatttttcatgtttctgagcatcaattaaaaataatcatgtgtttttgtctcagtagagctttgttgtgcaacttaaaaatattgtccgatacatatatcccttgcctagtatttgatatcctaatacattacatatctctttaggtggtaaattgagttaattcaaaggattacctctaagggagagcttaactgtttcagtttcctaggtttctgtctagttaccactgctatattttgattaacattggatatattgtgtaaagaataggttctgcatcatccaggccctgtgactaggggccgatttgaaaactaatttctgctctgcaagtttttgtatggtttcagaaaatactgtgctttttcttgtttggtattatttttaccagtgtttactgtttatatcttaaatatattggttgagcagtaaatgattggaatttgaggttttaacatctttaataaaaacttatctgtcatgtttcttgtgttacagttttactggtttaaatattgtgcaagataatagtgtctttagttgggacttggagatatttttgttatatagatagttttgtggtaggatgtatacattgttattgaagctatactgttgtcacttggggaacaaagtattctgaaaggttacctagattacatgataaaggtcttcataattatgtgtacttatggttggtattagaccacataccatagaaaactttcatcatcatatgttactgacagtagaattctatcctccccactcctaccttttaaagactgtttactgtaagagggggagaatgtcacccatttttatctacctaacattttaattttttcatatttctgattatttacatgtgtacattttaaatacttacaagtttatatgtattgaaatacttgtaattatgctatttttacagttttatattttttcattagcgtataaaaaggatttctcataatctgagttgatttgatctcatttattctgtaccataataatccagtgaatgcatatttggatattgtagaataattttatttttccattggtacagaagtattacaatacatatttttatataacttttaaacttttaccaaaggtcattgaattttacagtgatgattgtcgtatttcagtgtatgtaaatttaacctcaattcaagaacagtcaaaaaatatatcaggagagtagatagactattttctttagaatctgcccgccttctcttttcttgcctaatcttgtttaaaaatgataaggtaatttttagtgataatataagatagtagaaagtacactgaactaaacccaagataattttgagagtcatttaaggtgttgtgtacctctgtcgtagcacctgtcttttaaaaatatcactgttttttcccccttctagtagacatcgagtttcttgagaagaagtgggtttaatttttaatgtatcctcaccacttagcacattacttggtatatatagtaggggcacaatttattgtatgaaagtaatacatgtttccaaatgaatgatacagtagtacaatcagttttataggaatgtatgtccccttgctattattgggtattgatctttcaaaatttccctcgtttagaatgcagaattatagatatatcaaatataaatacacatgtacatattataaaagaggttgtcttctgtggaaggtttttggaattacatctgtgtatttttttgaaatttgccaaattttctactaggagtctacattttataagggaaggaagaaaaggtttgtttgtttgtttggtttttgagacagcatcttgctctgttgcccaggctggagtacagtggtgcgatcttggctcattgcaacctatgccttcctggctcaagtaaccctcccacctcagtccccgagtagctgggactacaggtgtacgccgccatgcctggctaatttttgtagtttttgtagagacagggttttgccatgttgcccaggcttgtcttgaactcctggactcaagggatcctcctaccacagccacccaaaatgctggggttacagatgtgagccactgcgcctggtcaagtttggattttttaaaaaaacatttgtggtgaaaatggcacactgttaatatgtgtttattatttttacagttttgtaattgctctttgtccttttgttcatttactttttttgaagtattactgtatgtattttaagcagtctgttggtacatttataaataaattaaccgtgtcaaatttgttacagttttttcacaatcttattatttcattttggttatatttttggtctgtacagaaatttgaaatgatccccatgttctctggtttaaaaacttagaaagttattcctcttttagaaatcagatagtttagaggccgggcagggtagctgatacctgtaatcccggtactttgggaggcagaggcaagaggattgcttgaggccaggagtttgagaccagcctgggcaaaatagtgagactgtgactctacaaaaaatataaaaaagaaatcagatagttcatttttctctgaagtgatattatatgatgaaatctttttctcagtttgaagttttctacacatggagtttataaaatatcatgagatggatctaagtggatttaaaaaaatttcccaatcactaaccagttttagcaacatagtatatttaataatctattccttacacaattatggcagctgtataaatctagacactcataccatttaaacaattctaaaatattttaaaactctctattacgaaaatattctcaagatacaaaactagagtgagtagtataagaaaccccatacatagtgtttttgtagttcaagaacccttacgcttaaaaaaaaaattctttgctgtttgattttcttaggatgttttcattagtttgcataattttcaaatattacccagaatattttattattactttatgtgtagttttcatatatatagtttatatgtatgattattaccatatgtgtatatgtgaattactatacatacatacatacgtatgtaacacacatatacataatgaaaaatatacatacacacacttatttaaagtatacaatctacctttcattgcggggaggtaaaggtctcactctgtcacccaggctggagggcagtagcatgatcatggctcactgtagtcctgacctcctgggctcaagatcctcccacctcagcctcccaggtagctgggactacaggcacatactgtcacgcctggctaatttttttagtttttattcatagagacagggttttgccatgttgcctaggctggtcttgaactcctgggttcaagcgatccacctgccttagcttcccaaagtgctaggattccaggtgttagccactgcgcctggcctaatctaccatcttaaagcattaaaaaatataggtttagagtaagaactggggaaattcaaagttatgatattaaggattgttgattaagggaagaagaacattgttttgtttatggtacagagaactgtaaatagaaacttgtatatttcgaatataatctaggttttccaacagtactgatataaatacaataatttcaaatcattacaacaaacacttgttgtttgtagttgtaaaatagctttcaataaagtgattaaacgcttaaggacaaaggccactttattatctcttcaatgcctgacagaaaatagactaaccataaatgcaggttgaaggagtaatattttttgtcctttttttttttcccaaaaaaatgtaggtaatcttaaacttataattccatggaaaaacctttatactcaacctgttgaagccgtattggaagaaatttatttacttatagtgccttcttctagtaagttaaatttaaaaaaattataatttaagttattcttttttatggatggaaaaatatttatattcaaaatacttttggaatttttttgagattttaatatttaaatttgatatttgttaattcaaattaaattggtttttactctacatttttggcaactttgaattatttattatttatttattattatttttttttaagatggagtctcgcactgtcacctgggctggagtgcagtggcaccatctcagctcactgcaacctctgcctcctgggttcaagcgattctcctgcctcagcctcctgagtagctgggattataggcgcctgccaccacgcccagctagcttttgtatctttagtagagatggggtttcaccgtgttggccaggctggtttcgaactcctgacctcatgattcgcccagcttggcctcccaaagtgctgggattacaggcatgagccaccgcgcccggccaattaatgattatttgtaaggatttttttggaatgactatatttaaatttaaggtagttatgattcttcctttttaatcttcctataggaataaaatatgatcctttaaaagaagagaaacaactcatggaagcaaagcaacaggaactgaaaagaatagaagaagcaaaacaaaaagtagttgatcaaggtaaagaaaacagtaaataacaatgctaataagagaagtagaaaagacctaaatatttatcataattgaatattatttttctctggagatgctgagattatttcagaaatatgatagaatctcattgcatggggaattttaatgtggtttgtatgctttgttatgtgtacaggaattttaccttatggaaatttatcttaaggcaaataatatgtctagcttattattattattaggtttacatattttttatatatatatatatacacacacacacatatacatactaggtaaggtcagtttttaatgatagcaattaattttatcaagcatattttcttaattttctagcctttgcttttgtattccttttatatcaattcttcacccttttggagatacttagtttcttgacatatttctatttgcctctatctgtttatttaccctctggcttcacatattttccaattaaacttagacaatatgttccattactgcaacctctttttcattattggaagcggtgtcctgaagaaatctaattccttttcacctgttctctgatccttactgccagctactttttaaactctcacctagtgggttttttgccttggcatgtaaatacgctgttctttatcttgaaacatgaagtcattttcttaacctagtcatctgtttatgttcttctcctctgtcattcatttaatagttaaacatcttaaaattaaaaagtttactgacttcactgtctctgaaatgcattgattttcttttaataaaaaataataagcttcaataatgttttacttgttggcaaacattaatagagatttaacatgtaattcttggcaatatctcttgtaattctgttttttctctgtaacagttactttatattatgtgtagtcatttatccttacctccagtcctctttcctaagtctcttaggccttttctttttaaaaattatttttattttatcaagataatatatatacatagctttaaaagttaagcagtattatagtgtccggattaaaaaaaaaaaccaactgttcctggcccaggcccgcacctatattactaaatatggtgctcaaacctctgtgtcttgatttatttagatattatatatatatatatatatatatatatatatatatatataaaacgtgttatatgtaacataacatgcatattatctataacataacatattttataacatataattaatgacattacatattttaaactcatctcgtgtttcattggcatatatatgacatatataatatataacgtgtaatatatatattacacacacatccttttatgatgtactatgaagattgaccctattttttcatcttctctatatagttctgtcacatttttggttaaatcagaattcattgttaatagtatcatggctatatataaatgttttatttatatataaataaagtggctttaagtatgactgtttattttgtaggcttttagttaacctccctgttctcccatgtacaaaatttggatcctattagggccattttctctaaaataaacccttgtgttctcactagggtgggaaagggatgttgcttggatattgggctgggagagaaggggacctaacttaactgctccttatacagatttaaatcagttcttgtgttatcttcctctctctccactgtgttccatgtttgctattttttgtttggtggggtttccagttcctgtgtctttccagggttctgtgacttggatttttgttgttgttgttgtttgttttaaactcatcttgtgttttgtttcattaccctgcaagatataggcattgatatgcttttcatgtaaaatggatagttggttttattcaggattggtactttattgacagtaatatgcaaaaaaagagcaaagggatttaaggtgttggtaaaataacatatcatggaatctgagctgcataaggaagtcaggaggaagtagtgggtagagaaagaaagacaacatttaatcgaatgactaaatgaatttataaaagaaaagattttattaggtagtggtgagagtcaaagattaaaatatgatcctctgtctttaaagagcttgtattctgttgtctacttaattctataatctatttatatgtatatatattcatttaactctggtgtatttgaggtacatatgattagtatcttcagctttcctttatctaaggcctcctgggccagctgaatttgagagtaataggcaattagaggaaaagatagatttatatgtattatttctatataggagtagaaatatgaaaagaggaacagaattagaaataaagaatatagctttcattggcatttttaaggggagaaaaaggataataactatgattatcaaaggcatatttcaaaaaaattaggaacctcaattctttattcttctttattcttggtttttctttttttttgagacaaagtctcactttgtctcccaggatggaatgcagtggtgtgatctcggctcactgcagcctccacctctctggttcaaacgattctcctgcctcagcctcccaagtagctgggactacaggcatggaccaccatacctgcctaatttttatatttttaatagagacggggtttcgccatagtggccaggttggtctaaaactcctgacctcagatgatctgcccaccttggcctcccagagtgctgggattacaggtgtgagccaccttgcccctccaattcttgattctttctatttctttggaaagtaatggaacttgagatagttaatgctgttttctgaacatgaaatagttgatgaacttctttcatccttgttcaaaagaagaaagaagatcttatttcctattttgtatttactgggggaggaggatattcaactgttttacacatctatacacaggcaacttaatggtggtatcactaattttgagagagatttctgctttgctgctgttagtggattttctcatttaagtctattgtaattcttacccaataatcttcatttttaaatatatttttgtactcaggcataggttaacagaaattataaaatttaatgccagtaaattctacatggtctgctttagtctcatggcacaataaactagcttttgaaaaatgtttacttgcttttgaaagacttttggaaagcaagctattagtgttctatttacatatatatgtatatttcagcaaggcaacgtaagcatgttacttcagtatgtggatatttatagagtatatttttcattcaattttaaaaaaggaatatttgcaattgtagaacaacatctgccggaaaaacaggacacttttgcagaaaaattagttacacagatcataaaaaatcttcaggtgaaaatttccagtatccatattcgttatgaagatgatgtaagtattttaatatgtgatatttgtttttatatttatatgtaagttattttactatttaatgacacctactttttaatggccaatctgttaaatcccaaaaggttacagagctaaagatgatgtgatccttcttttctataattatagttgtaatttgcagtccttagtgttgagtgcttgattttacactttcccaaaatgttcagacattagatcatgaaggaaatgccttgggaattatgaatttagcagttatgtatttttaaaatactttaaagtatgctatatttacctcctggatggagtactggtctagcaattagtggagctagccttaaataattccttgatcctgaataggtcatttgttttctcttaaccagataattatttgctttataatcctattttgttagtcttttttaataattttttttgtaaactggaaaacatgcagtataatattcctgtgtaacacgaatacattaataattagtattctaatttgttttaggaaaaatataggaatgaaagtttttctggaaagtaataaaatgtttctgaatgtttgaaataagttacttcccaaaaagttatccctccctcccttcctccccccacctccctctctctctctctctctctctctttctctttctctctttctttctcttctcctcttctctcccctcccctccccttgcctccccttcccaagacaaggcctcacactgtcgccaggctggagtgcagttgcccgatcatgactcattgcaaccttgacattccttgctcaagtgatcctcccacctcacccccacccacccaccctgcagtagctgggactacagttgcaccccaccaggcctggctaattttcttaacatttttttttgtagaggcaggatctcactgtgttacccaggctggtctccagagctcaagcagtcctcctgccttggccttccagagtgctgggattacagatgggagccgctgcacattgacagttttttctataaagtggattttatccaactactaaaaatctgaataaattttactttctttcctctttagatcacaaatcgggacaaaccgctgtcatttggtatttcccttcaaaatctgagcatgcaggtattttgtttataaaagaatcttaaccatatttaatgtgcaatatagtctattaaactgctactatttgtatatgccagcatcagaaataggtgtctatgtagaacgggtgcacaaagggtcttcattggattggaatcgagggtatgtagattcacatttcaaaaaatggttgaaaatcaaattcagaaatatgaggtcctattattattggtaattatgatgttagatgcttttgcttactttaagaaatccatttccaagtttgtaatgagtaagtaccaaatacaagtaataaatgttcatatctgaaacttcgataagccttgaaaaacaaaaatcttcagtttttctcaatatcattattaatattgtagcatagtgttttcctgtttaatttttgaaattgaggaattttaaaaatataagaacatgtagagaattttgaaacatatgcttgcctccagaatggatggctgttaaattaagagcctattaaaatagcctatttgcttaaagtcttaaatatttttataggaataagctgttttggataaagtttgaatcccttttgttttctacttccacccacccgtccttccccagagataagtatcctaaattttaaaacttttatataatatatctattaaaaatgtaggattataaaagtttacgcgttttatatgactcttttatgagttcctttttgcactttccagtgttgttgacatttatctgtgttaccacatgtaacaaaattcattcagtttaactgctgtgtatttcattgcatgattttatttgttgtatctattgggttttgtgtaagatttctttttaattttattattatttttaaattgggcagcctcccaagccagagcaggctcagagagactccacagtttctttttaaaatgtggccccactgcaacgaaaaaagaaaaaatgccctccaaaaagttactcaaatactctcattaagttgaaaaataagaatggagaattagccattggattgggcaatgtgaagatctttggtaaccgtgataacagtagttactaatcatcacctttggaaacttgtctgccagcctagacctgttcagttagaaactctaggatttggttgcagcaatctgtgttttacaaagccctctaggtcagggttcctgggccacagaacaggaggtaaggcctgggagtgagcattaccgcctgagctctgtcagatcagaggtggcattcgattctcgtaggatcctagcgaaccttattgtgaactgcgcatctcagggatctaggttgtgcccctgatggaaaagttatctcctatgaaactggtcgttggtgccaaaaaggttggggaccactgctctaggtgatcctaatgcatgctaaactttgagagctactattctaattatccattcagttcgtctccacatagaaacgaaaaccatctttctgaaataaagatctgatcactttattcctctcagtggcttttcattgctcttagttttatccttaaacaacttataaaccctttttaaaccgaccccaggcaatatacctggttttactttttttctctgtctgttttgcattatattctcctgcatactgagctacttcagttgcctgaatgtgccatatatttgtgtacttttgggctctgcctgttgtgaatcatattccctgtcgaccttagaatcaataatttttagttacatgttatatattaggttatatataacatctctttatccatcacacccctgaattggatgctcctgccatgccctctcaatgaaatgagagggcattttttttgtagagacaaggtctcactttttgttgcccaaatttgtctcaaactcctggcctcaagcaatcctcccaactcagccttccaaagtgttgggattacaggtgtgagccactgcacccaatgatacctgcaaatctaaatagctcctagaacattcttttataagttaaatgagttatgagttttagaagttaaatgagtatttaacttctgctgtggcacttacctgttggaagttgcctgtttctttgtttgcttttctgacccgcaatgagctccttccttgaaagcagacactttactgtggtcagttagtattttttgatggagtgatatgtctttaaaggcattttcatgaaagggacattggtctagggtatggtagataatgatttattactctgctgtttcaaatggaatgacctttttactgccattgttttttttccttttcagacaactgatcaatactgggttccatgtttacatgatgaaactgagaaactggttcgtaaggtaaataaatactgtgtttgtcaactcatggacttaagagaattttggaaagccaaatgataatatatagataaggatgtatgtgaattttgcttatttgtttaactctgtgatatggctcacttaattatttgagacttctgaaaatagtgtatgataaaaattcttcaaagaaaatgagacatctaataaattttattttcagttaatccgattggataacctgtttgcctattggaatgtgaagtctcagatgttttatcttagtgattatgataactccttggtaagtaaattttttctgtatgtatttgttggtatcatattttgcatgaggtttaattcattgtcatttatctaatatactgtagtcagtattttttcctaggcacaatctattagcagaatttacagatacaggtgaagatgtgtgtaactatacacaaacatgaatacatacccccatatctttttttttttttttttgagacaaggtcttgctctgttgcccaggctgaaatgcagtggcacgattatagctcactgcagcttctaactcttgggctcaagcaatcatccttcctgcctcagcctcttgagtagcgaggactataggcacacgccaccatgcccagctaatttttaaatttttttgtagagacaaggtctcactttttgttgcccaaatttgtctcaaactcctggcctcaagcaatcctcccaactcagccttccaaagtgttgggattacaggtgtgagccactgcacccaatgatacctgcaaatctaaatagctcctagaacattcttttataagattagtttggtgagatgttgtttaactactttaatattttgccatagctaagttctaagtttgaattggtttttaaaattgcttttaaacatttttcttttgcagataataggattttttaggataaagacatattggcatgaatatggctaggcgtggtggctcacacctgtaatcccagcactttgggaggccgaggcgggtggatcacttgaggtcaagagttcaagaccagcatagccaacatgttaaaaccctgtctctactaaaaatacaaaaattagccaggcacggtggggcacgtctgtaatcccagccactcgggaggctgaggcaggagaatcgcatgagtccatgagacaggggttgcagtgagctgagattgcaccactgccctccagcctgggtgacagggggagactccatctcaaaaaaagacatattggcatgaatataaataaaagcaatttgtcttttaataggacgacttgaagaatggcattgtcaatgaaaatattgttccagaaggttatgattttggtaagtacattttataagataaaaaaagtagttaaagtaattggtataaattttaaattagcattgttgctatcactgtgctagttcctgttaaatttccttctatatagttaaatgtatttataatgtatatacaaaagcaaataatattatattttttagtaacgtattttattgttatgaagcttttgactatatttcaaaactataggggaaaatgtccaacaaaagatgttaataaattatgataaacctctaaggattattcagtaacaattagggtaatatttatgaagacatttcaaaatggcaagtaaaatttaataaggctagctagtacagcctttttcgaaatagtaagatcacgctgcatttaaaatttttttaatttatacttttctatgttttcctaattttccaaaatgagcatccattacttttacaatcggaaatgaattactaaaacagaaagaaaaaaatcagtgctgtttctcagtttcccaagtagctgggactatgggcacacactgccacacctggctaatctctttcgtattttagtagagacggggtttcaccatgttgcccaggctggtctccaactcctgagttcaggcaatctgcccgcctcggccttccaaaatgctaggattacaggcatgagccacctgggaacctgggaggtagaggttgcaatgagccaagatcacgccactgcactccagcctgggtgacagagtgagactccgtctctacaaaaacaaacaaaaaaaagtgctgttttttctatgataagggcacttaataaaagttggtgatggataacttaattattgaatttgcatgcctgatgtcattaaccatagaatatccttcctgaaagtatttcctttcttggctcagtgatacttttctgtctatattatacaccttcatgactactcaagtgattcttctttttgtgcccactcttaaaataattatttttattggtttgaatttagtttcattttcttgattctcttctcataggaaatattcagaacagatgagttatctgtcatatgtgtttatgattttcaaatccataatcgtaaattcgacttatttctcctttgccctgaagtcatttttgttgtatcagagttcagtgaggagagagaaagtactgagtaatttgaagaggacaaatttaatataaagaattaccaactataagaggagactggagtaacaagggactgtctcataaaaatgctaaagatatagacagaagaaacatcccctaccctagggctaagacggggtgcccaaaagagagggtccccctccttcaggactgagttgtagaccttgttggaggacatagcgtggcttattgaatggcaggaaattatctgtggtgctgtgccagcaaaacctgttggtacttcactctctggaactttctggaaattacttttagggagcctcatggaggggtgtctctctgaatgcactccagtacaaaactgccttagcaaggtgctgggggaagttgctggcatctggctgcatctagctgccatgtactgcataaggccggtgctgaagaactccgtgctggaggaaccagacactgcagaagctaccggttctgtaggagctgggtgtgggagaagccgtgttcttgcaggagtctattgaatgaacatactggaaccaggcagcataactctttcctcctgcagtgtctctccagtgtcctctactgataaagcttaacattacgccagctggaaaaagaaaaaaaaattttttttctctacattctctgccttcaaaggaaacatatttaaagatccccaaatcatttttcagagcaggctatgaaggagaagtttggagctcagaagtaaaaaattgataactggcatacctgttggagagcgaagggggaatgaagggtttctttttgtttgtgtttatatttaatcagggagatgacagcttgtttttaggctgagatgggaatgatccagtagaacatgacaaattgacgatgcaggagaaacgggggacagtttctggattgatgtaggtgaaagagaatggtgtctagtacgcaagtgaagagctttgctgcatataggagcatagttaatttatatgatagagtttagttgtgagagaagtccttatactgagtagatgagtagatatggtgataagagttgatgtaaattctcttctgagctcttcaattaaaaaatatgtatctgaggtatgttagggttctctagagggacagaactaataggacaggtgtatatttaaagatgagtttattaaggagtattgactcacatgatcacaaggtgagatcccttaaataggccatctgcaagctgaggagcaaggaagccagtctgagtcccaaagctgaagaatttggagtttgagaagaagaatttgaatgtttgagggcaggaagcatccagcacaggagaaagatgtaggctcagaggctaagccactctggtctttccatgttcatctgcctgcttttattctggccatgctggcagctgattagattgtgcccacccagattgagggtgggtctgcccttcccagtccactgactcaaatgttaatcttctttggcaacaccatcagacacacccaggaacagaagttgcatctttcaatacaattgagttgacagtcaatattaaccattacatgagatgttggaggtttttggagggaaaagagggtatgaaataggaatgctaggggagtgagagagtgaaatgacgagggcagtattctcaaagtatggttcaaactagcaacatcatttagaaatgcagatttctagggcctttcccagacctcctgaataagaacctctggaggtgaagctcagcatttgatgtttttgtatttaattttttatttgtataaaattgtggagtacaatccttacatggatatattgcatagtagtgaagtctaggctttcagtgtttccatcacctgaataatgtacattgtccccattaagtaatttcttatcatccacccctctcccatttctctacctttctgagtctccagtgactgtcattccatgctctatgtccatatatacacattatttagctcccacttacaagtgagaacatgcagtatttgttgttctgtttctgcattgtttcacttaagataatggcctccagttccatccatgttgctgcaaaaaatgtgattttcttctttttttggctgaaaagtattccatgatgttcatgtaccacattgtccggttacctgttgatggacactttggttgataccatatctttgctattgtgaatagtgctgtggtaaacatacaagcgctttttttttcttttttttttttggatagaatggtttcttttctttcgggtagatacccagtaatggaattgctggattgaatagtagttctgtttttagttctttgtgaagtatccatactgttttccacagaggttgtactgatttacattcccaccaacagtaatcccttttctccacatcctcaccaacatgtgtcattttttgtctttttaataaaaaagacattatagttttaattttcatttctcggatgatgagtgatgttgagcagtttttcatacacatgttggccatttgcatatcttcttttgaaaaatatttatgttctttgcccacttttttttttttttttttggagacagagtcttgctctgtctcccgggctggagtgcagtggcgcaatcttggctcactgtaagctccacctcacgggttcatgccattctcctgtctcagactcccgagtagctgggactacaggcacctgccaccatgcccagctaattttttgtactttaaatacagatggggtttcactgtgttagccaggatggtctcaatcttctgacctcatgatctgcctgcctcggcctcccaaagtgctgggattacaggcgtgagccactgcacccagccctttgcccactttttaatggagttgagttttttgttgttgctgtttgagtttcttgtaaactctggatattagtcccctgtatgattgatggatagtttgcagatattttctcccattctacagtttgatattttaataatctctccaggtgattctaatgaatactaaagtttgagaaccactcagatagactagggttcaataaggttctcatactttgagaacattgccttttttttttttttttggaaagggacatgtagtaagttaaatattttacattttgcaggccatatacagttcctgacacattcctctttgtttcttttaaacaactctaaaagtgtatgaatcatctttggctcactggctatacaaaaataggctgtagcatggatttggatgattcctggactgaaggactgttgtgtaattgctcagcagcattaaggatgcacttgagatttatgacactaaagtgagacccagcagtatgtttttacccccggccgtgttcagctccttaggggcactgtggagttaagttggttactccacactgacgaagtgagaagttaaggagtctatgcaaaggaatgattaaaataactgatggtggaacttcagtaaggtggggatggactgaggatgtgaagcagaggtgaagggcagagaaaggttggaggatcagtgaattgtaggtccagggtagcttctgtcaccagccactaaatttatttatttcttctgcttttttttttcaatgtaagaagaaatacagaagaaagaacaagatctttaagcatttatttatattcaaatgaacatattcttgaatgtttaatgtttaagaaattaaatgttagtccatatcaatgattaaaataaaaggaatatatcatctttatatacagattagcttataatttaatgatggatctttgtctagattctgctattactggtcttcctctgaattgttcttattctttttggcaccaaacacaaagagttgagaggaatttatcttagattatgggttcagccaagcaggtaatccagagcaaactttcactcttcatctctctccttttaccaattaaaaggaagaacacagatggatctagagaaattgatcagaaattcagaaattataattatataatggaaaccagtgttaatcctcttagcatttctaatgttcattcattctgtaaaactgtgtacttgtattaaaactatttttttgattttttttttcttaaaatgtttctgcttttaagtatcatattggtattttgagggggagttcaatttgcctttattgtatttatggaagacagtgaattttaagtaggaaaaagataaagaatcttctccacacatggttcatctgactgaaccatggcagtgtgaacatctgggaactgtagaaggggtataaaataaatggaaatcagtgttttcaacttcatcactttattgccttgagactttggaaatataactcagttttttttccatttttattatttttcagtatttcgtcccatatctgctaatgccaaacttgtgatgaatcgccgatctgattttgacttttctgcccccaaaataaacttggaaattgagttacataacatagcaattgaatttaataaaccacaggtgattttctttaatataattttcaattgtgaattattgtttgataaaagcaaaactaagattttaaatgtttcactaaaattcatgatgttatatggtagcatttccctaaaaagtcagtaatgtaacttttatcttcagcaattgaacaaaaaaatgtgatacatttaagagctttaattttccattctttagtatttcagtattatggagcttcttgaatcagttgatatgatggcacaaaatctgccatataggaagttcaaacctgatgtgcctcttcaccaccatgccagagaatggtaaatgccttgatttttttttttttttagattttaaaaatacaacataaaaataaatttctcgacttcaagaataatctttaagatataccatttttaaggtctgatacaaaccataattgatttatagctagaaatatatgtagctgctttagcttattgagttaatgaaactgatttaagggattcttgctaacacagtttacaactcgagatgctcgaataccatagttttcatttactatggacgggtcagtatatttagaattattacaaaaacaaatcctggtttgttttcttgcattgtctctccccaacccccacctcagcttccctatcagatacactgaaccaatattattaaacctgtattttaaaagctaaaaatgttacggagtctatgcaggataatcccattttaaaactcaaaagtcttgttattccagtttttaagctattccctagtttctagaagttacaattactctttcagttgactatttcagttattattcagatgactaaatgttatttgccaattaatgccttaacagttcttgtgtagaactatatttaacaaaatggagtgattttgcttattttcacttaagaaagaggaaagattaatattgaatggattattaatgcaaatggagttgggtaaaaaggaagtactcagataatatatcattttcctaatctttgtattatagttatgtatgttgttagagtagaagcaatgtcagtaatgtttcatactgttgatttgagggtgttaaatgtttttctttttttaactaggtgggcttatgctatacatggcgttcttgaagtaaatgtttgccccaggttatggatgtggtcatggaagcatattagaaaacataggcaaaaagtgaagcaatataaagaactgtataaaaaaaagttaacaagtaagaagccacctggtgaacttctcgtgtctttggaggttagcatttaaaatgaaattgttgagtgttttatactacatagctccttattggtcttcagtgactgatactccctacctttcattccaatttttattgaccttttcatctcttttacttagacttttttgtgcttctgttcttaacttcagctgaataatacaagatttgttgaaattctccagtgagcttttgaaattcgagattattctcaatcggaaggaatttgggttcatgcaaatagtatgattatgtcatttttaacctcaaaagtctaaatagtgtttgctacattgattccaacttctctgtgttggtttcaaagccttttatgtgtcaccactacattttccctatgttacaatctgaccatgcactaatttaatgtttcctgtactctgtatatttaatgctcattcttttagccacgcctatgctcataaatgctacctgcctttatctctctacctactcaattctactcatccctgaagttctacttaagtcttagtgcttgcatgaatgtctctgaattttctgcttatacagagccctttttctcttaatttttgtggtatctctagtctctaccagtagttttacatttaattatctatcttgagatattatttttgtattaatcttgtcttttagcattatgacatatttcaagagggactcttttacaaattgatgaactatagcttagagagattaaggggagttagtctcttgaagttaatgtaaacattctgaatccagaatgaatttctaatttatagattagattgacttttacttttattttcaatgtgggagactttctgaagacctagggctgttaggaatgcctgggcttagagtctttgggggatgggttcaggttgtcttagtcttgaatcataacctgagtcctccaagtctggataggagaaccctgaataagttattctgaaataataatgggttgtagttacttctcttgggggaaacatagtttgatcatgaaattctcaaaagtaattatgggtatgtcaagatagctgtgatgaaagatttagctaatctcagcttatttcaatagctatgacaactatgaaaagtgttaagtattaaaaacaagttttaagtgtatctgggtctacttgaaatacaggcatacttcactttattgtgctttgcagacattgtgttttttacaaattgaaggtttgtggcaacactgtgtctagcaaatctgtcggcaccatttttccaatagcatttattcctgtctatgtgtcacattttggtaattcccacaatatttgaaactgtttcattattattatatctgttatgatgatctatgatcagtgatctttgctgttactgttgtaactgttttggggtgccacaaactgcatccatataagacagctgttaaattaagtttagactaaagctgcctccttacatattttaagtttggccaaaaggtttctttgtacgccataaactatagcttaaatggaagtataaacagactctagtctactcttgtgccaatcaccaagttttggccaatcacatgtggccagttgttcaaaccgtgttcaaataaggtgaacactaagctataaccaaaccagctgtttctgtacctcacttccattttctctatgtcagtttcctttttctgtccataaatcttccaccgtgtggctacaccagagtctctgagcctcttctggctctggaggctgcccaatttgcaaattgttcattgcttaattaaatcttttaaatgtacttcggctgaagtttttattctaacacagcaaacttaataaatgttgtgcgtgttctgactgttctgctgactggctgttttcctgactccctctgcttgggcctccttattccatgagataaaatattgaaattaggccgattaatagccctacaaaggcctctaagtgttcaaatataaggaagaatcatacgtctctcactttaaattgaaagttggaaataattaagcttagtgagaaaggcatgttgaaagcagagataggccaaaagctaggctgcttgtgcccaatggttagctgagtcctgaaggaaattgaaagtgctattccagggaacacatgaatgataagaaagtaaaacagcctgattactgatgtggagagtgttctagtggtctagatagatgaaatcagctacagcattcctctaagccttatccagtgcaaggccctaaacatattctcttcaatactataaagactgagagaggtgaggaagctgcagaagaaaagtttgaagatagcagagattggttcttgaagtttaagggaagaagctgtctctataacaaaagtataaggcaaagaagaaagtgctgatggagaagctgcagcaagtgatcctgaagatctagctaagatcattgatgaaggtggctatactaaacagattttcagtgtagatgtaacagccttttactgagagaggatgccatctgaactctcctagctagagtgaaaaagttaatatctggcctcaaagcttcaaaggacaggctgactctcttgctagatgctgacgtagctagtgatttcaggttgaagccagtgattctttgccattctgaaactcttagggcccttaagaatatgctaactctactctggctatgctctatacacggaacagcaaagcctggatgacaacatatctgtttacaacattttaaacccaagctcagacctactgctcagtaaaaaaagatttttttcaaaatattattgctaatagacaatgcacctagtcaccaaaagctctgatagagatatacaaagagatgaatgttgttttcatgcctgctaacaccacatctgttctgccacccatggattgaagagtaattttaactttcaagtcttattatttaagaagtacattttgtaagatgatagctgccttatgaagtaggcagctatcattcctctgatggatctgggcaaagtaaattgaaaaccctctggaaaggatttgccattctatatgccattaagaatatttgtgaatcatgggtggaggtcaaaatatgaacattgacaggtgtttggaagttgattccaaccctcatggaagaccttgagaggttcaagatttcagtggagaaagtcactgcagatgtggtggaaatacgaagagaactagaagtggagcctgaacatgtgactaaattgctacaatctcatgataaaactttaaccaatgaggagctgcttcttatagaagagcaaagaaagtggtttcttgagatgaaatatactcctggtgaagatgagaacattgttgaaatgacaattagaaatttacataaaattagttgataaagcagcactgctgtttgagaggattgacttcaattttgaaggaaattctgtaagtaaaatgctatcaaacagcgttgtacgctacagataaatcagttgtgaaaagaagagtcaattgatgtggcaaacttcagttaagagattgcaatagccaccccaaccttcagcaatcaccaccctgatgagtcagcagctatcaacatcgaggcaagatcctccatcagcaaaatattacaactcgttgatggctcagatgattgttagcattttttagcaatgaagtattttaaaattaaggtatttatgttgttttcttaagacaatgccattgcacccttaatagactataatgtagtaggaacataacttttatatgcactggaaaaccaaaacatttgtctgacacttgccatactgtggtgatctggaactgaatctgcagtatctctgaggtatgcctgtatcttaatgataacatacaggctgtacacataatatgaaggatttacgattatatatctttgtatagattttttttgagacagagtcttgctttgtcactcaggttggagtgcagtggcaccatgacccctcagacttaagctgtcctctcatctcagcctcttaagtagctcggactacaggcatgtgccaccatgcctagctaatttgtatatgttttgtagaggttttgcagtgttgcccaggctggtctggaactcctgagttcaagtgattcgcctgcctcagcctcccagagtgttggggttacaggcatgagccactgtgcttggccttgtaattatatttttagttgaaaatgtaactaatatgtttacccttatctgtagtttaaacccaaataaaatcattttaaacaatgcatgtacatattttaatatgtgtttataacttgaagagtttggaactctttatgcagaatatgtattatttcatttttcaaaaaattactctctaatttactaatttccatgctgatatatgttcaagcattgcttcccagaatttaacatatgtattatattgatgaatgttctgttgtttgcttcctattatatcttttctttagtgcagccatttgatagattatgtgcttaagttaattatgtaaagttatttttgtaaagttaacacatttttgtttatatttttcaggagttggaaaaaaccttggatgtctttaatataactatagctagacagacggcagaagttgaggtaattcttggcttttcaattagtaaaaataattctgaattccatatagatatgacagatgtgatattattaatcttatactgtaacatattgtttccaaaaagtggttcaatttgctttttagtattataagaaaattatttaatattttttggcacatccatttaaatcagacagatttctatgggaaaaaatctttctaaatatttgggcttttcaaatattcagttatgaaggtaaaagccaatttattttttttcaatcatcatttcttataagatggtggaaaaactatgtggtactcctaaattcttatgttcgactaatgttgcagtttctgtgttctgttattaatgtgtatattgtttacattcattttgctcaagaggataagttctcagaatgtcttgcttatatttgtttcagttgctaaataaaggataatgtgtcatttatttgaaaatttattcattttaggtaaagaaagctggatacaaaatttacaaagaaggagtaaaagatccagaggataataaagggtggtttagctggctatggtcttggtcagaacaaaatactaatgaacagcaaccagatgttcaacctgaaagtatgtccatttcattttacagcatagttaatcactgggtgtcaaaataaagttttgccattttttgcctaattaaagtaaatagacattgaaatatatttatttaattatatataaagttattacaaataaaactattaaaacattgaaaatgtgtattagtttaaaaataaaaaataatttaaaaatcatgctagtgcttacaaaaagagctttatgcccagagatttagtgaatgcatatagcacagtaataaataaataaaaattccaaagtgttctccattgtaaatttttattgaagttgtttcttggaaagatttttgatttttaactaacagcttaagagtatagctttggaggtttagagacttaggtatatgttttagatctatcacttattagcagtgtgtctctggcaagttatttaagtgcactaaacttcagttttatcatctataacatgggaggaaattacaatgttaatactacctactttttatactaaatgtgttgattagcacagtgctattgtctaatatagttagccgtttttgagctcttgcttaatacaaatattataaattaatgttgctaaacttacatatttagcaatttatattttggataattacttgtaaaattgccagccccattcaaacattcagtgtttataatttcttaagagcgttcaagaaagtaaatttcacattctgtttattaaaggcagatacattgtgttaattttattgtttttatttaagaacataaagcacttctttctgatttgtagctcttgaagaaatgttgacacctgaagaaaaagctttactctatgaagcaattggctatagtgaaacagcagttgatccaactttactaaaaacagtaagatgttttcttgccttataccttagaatatatttatttatttatttgtttagagacagggtctcactctgttgcccaggctggactgcagtggtgtgatctctgctgccagccttaacctggcctcaagcaatcctcccacctcagcctctcgaatagctggagccacaggcatgcaccctcatgctagctaatttttgtggttttttttttgttttttttttttgatagagatggggtttcgccatgttgctcaggctggttttgaacttctgagctcaagcaatccgcctgcctcgacttcccaaagtgctgggattataggcatgaaccactgctcctgaccttatgctttggaatttaatgttacatatgtccatttttaatcctttcaaaaatatatgttactgacttgttctgtgatcttttttctgggtctgtaattgcatttattttaatttctaaggtagggataaatattgtctctttttttggggtcaatgtgatgattcttgaagaaataaaatgtccttaaaatatttggtggtttttgaaatgaatgtactataagaatatttgttatgcttatatatatatatatgttttcattttattcttctgaatataccttagtttgaagccttgaagttttttgtccacttgaaaagtatgtctattgttctaagagaaaatcatcaaaaacctgagctggtagatattgtaatagaagaatttagcaccttaattgtgcaaagaccaggagcacaagcaataaagtaagtattaatttatctttttttatcatatatgaaaaaacttcactgtgttcttagacattaggtcacaatcttagtcttttgtaaagagcactatagtttcatatatccttttgtggtttcaggaaaaaggttttttttttaattgttaagataatacatgttcaatagaaaaccacattccagtgaaacatagggcattaaagaataatacaaaaatgatcagcaactacactacacaaaaagaaacagcattaacaatgtggtttttatctgagagtttttagttttattttttttaaagtagctttgagatgtaattcacataccctacaattcatttaaagtgtgtggttcattgatttttcacaactatattatatagtaatttcacattggtatatttacgaagctgtacaaccaccagcactgtattagtccattttcatgctgttaatgaagacttacccaagactgggaagaaaaagaggtttaattggaccaacagctccacatggctggggaggcctcagaattgtcaggggaggcgaaaggcacctcttccctggtggcagcaagagaaaatgaggaagatacaaaagcggaaacccctgctaaaaaccatcagatctcatgagacttattcactaccatgagaacagtatggggaagccacccccatgattcaaattatctcccaccaggtccctcccacaacacgtgggaattatgggagtacaattcaagatgagatttgggtcgggacacagagccaaaccttatcaactactatctaattctagaactttattttattttatttattttttttgagacagggtttcactctgttgcccaggctggagtatggtggtagggtcttggctcactgcagtctctgcttcctgggctcaggctaacctccagcttcagcctcctgagtagccgtgactacaggcgcgagccaccaacaccttgctaatttttagaatttttgtagagatggggtttcaccatgttgcccaggctggtctggagcttgttggctcaaagcagttcgccagcctcagcctcccgaagtgctggaattacaggtgtgagcctggctcattcgagaatatgttaacaactcccaaagaaaccctgtaatcattagcagtcactcccaagtgcccccttacccagcccctggcaacaactaatttactttctatttgaaaggatttgtccattttggacagttcatatgaatgtagtcatacaatatctggtcttttctgtttggcatttttcacttagcatgatgttttcaaggttcatcctgttgtagcatgaattagtacattcctttttattgcctagtaatctctattatggacgcatcacgttttgtttatccatttaactgttgaggatatttaggttgttccttctttttggctcttctgagtattgcagctatgagtattcatgagtaatattttgtttggaggtgggttttaattttcttgggtagacacctggggtggaattgctgtctcatatgctaatactatttaaccttttgaggaactaccagactgtttcccaaagcagcctcaccattttacatttccatgaacagtatatgatgtttccaatttcttcatatcttcatcaacacttgttattatctgttcttttgattacagccattctagtgagtatgaaatggtatctcactgtggttttgatttgcattttcctgatggctaaggattttgagctttttttctttgtgcttattggccatttcacgtgcatatcttctttggagaaatgtctattagattttttttcctattttatgttgggttgtctttttattatcgatttgcaagagttctttatatattcttgatacaaatctcttattagataaacaattttcagttattttctctcactgtgttttctttttatttttcttaatggtgaagtcaaatttatattttttttgctacacatgcttttcattataactcagaaatctttgcctactccagtggtacaaatatatactcctatatattcttataagaattttatgctatttcctcttatatgtagggttagaatccattttgagttaatgttagtgtgtggtgtgaggtgggggattcagcttcattctttttcatgagattattcagttgtcctagcaccatttgttgaaaaaactattttttcccattgaatgatcttggcaggcttgtcaaaatttataagttgatcataaatgtaaggatttctagactcttaattctaatcccattgttctatatgtctagccttatgccagtaccctactgtcttaattatggtggctttatagtagaacttgtaatcaggaagtatgactcttccagttttgtttttttgttttagctgtcctgatttccttaaacttctgtataaattttaagattatgttgtccatttatgcaaaaaaataagctcagatttgataaagattgtgttgaattttgtggatcaattttgggtgtactgaacaaattattcagcacaaattattcagctacttatctaaacaatattaagtcttccaatccatgcacattggatatcttttcatttatttagatttttaaaatttgaacaacgttttacagttttcagatacagtacacctcttaggttaaatttatttgcaagtattttattgtttttgatgatataaatggaattgttttcttaatttcattttggattattatgtgtatagaaatacaattgagttttgtatactgcacttgtaccctgcaaccttgatgaacttgtttcattagttcaatgagtttttttagttgattccttaggattttttatatacatgatcatataatctgcaaatatagttttacttcttccattccgatgtggatgccctttcttttgttttcttgcctaattgccccggctagaacctccagtagtattttaaatagagattatgagagtgggcttctcttcttgtttctgttcttcgaaggaagtgttcatcctttcaccattatgatgttagatgtgagttaggtgtggtctgcatcattttacaatcccaccagcaatgtacgtggattcatattttttccatatcattcccaacacttgttattttgtttttttattttaaattatagccatccttatgggtgtttagtatcatattgtggttttgatttgaattcccttaatgactaatgatgttcagcatcttttcatgtggatattggccctttgtataagttcattgggtcttttttttaattgagttatttttcatttgttgttgaggtgtaagaattcttttgtattctggatactaaactgtcaccggtacatgatttgcaaatatttccttctattctttattttgtgatttcacttcattgatactgtcctttggtgtacggaagtttttaattttgaagctcacttcatccggtcttatattttgttgttcatgcttttgatgtcttatctcagaaggttcacctaagccaaggttgtgaacgtctactccagtattttcttctaagagttttatacttctgtcgcttacatatacgtttatgacctgtattgagttaatttttgtaaatggcataaggaattggtacagctcatttcatttgcatgtggatatcccggtgtcccctcacacttgttgaagacactattctttcctcaatgaacactcctggtaccattgttgaaaatcaattagccatagatgtatgtatggctttatttttggactctcaattctatctcatttttattctagactttcactgtgattatcattataccaatatcgtactgttttgattactgcagatttttagtaagttttgaaattgggaagtgtcttccctattttgttctgctctttcaagaatgttttagctgttcaagggttgcttacaagaccttatgaatttgaggattcacttttccatttctggaaagtgtctctttgaaatttgatagggattgcattcagtatgtagattgcttttggtagtattgccataataacaatattaagtcttctgtgaacatgggatatctttccatttaaataaatgctaaatagatgctttttctgtttttatgaagagtttcagaaggattgttattaatccttctttaaatattttgtagaattcactagtgaagccatttggtccttgtattagtctgttcttatgctcctaataaagagatacctgagactgggtaatttataaaggagagaggtttaattgactcatagttcggtatggctggggtggcctcacaatcatggcagaaagcaaatgaggagcaaagtcatatcttatatggaggcaggcaagagagagcttgtgcaggggagctccctttataaaaccatcagacctcatgagacttattcactatcatgagaacagcactggaaaaacctaccctcttgatccagttacctcccatcaggtctctcccacgacatgggggaattatgggagctacaattcaagatgagatttgggtggggacacagccaaaccatatcagctgaattcttctttgttgagagtttttggttactgatttactccttactagttataggttttactataagtaagtttaaaaggttatagtaagttttactatactaaagtttatagtaaagttttactgatagtttataggtttataagtaggatctgtaggttacagtaaagtttactataggtttttaaggttatagaaaagttttacttcctattagttatctgattttctatttcttctcgaggcagtttttgtaatttatatatttctaggaatttgttcatttatctattttgttggtactgttttttgcagtactcttttgtagtactttttattcctctatggtgtgtcataatgcctccactttgatttctagttatagatatttgcatctttagtgttttttttcttattttaggtaaaggtttgttaaatatgttaaccttttcaaagtggcaactttgattttttttcattctctctggtgtttttgttttctgtatttcatttgtctccactctgacatgtattattttattcatactgtgagctttgggtttaatttgctcttctctttttagttctttaaagtgtaaagtgaggttattgatttgataatctttcttttttaatgtaggcatttgcaaacaaaaatttccctgtgagaactgctttggatacatcctgtatgttttgtaatattgtgtttgattcgcatccatttcaacgtattttctgatttctcttgtggttttttttttaacctgttgcttgtttaagagtgtttaatttccacataattgtgaatttttcagtttttcttctattgagttctaatttgattccattgtggttggagaagatgcttggtgtattattaaacttgttgagatttgctttgtgacctaacatttggtctatcctggagaatgttccatgtgcttgcacttgagaagaatgtattttgctgttgttgggtagagtagtccatatttgtctgttacatgtagttggtttataatgttgtttaggttctctgttactttattgttcctctgcctaaatattcctcatttaatggaagtgggagattgaaatttctaagtgttattgtgagctatttctccctttaattctgtcaaggtgtgattcatatattttgaggactttggtgtataaatgtttataattgttgtatctttgatgaattgagccttttaatcaaactataatgaccttttcttcttgtcacagttttctattgaaagatatttaagttaattaattaattattaatttagatacagggtcttgctttgccacccaggcttgagtgcagtggtgtagttatagcctcactgcagccttgaactcctgggctcaagtgatcttcccaccacagcctcctgagtagctggaattaaaggtgtgagccaccatacctggctaaagattattttatatgttagtataaccacccagctctctcttggttatgagttgcatgcagtatattttttcatcctttcactttcaacccatatgtgtctttggatgtaaaatgagtctcttttaggcagtatgcctatggtccctgacttaggctaagtatattaaatacatttttgacttggaatattttcgatgggtttattgggaaataattagtcataagttgaggagcatctgtattgttgtatcatgtttttttcatccattctgccagtctctatctttcctttgatgagtttaatttcatttacatttaacatgtttactggtaggcaagaagttctgccattttgctatttgtttattgtatgtcttataccttctgtaccctcagttcctcagtactgtcttcttagtgtttgttaattttttgggggatatatttttatttcttcctcatttctttttccaaacatattttagtcattttgttgagggctactatatagggattacaattaacagtccaaatttaagacagtcaaatttgaattgacactaacttaactttaatagtgtataaaaactctactcttatgcagctccattcttcatctttacgttatcattttcacaaattactgctttacatacttgtgttcattagtctaggtttatatttgtttttatgtgtttgtctttaaatcatagaggaattaaaaagaggagttaaaaaccaaaaatgcaatattactggctttcttatttgcttatgtagttacaattacaacagttctttatttatttgtatggctgcaaattactatctaatatcctgtcattgcagtctttaggacttcctttaacctttcttgtagggcaggtctactaatgacagacagactcagtttttgttcatctggaaatgtgttcatttttccttcattttagaaggatagttttgtcatatatagatttcttggttgacattttttttcatttagtgctttaagtacatgatcttgctgccttttggactgcatggtttctgaggagaaattagctgttaatctattacatatcttgttatgtgatgagttgcttctctcttgctgctttcaagattttccttgttttagcttttgacagttggattataatatgttgctgtgtgagtctctgagtttatcctaattggaggtctttgagcttcttggatgtataaatttgtgttctttatcaaatttgagaagtttttggccattatttctcccagtatttttaatgtctttttctttttctcatgtccttcggagagtcccgtagtgcatatgttgttccacttgatggtctcccactttaggcactgttcattgttcttcattattctttatgctccacagactcaataatttcagttgtcctgtattcaagtttgatgattctttctttgggctgcttagatcctctgtgaaacctctctgcagatggttcccaaatcatgattgttcagcttatgatttttttgattttagaatggtgcgaaagtgatccatatttagtagaaatcttactttgagtatccatacaacctttgtttttcacttttcagtacagtactgaataaattacataagctatttaacattttattgtaaaataggccttgtgttagatgatttttcccaacgtagactaatataactattctgagtacatttagggtaggctaggctaggctatgatgcttggtaggctaggtgtgtcaaatgcattttaaacttatgacatattcaacttacaatgattttattgggacataaccccattataagtcaaggaacatctgtagtgaagttttcatattggctgttgtacttttcaccttcaaaatttctgtttggttctttttaataatttctgtcgatttatattctgtgctcaaatgttattttcctggttttctttagtctttgagtgtaagcttatttaacatgatggcttagtgaacataatgctagtcttcccttttctgtgtaagctttgtacatttttgtttaaaacttgatgttttgagtggtataatgtggtaactgtggaaattagatgtcccccctctccatggttagttgttgttgattgttgaaggatgtagttttccatttgtttacctactgtagtgggtagaattgtatcatccaaaacattgtcaatttctaattcccagtacctgcaaatatagccttatttggaaatagcctttgcagatgtaatcaagttaaaatgagttcatgctgtattagtgtttgctctaattgaatgatgtgtgctcttcaaaggaaagagaaatttgaacacagactcagaaaataagacagactagagaagacaatttgcagacagacataaagaggagaatgccatgtgacgatatcttcttagctgcgcccatattaatgtagattttctgtaacgtggtgtggggattagaggtgggaaatgatcatagctcagatgccacaggctctccctgttcttatcaagttttagtagatttttttgtttgttttgagatggaatgccactctgtcgccaggctggagtgcagtggcacaatctcagctcactccacctcctgagttccagagattctcctgcctcaggctcccgagtagctgggattacaggcatgtaccaccacacccagctaatttttgtatttttagtaaagacagagtttcaccatgttggccaggatggtctcgatctcttgacctcgtgatccgcctgcctcagcctcccaaagtgctgggattacaggcgtgagccaccgagcccagcctagatttttttgaataaaagtttttctgtttgctgtatgcccttagattgatttccagagattttataattttcaccagttctttccctgtttggtttgctggggagaagagttgctgagctcctcacatagtcattctcgaagtcctgcctcatccttggtttttaaatgtttattaaattgttttatttttttgagacagagtctcactctgtcacccaagctggagggcagtggcatgatctcggctcactgcaacctccacctccctggttcaagcgattttcctgcctcagcctcccgagtagctgggactacaggctcatgcccccacacctggctaacttttgtatttttagttgagacagggtttcaccacgttggccagtttggtctcgaactcttgacctcaagttatccacctgtcttgacctcccaaaatgctgggattacgggtgtgagccacatgtctggcctttaaatgtttatttttatttttagaagaaaacatgtttatagacttgtgttaaatatgcaaaacttttcagttttacattaagcattgtagatttactgtcattttaattttagcttatcataacttttttacatataagtcaacacaaataggattctttgtgaattaatctatgtcaatttagaggaatcattgtatgtcttctttgatgggaatggactggagtcagaaatgcaaagtgaagttgtcttcattaattttttaaatcattttcaatttttaaaatccttcacaattttactgatcgctgacttttttcttttttttttaatgcagatttgaaactaaaatagattcatttcatattactggcttaccagataattcagaaaaaccccgcctcctgtcttcattggatgatgcaatgtcacttttccaaattacatttgagataaatccattagatgaaactgtttctcagaggtgtatcatagaagctgaacctttagaaatcatatatgatgcagtaagcatttttttaaattactaagttttaatataatttagtttgctttgagtttgtgttaatgatgtttattttaacagaggacagtgaatagtatagtggaattcttcagacctccaaaagaggtacatctagcacagctcactgcagcaactttgacaaaactggaagaatttcgcagtaagacagcaacaggtaaatgccaatattaatgttggtgaattaaatactgtatcctatattaaacttttatttatggtagaatgtttttagtaaagtttattttaaatttattatatttctagactggttttagtttaacagaaactaatttagtacttttatgtttaaaggcagataaaaccataatcattttttacactcagaaagttcatacctagtaaccacatttaagttagttgcaaaattttgcttaggatacttggacctctatttatgacaaaaactggcctctcgttttcctttcttagaatgcgttccagattttgatatatcagcctcagggaaaaaagttctatccttttttattctctaggagagtttgaataaggtcgggtacgatttcttccttaaatatttggcagagcttaatggtaaaaccacttggttttggagatttctttgtgggaaagtttaagattacagattgaactttttaattaaatagttgaccatagagattatctgtatgattttaatgctttgtaattggttgggacttgttttctagctcaatgtatgatattaaaaaaaatgttcctcatatgctgaaaaggctgtcttttcatatctatacctattcattaggtatggattgttaatcctttacttcaaattttttgtatccttactggattttttttttccccttttgtcaccttgttctaacagttattaagagaaatacatgaaaaatgcctcattatcaatgtagatttttctatttctaatagatctgtcagtttgtttaaaaaaataaatttggctgggcgcggtggctcacacctttgatcccagcactttgggaagccgaggcgggtggatcacctgaggtcagagtttgagaccagcctggccaacatggcaaaatcataatagagacggggttttaatagagaccaggtttcaccagcctggcgacagagcaacaccctgccacacacaccaaaagtaataataataaaaattaaaaaaaaaataaattttaagactgtcattaagtacatgcaggagtaaattatttttcctcctataaaccacatctttaatgctttaatttttttccctttgtacttttttattttattttatttttgatctgatgtcagtatgaagtacaaagtttcttttcgttagaatttacctggtatatattttttcttatatttttactttttccctgtgttttcagatgtgtcatgtcaacaacatgtaataggattttttccaatctagatttatggtccttattttttatttatatctactttttgcatttaattaatttatttaggcttatgtctaacatcctattttgtgcttttgaatttggttttccttgttttatttttcttgccttcctttggataaattctaggatacctttcttcccccttccctacaatctactattgggaagttaaatattctctatctctttttattttataaattacagtatacatttttgtaaaaatataaatttaatgaaaaattttatattctcctagtcattatatggactttagtactcttgaactttatataccatccccatatactattttttttacttaaaaatactttattgtactgtatgtatatagttcatggtagtttacaattacttgtgcatttactaccttctttgctcttcatttctcttatagcttacactttttatttgattttattttctttctgttggaagttcattttttttttttttcaacctctgcctcctgggttcaagcgattctcctgcctcagcctcccgagtagctgggattacaggcacccaccacaacgcctggctaatttttaaaaaaatttttaatagagatggggtttcactgtgttggccaggctggtctcaaactcctgacctcagatgatctatcctcctcgacctcccaaagtgctgggattacaggtgtgagccatcggacctggcctggaagttcatttgtaaacttcccttgtaaatattttctcttgtaagaatctgctggtggcaaatctgtggtttgtttttgttatgtttttgttttttttttttttttttgacagtgtcttgttctgtcagccaggctgggggtgcggtggcataatctcggctcgctgcaacctctgcctcccaggttcaagcaatttttttgcctcagccttctgagtagcttggattacaggggtatgccaccacacccagctaatttttgtatttttactagagatggggtttcaccatgttggccaggctggtctcgaacttctgtcctcaggtgatccatctcagcctcccaaagtgctgggattacaggcatgagccaccatgcccgttgcatattagcttgacatgatactactgtatgtagaattaaaggttgatgttcattttctccttaacacattgaagagggcattctgtctttaggttttcattactgatgttgagaattcaggtgtcagtgtgtctgctgtttttttttgtacattatctacccttttcttttacatataagaactttttatcttttgtattctgttgtcgcaatttggtgtatccagctatagatttgctttatatatcctttttgggattcactggatttcatgaatctgagtactgggatttttaatgagttctagaaaatctatctggaaaattcttagccactaactctttacatatattctcttctggaattctggctaaatgaattttagcctttcttactccatcttccattctccttaacttctgtatcctgctttctttccatctgtttcttctctgtgttacatgctgggtaatttcttctaatttatcttctcatttactgagtccttctgtagccatgcccaatgtggtatcaaatctcttcattaagtttaatttcagtgattatatttttccctttaggaattctgttttgttaaatttaaaatctgtgttgtcattcttttttggttttgtatttcccacggatatctttacacttgtcttttttttttttttcagagatcataagtacagtattttatattctgtctcaccagttaattctctctcttcagatagtccgttatatgaagacttttgtggttctgtttttcctatcttctgtcttttgtttttgttggtacttacttatggtaacgtgtgtctttttatgcttggtaatttttaattgtaatctgctcattttccttagaatattatttgggagaattctctgaagcctgagataagtgggccttcatttcgggaagatttatatttcttctgccaggtaccttgggtatgttggtggcatagctaaattaattgcttaagatgttctggactgccaaagaattcttgggctacatacctccttgaggaatatatcatacttatcattcacagaggtattacctttttctcctaatttttctcacagcctttgtttgcatccccctgtgagagtgttttagggagaggaaggttttacttcacaattattctttctttgagtgagtgtcctttaagatttcagatttgtgaggagaactcttgcaagactctccatctttgtcttctgtttcctgtgttctgagaggctgaaattatctttggagtaagatccaatttcattgtcaaagttttaaaattctggttttgttaagcctgggagtacacttctaattgaactcagaatttgtcccattttggtggctataaaacctggcatgaaattatgatttttctcttgccatttttattatattcactttatccttattggtagatatgagatatactatctgtcattttcctttgttctctttcctaagataaaataatttagatgagtcaagaaatcacattttgataagaccttcaggaaatgtctaactagttgtcttttgttaggcaatattataataggcatcttgattcattattaatttttcttttttcacagaaaagtgtgtgttatattcttcaaaatatatgtgtcttctctggcttttgctcatttttctctactatttttatatctgaatagttttaaattagattgtacatgaataccttacctctagaaactgtagggtttgcatttattcctgtattctttgttaaaatctgggaattccattcctagtttacattctgtatattggtatattatatactgagtagaaaccaaagcataagatcaggctacttctagtcagtttttcttgattgatagaaactcatagttaaatacaaattaatcatattggaaatccactatagacattcagattttgagattttttatctctaagatttatttacctcaacttttattacttaaaaaaattaccaaacagtaaatatccacaatataaagttcacatgttacagaaatatgttttagaaagtggaagtcttcagtattttaccttctgtacataataacctttaaaatttgaagtctgttcttccaactttgttttcttttctataccaatagtataaaaatgctaattctatgaaaaaaaatggaaagcttctatgataggtttttgcacttaatttttaaaatttaatatattttggattttttctagaaagttaaaatttacctatttgtgaagagactcatatatattataatgattctggttacttaggttctttccttccctcatattcctcctttcttccttttattttgttacattctcctctattaacatcctggtttctttcttgtattataggttgagtatcccttagcagaaatgtttgggatcagaaatgtttcagatttcagatttcttcggatattggaatatttgcattttacttacttgttgaacatccttaattgggaaataggaaattcagagtattctaagcagcattttctgtgaatatgatctttgaggatcatgttattgtggtgctgaaaaagttttagatcctggagcgttttgattttggattttcagattagggatgctcagcttgttattttccccttcctttctaagaactcaaggtctttcaggtctttttgttgtcaactatggcatgagcttacagagcctgctcaactagttatcctttgtctctggcaggaaaacagatgtggtcgtttgctaaaactcttctttcagagtacaaggttctctgataggatcatagtgaatcattttctttcagttatttcatttatttactcatttaaatatatatcaagagcctaatctatatgtcagacactatgctaggttttagggaacatagcaatgatcagaatggatgtagttcttgcctattgatagatgttatactcttatggataggacaaatataaaactaagagcaatatactggaaatttttgattaatgctgtatgggtccaatcaggaaagaaaaaccacacagtaattttgataggtatgtttaatgtaatgaattattaactgtaatgagggactgttttgttactccaaagagtaactttaaagaatgtaacaagaggccaagcgccatggctcatagttgtaatcccagaggttttggtggccgagcggggaggaacacttgaggtcaggagttggagaccagcctggacaacatagtgagaccttgtctctacaaaaaattacaaaattagtcaggtttggtgacgtgtacctatcgtcccagctacttggcaggctgagactggaggattgcttgagcccgggaggtcagggctgcagtgagctatgatagcaactcctacattccagcctaagtgacagagtgagatgctgtctccaaaaatacatatatttaagaagagtagttatgaggaatatagaactgagacagcgttccctaggaagaggtctctctcttccctgagaattgaaatccacactttgttgggagaaggaacctctgtgagtcattgaatggtagaaaagccattcttgtgtctttctggtaatctgctctctaaaactttctggaaatccatcctctgaggtaaaaaggaaaaatattcatggggcaatgtctcactgccctcgttctgctgtgaaaccacctgaggagggttctaggggcagaatactggcttttgagtgctgttatgtgcacattatgcattgtgttggagaaaggcacagtgttacaggatattgctaaatgagtgtactggaaccaggaagccagctcttttctcctgcagtgtctctcctgtgttctttatctatttcagtgctagttggcaaaggaaaatcatttaagcaactcagatctactttcacagagcagacaagtgggtgaatttggagctgagtgaggaaacaattctataatcagcccaaatgctgtgaaagaaatgagaatggatagatgccccaatttagtcttggtggtagtgtcagagaagatctctgaaaattcaacattaagatcagatatatatgtaggatccacactgctaaagggtataagaaagagccttcaaggtgatggtccactgtgaagagcttaacttagcaaacaattgggtgaatttggaagttgtagaaagctgaattggttctaatgtaatgagtgaggggagagtggagggatgttaaagatgcatactcttgattatgcaaatatgaaagtcatattaagcagttaggattttgttgtaagtgcaatggaaaataggggagagacccaatcaacctaaggtcaaaataaaatactccccactcccttccattaaaaacaacttagagaaatcattgtgtcctggtatcaagaaaggctttgttgaaactaaggcttgtggtaggacttccagggagtaccagaacttagatttgtagaagccagaatacttgaggaatccttagactagagatggaaatgaagatagagaaatgcttaacagatagtctctggagaatcttgaatgtcagattgacccttctggatgcttcttgttactttagtaaaatcatgccatctgtgtttgaatccaaatcatttggggaaaaagaatgaataactgtttgagtcaattctgctcttaagtttcaggctaattggatggtcttcagaatttttgatgatctgtcagtctgttttcaaacctctatctcacctcaccttccatcctcattttaagagatttcacttgaatttgcttcttacaggctatgggaaatgccagggttttttcttcctctctctactagagtcttgcttgggctacctgtgcaaggccgttggaatcccttaaagatgacacagttttgataacagtttctcatatttcaaggaagagctgtcccagatgtaatttattagtgttatttttataaagactactggaggcagcgtaatttgtgaagaaaagaggtttatttgtttcatggttctacaggctgtacaagaagcatgactccagcatctgcttttggtgagggtttcagaatgcttccactcatggcagaaagagttggggagcccacatgtgcagagattacatggcaagagaaaggaaggaggtgccaggctcttttaaacaacaagctctaactaaaagagcgagaactcactcattaccatgaggacaacatcaagccatttgtgaggactctgcccccatgacccagacaggtcttattagggtcccacctccagcattaaaaatcaggtgtcagcatgagttttggagggctaaaatcccaaactgtagcacaggcttaggttatttattttctattttaatttaaatagatatttaaaacagaaggtattttaattacttttaatttattcattttctttctgttggcttgtatatcaagctgattatgtgttggcacttgacacttgctcaatgtctgcttttaagctttataattgtatatgtattttatttgtaattttaagtacattaaaattgttgacatattctttaatttgaacatgtattctttaataataaattcttaactttaaaggttatattcaaatatactgacctgcctacattttgtgtgtgtgtgtgtgtgtgaaaaaatgtgcctttttgtttgagtgtcagatctttttaaactttttaagtcaaatatctttcatttactctaactgatttgatggctgctcatataattttttctttaagaaagggttcacatctcatagaaaataatttgtttagatttaaaagctgatgctgatactggacttagggacataaaatagatgaatttggtatactaatcacatgcaagtgaatgaattaaatttattagactaaaaaactccaagtgaatgaaggacctagggaatggaaaactctggtttgttgccttttctggtttgcatatgattttattgaagatgatttgataatccaggattttttatattctcagaataatattaagatcaagtgttattgttcagtatggtaaatgtagcttatgaagtttatgaattgagaagtatctatgtagattctaagagttgttgtgagtaaatattttatgccactgaaactttttttttggtctgtatcttcccaattttacccaaattgagtttataggttaaaaattttttttggaagaatcactccaattttgtactcagctatatttaaataggagtacatgcattggcaggtattttaaattttatattggaagtattttgctgaggtcattttaaaattaatactaattttacattaagattgttttatcagttcatatatttagtgattctgtatttctcgagtaatttgtgaaaagtattcatagaaaagatttacatttttccaggtctactgtatattattgaaacacagaaagttcttgatctcaaaattaatttgaaggcttcatatattattgtcccacaagatggaatttttagtcctacatcaaatctgcttcttttggaccttggtcatctaaaggtatatactaataatatttgatttatgatacagcatttggggtgtttctttgttttaaatgtattttgttttttaaacagtttgatttattgctttttttcctagatttgtggtagataagtaagatttgagaaatctccctttctgttaaataaagtgaagtctcaattaggtagttttcctacacttatgaaagcaaaatgaccaattaaactctgcagggcaggtttgaatctaagcttgattgactgattgattgattgattgattgactgattgatttgagacagagtctcactctgtcgcccaggctggaatacagtactgcgaccttggctcactgcaacctctgcctcctaggttcaagtgattctcaggcctcagcctcctgagtatctgggattacatgtgcccgccaccacgcccacctaatttttgtatttttagtagagacggaatttcactatgttgcagactggtctcgaatgcctgtactgaagtgatccacttgcattggcttccctaagtgctgggattactggcgtgagccaccgcgcctggcccgaatctaagatttatatttgtagtatttgagagttgtgcttgagaagcttatttctttctcaatttagacctattacttgattacttaaagtatatagaatgatagagaattgtggaaacaatcaaatacgtcttcatctttctgaaattttttgtgcataaaactatatatatattgacattttaatatttgtatttaataattctaaattgagaaatggccttcttctgtttacctaagtcatttccctttttttctttcttttttttttttgagacagagtctggctctgtggcccaggctggagtgcagtggcacgatctcggctcactgcaagctccgcctcctgggttcatgccattctcctgccccagcctcccgagtagctgggactccaggcccccgccaccacgcccggctaattttttttgtgatttttagtagagactgggtttcaccatgttagccaggatggtctcgatctcctgacctagtgatctgcccacctcggcctcccaaagtgctgggattacaggcgtgagccaccatgcctgaccctttttttctaattatatacttttttctttccaaattttcagtagagaatacatttttttggcggtattctagatctgtgctcttcactatagtacccacttcccagccacatggggttatttaaattaattagaattaaaattaattcagtttcttagtcatattagccacatttaagagtttaatagtcagaagtggctagtggctactgtattttttgtttttgtttttgagacatagtctcactctattgtccaggctggagtgcggtggcgtgatttcagctcactgcaacctctgcctcccgagttcaagtgattcttctgcctcagcctcccaagtagctgggatttcaggcgtgtgccatcaagcccagacagtttttgtatttttagtagagatggggtttcaccatgctggtcaggctggtcttgagcccctgacctcaagttatctgctggcattgacctcccaaagtgttgggattacaggtgtgagccaccgcgcctggcctgtatttgacagcattgatatagaacatttccattattgtagaagttctactggacagcgttgctgtaaatcattaaatgtagaggaatatctatcacaatttaaagaaccaagagaggtggataatattagaatgctttttctggccacttaacaaaaatacgtgcctgtccttgatactgacatcttcccttatcctatttttaaaaattctgcatttgttaattgtgtaaacgcccactgggtatatatttataataaaatttatacagcttattattcatatttgaattttattcagttgtttcaagggcagtgtggtataatagagcataaggttaggagtaaggatatctaattttgtgactttaggcaatttgcttaacctgttacctaaaatttattacttttcaaacagagataatctttttttgagtgtttacttcacatgagctatatagagggaaaaaaagttaaaaaatgtatgtgtacacacatgtatttttatgagtaagatctttatgtactattgtggagtcatctccaggatgtttaagtgaaaaaagtaatgcgcacagtatgccaataaaggagagatacaaatataacttgcctggagttgcataaatggcagagttggaactaaaattcagctatcctatttaattctggactcttttacttcttattgtacagccatgtcagtatttgtcatcatgccatagaaacattttataagctaaatttgtctcttgatcttgctcttaatcagaaggcctcttatcacatttaaaaaatttgtagacatattattcttcaggaccatcttggtttcttttaatgcaagtaaatgggaaatatatcctaatatgtaaaaatttactttatcgctctccttattattatatatctcatcgatgaggacctttctaatagccttattatgtatgcttacttgtgaatttatcctctcctattaacattttataagtctaaaaattaaacactttatacttacattttgaagtattttgcatagtctaaactattaaaattaacttgaaggtgacgagtaaaagtcgttctgaattaccagatgtgaaacaaggtgaggccaatcttaaagagataatggatagagcttatgattcatttgatattcaacttacaagtgtacagctgctttacagtagagttggtgagtataaaatgcattatttgttgattgattttgttgaagtgattaattaggtttttagacactttgaagaccttcctcttaaatgtgttagaacgtctatatttttgaattagaaatgatagtaaatattgtctagctgttcttaccaggagcagtcttgcccccccaagagacatttgtcaatatctggagacatctttggttgtcacaggtagagcatgagtggcactcctagcatctagtgggtaaaggtgagggatactactaagcatcctacgatgttcaggccagtccctcataataaatatcagtagtgctgaggtcgagaaatcctgatctgtaccaatgttttccagcctttgaccaaagttggcccatattgaaaatgatattggtattactacacagttggataaccagaagacattgctcagggccagaagtaagcagcctaggggctctgacagtcatggacagccatacaaagacgagggtcactctcctagacatacttgtatctcattcactgtggtataccagtcaggagtctgatttagagctagttttgaagatgaagtcaaagccagaaattcacttgccaagagccatttaagtagttagggagagaccccagactcgttcagctttcttttcgttctgtcatactgcttttgaatccctagagtgttagtgaacatgcagataattcagtaaaatttgatctgttgaagagatccatatgtagagatctaagtgtttgtatgcagtcagattttaattacctgagctaaccaataaaaggagaaacaatgagaatccaaagtagttgttatcaaaattgttaatttgtataggactgaaacattttatttcttcaattatatttgcttcaggatagtgaatgtagtttgtatttttatcatattctaattgtggtggaggaaacccaaaggtatagtgggtggcagaagtacgttattttcagaattccacaaattctttttcagggaataaattactgggtttggttttccttgactgggattttatctgactcatagaattattatgttcaaatgagatagtatatatgaaaatgcattatatgactgagatcccattaatcttgttatgaatttttaaagttatttctttctgattatacctatttcagaaaatctgaacaactgagaaaccaaaaagataaacctttatgttactgcttaggcaggaacactattgatattttgttgcacatccttttagtatgtttttcagtgtgtgtacctgtgaatatatgggatgtgcttgtttggtgtttatattggaggtatttgtgaatgtattttttttacatgatttatatagttttatatccaggtattttttcttttaccagtaatattttggtcacttgaactcatggtttttattgtctatattatgctatatggctatggtctcagttatttaaccattcccttatggaacatttaggctcgtaactctgcagtgattgttgccaatcaacaacatccaagtagacttggatgtgaatttcagttttatcactagcagattgatcataggcaaattataaattcttttgagtctcagttttctaaagtgggattattatacagaattttgagaattaacatttaaacattacctagaagagtagaaattataaatcttgaataaatggtagcttttattagttactgttaaagaacctcactttttactaccttttgcattattgctttactgccatgttacttttttgggtaaggtatgtggttggtgtagtgattgtcagtggatgcgcagtagatttgataacctactgattgtatgtacctgagaatgtgacattaagattacctagatgtggggaaatttcctcatataatggaatgtgtgactatgaagtattaatagttattttaggttttgtgtgttatagttacgttaaatatgaactattttctgtacttaggtgataattggagagaagcacgaaaactcagtgtatctacccagcatattttggtacccatgcacttcaatttggaactgtctaaggccatggttttcatggatgtaaggatgcccaagtatgtactgtttgtttcatgtgaatatggattttctgggtaattctgtagctagggaaataccatacttaactgactcttccttgtgtgtgtggtgaaatgtatataactgactcttccttgtgtgtgtggtaaaatgtatataaaatttaccattttgataatttttaagagtatagttcattgtcattaggttcacgcatgttgttatgcaaccatcaccaccattcatttccagaactgtttctcttccaaactgaaactctgtactcaattaaacaataacaccccatttcaccctgcacccagcccctgacaacaaccattatatcttctgtctttatgaatttgactattttaggtgcctcatataagtggaatcatagaaaatcagattttgtgtgcctgggtttcttcacttagcataatgtcttcaagattcatccatgttggagcatatgtcagaatttcatgtatttttaaggctgattaatattccttatatgttgtatatactatgtttttatttattcatccttcaatgaacatttgtgttgttaatgctgtttggctgttgtaataatgctgctgtgtacaaatatctgcttaagtccctgatttcagtatttttgggtgtatactcagaagtagaattgctggatcatattatagttcagtgtttaagttttagaggagtgctgtgctgttttttatagcagttacaccattttactttcctaccagcacaagagtttcaatttcttcactgcctctacaacacttggtattttctgtttttttattttaatagtcatcctaataggtgtgaagtgatgtcatttttctaatgcttagtgatgttgaacatctgttcttgtgtttgttgaccattcatgtatttatttggagaaatacatattcaagatctttgcccatcttttaatctggttatttatttttttctgtttttcgagatggagtctccctctgtcacccaggctggagtgcagtggcatgatcttggctcactgctacctccacctcctgggttcaagtgattctcctgcctcagcctcctgagtagctgggactacaagcgcatgccaccacgcccagctaattttttgggtttttggtagggatgggatttcaccgtgttagccagggtgggcttgatctcctgaccttgtgatccacccgcctcagcctcccaaagtgctgggattacaggcatgagctgccgcacccggctgagttgtgagagttttaaaatatattttggatattaactctttatcagatatatgatttgcaaatattttttctcactctgtgtttccttatcactctgttgattgtggcctttgatgtctaaaagtttaaaatttttattgtccagtttatcttagttgcctatgcttttggtgtcatatccaagaaattattacaaaatccaatgtcataaagcttttcttctttgtttaccttaaagagttttatagttttagcttcttttatttagatctttgatccattgagttaatttttgtatgtgacatataggataaggaccggcctttattcttttttttttttttttttttttttttgagacagagtctcgctgtcgcccaggctggagtgcagtggcatgatctcggctcactgcaggctccgccccccagggttcacaccattctcctgcctcagcctcccgagtagctgggactacaggcgcccgccaccacgcctggctaattttttgtatttttagtagagatggggtttcaccgtgccagccaggatggtcttgatctcctgacctcgtgatccgcccgcctcggcctcccaaagtgctgggattacaggcgtgagccactgctcccggccttattcttttgcatgcaaatatctcatttcctctatacaatttgttgaaaagactgtccttttctcattgaatggccttggtaccctagttgaaaatcatttatccatatatgcaagagcttatttttgggctttctgttttattccattggtctctatgtctttattttcctgtaccacactatttagattactgtagctttataggaagttttgaaatcaggagatgtgagttatttaactttgttctttcgattgtcttggctattcgggatcctttggtattccatatgaatcttagcatgttttcttttcttgtaaaaaatgttatagagattctaacaaagagtgtatcaaatctgtagatccctttgaatagtattgacatcttaataatattgactgttatagtccatgaacatggaatatctttctatttatttgtgtctttgatttcagcaacattttctaggtctcagtactaaagtctcttgcctcatttcttaagtttattctttgtgatgctattgtaaatgaatttaaaaattttggggggattgtttattgttagtatgtgggaacttaactgatttttatatcctgcaacttgtgaatttgtttacaattctaagttttaggattctaaagttctaacagatttaagattttccacatataagatcctatcatctgtgtatggagttaatttttttccctttctgatatgggtgccttttatttctctttcttgcctaattggtctgtctagaattttttagcactctcttgaatagaagtagtttaggttggcatcctcaccttaatcctgagcccagaggaaaagctttcagtatttcaccattgagtatgatgtcagctgtggggtttttatggatgacctttattatgttgaggtagtttccttctgttcctagtttgctaactttttattatgaaaacgtgttgaattttttcaaatcctttctgtgctttgagatgatcatgtgatcatgtaaaaaatgatcaagatgatttttttccttcattctgttaatggggtatgttaccttaattgctctctatatattaaatcatatttcttgagtccagcaaaaaatccttttattccaggaataaatcctcttattctaggaataaattccaagagtaaatgatatataaaccatgtaatgggctattgatttaggtttgcttgtgcttttgggttttgcattaatatttttcagatatattggactacagatttcttttcttctagtatctttgtctggctttggtatcagggtaatgctgtctttatagaatggattagaaagtattcctgcctcttcagtttttgattgtttggtagaattcactattgaagcgatcagatcgtgggaggttttctttattgggaggtttttgattactgattcagtctccatagtagtttatccagattttgtttcttcataattcagtgttggtagatttgtgtttcttggaatttgtttcatttaaggttatccatttgttggtgtaaaattgtttgtaattgtctctctcttaacagccctttttgttttgtaaaatgagtagtaatgttaccactttcatttctgatttaaattgagtcttttctgtttttttctcagtctaactaaaggttttcaatctcgatcattttgaagaaccaactcacatttttgttgatttttttctctattgtttttctatattttatttatttctgctttcatctttgttattttttttatttcgggtagctttaggtttagtttgctgttctttttctagttccttaaggtgtaaagttaggctattgattttaggtctttcttctttattaatgtaggtgtttacagctataaagtccgcttttggcagacttttgctgcatcctatgaattttggtatgttgtattttcattttcatttgtcttgagttattttctaatttcccttgtgatttctttgatctcattgcttgtttaaccatctgtttttaaatttctatacacttgtgacttctacactttttccttctactcttgcattctagactcatttcatcattattggaaaagatacttcttatgatttcacttttttaacattttttgacgcttggttttttacctgacgtataatctgtcctggagaatgtttcatatgcacttgagaaaaatgtctattttcctggatggagtgttctatatatgtcattttagtccagttggtcaattttattggtccagtcccctgtttccttattaatctactgcctggtgtttctattcagtattgacagtgagatattgaagtctcctattattatcaaggaactgtctgtttcttcttcttaattgtgtcagtgcttgctttatatatttttgaactctgatgtttggcacatatatgtttataattgttatgtcttcttggtgaagttatactttcattatcattatgtaatgtccttctttattgcttgtaacagtttttgatttgcagtctattttggctgtttttgttacaggcatccctgctctcttttggtgattatttgcatggaatgtctttcttcattttttttttcacttttaacctgtgtgttttctatgagttaacgtgatctcttgtagacagtatgtagttgcatcctgttttttaatccattttgtcacttgaagtttttaattgagaaaaaatatatttacatttaaagtaaatacagatggggaggacttacttttgtcatattgttatttgctttctgtatgtcttacagcttttttgatccctcatttcctcctttaatggtgccctttgtgttcagtggatttttgtgtgtgacatgctttgattcctctctcatttccagttttgtatattctacaagtattttctttgtggttaccatagagattgtgtataatatcctcaagttataacagtctatttatttattatttctttatttttttagacagggtcttgttctgtcacctaggctagagaacagtgttgtggttgtagctcactgcagcattgaactcctgtgctcaagtgatcctcctgccttgtcctcctgagtagctgggactacaggcacacgtcactacactcagctaatttttaaatttttttgtagagatgggtcttgctatgttgcccaggctataacagcctatttaagattgaggcaggttgcatagtcttatacctgtaatcccagcactttgagaggccgaggtggtaggattgcttgaggcaaggagtttgagaccagcctggccaatgtagtaagaccctgtctctacaataagtaaataaataattaaataaaattagctgggcataatggtgcatgcctatagtcctagctacttgggaagttaaggtgggaggatagcttgagcccaggaggttgaggctacggtgggttatgattatgtcactgcactccagcttgggtgacaaaaattttaaaaagtgaaaaataaaactgataccaagttagcttcaattgcatgcaaaaactctacttgtttcctgttttgccccctccagtttatcttattgatgtcccagattatatttttatgtattctatacccattaacaaagaattgtaattatttcttatgcatttgtcttttaacttatgtagaaaataaatagtagagttataaaccaaaattctaataacatttgctttatactcatccatgtatttacatttactgggattattatatttcattgttagctgaagctatgtgcctgagatcctaagtagagaagtctgttgaactagactgggccatttagattatttatttctaaatagttttagactgtaggtagtcatttaacttcttccttgtaacagcaccttttttctcccttacaaatattcagacctcaggcacagatctattttaaaatttaaccaaaggcttttctcatctaacatctaccaaacacttccaggagagttgctactagcaaggcaacatgagaaggcttcatgcctagttaaagtgtactaggaagaatagagggaattagagagactctggccttttcctatatggtacatggggtggacattgtttttaatacttattatacttaacatgtaaaagggagagacccacactcttttttgttgacctttacctcatagtgactctatctactaacaaatattgtccagggccctaaatcttactctcctagattttcttttcttagaaaatcaaagcatgcactgagagtcttgaggcagaggaatggctagaatttggtttaagagacagaaggaaagaaaaccatgctacgcattcccttgttttttttcaaatccagctttagatatggttcaatttaaagagaaaaggcttaattcttttcatttctcccaaattatgtctgctgcttgtttactcttttctactgtttcttgtaaagtttttcattctgtgataaagattaaagatctgtgcgatttcttgttgtaagcatatgactaagaattgattttttttagcatagtttaagtacttttcttcttggtaagtatgctataatcttggaagttacagggtaccagaaaaagtaggtgatatttctctgagggaagaaaagggcagcttttatcttggtttggacttgctctgtcagtatatgcttaggaagaatttatgtcttgtgatgcagggaatatgtacagcatagcaggaattaaaatagctgattataagggtacagggcagaaatgacaatgacttaacttagaaagatgaaatcttagaagttatttggtttctattttataatattgtgagcagtataaagtggatatgatatgtcaaatcctgaaactccacaggtgtcaggaacattcccttgaaagttgagctgcgttaagttgaaggcaaataaaaggatgcttgctatttggtagatactgttttggtacccagcatctttagactgcgcaacttgcagatttttcaagaaagtgaaaaaaagtttaagtgcattaagagaaccgattcataatgtttaacaaagttaaactactactacgcttgtgattaattacaaatatttaaggtattggaaataaaagaaagcttgtaattttctgtaggactccagtacatttttagaaagataacgtaagtaatcagtgtgcgtacgtggaaaaagtaatttttagggaaaatgcagggataaaaatggggagtgaaaactttctctctctctctctgatagtgaaaactaactttctgtctctctcaaaggagactgtcaaggcaattaaaagaataataaagcactctgatgtggttttgctcaatgatctttgatacatagtctcatgagcaggctatttgcactgccaaaccttagttttctcataggaagcatgtacatataggaacttaaatagagagcaaaaataggttgtctgcctcatagattgtgaggactgtttacaataatgcatgtaaagtgctttcctcagtgcctgtcacatgagaaacacttgattagtagtaattgtcaattgtatatagcaaacagtagaaggacattacatgaaataagaacataaacctctgaaaaataatgagtttagcccatctaatgaaactggttaatacggtaagacggaaattggaatagagatttttagtgtttaaaatcacatttgattcagataatttgagaacagtctttttaattagtgcacttaaatcagaataattcctttataattacttatttttatcttttcaaaacagattcaagatttatggaaagttacctcttatttctttacgaatctcagataaaaaactacaagggattatggaattgattgaaagcattccaaaacctgaaccagtaactgaagtatctgcccctgtcaaatcattccaggtaatgttactttcaaaattaatataagcatgaattaagaaagtccacaaatagtatttcaaacaatcacaggaattttatataagacaatttgcaatttgttttgaatagacattaagaaaattactttttttttttttttttttttttgagatggagtctcgctctgtcaccaggctggagtgcagtggcgtgatctctgctcactgcaagctccgcctcccaggctcacgccattctcctgcctcagcctcccgagtatctgggactacaggcgcccgccaccacgcccggctaattttttgtatttttagcagagacggggtttcaccgtgttagccaggatggtctcggtctcctggtcttgtgatctgcccgcctcggcctcccaaagtgctgggcttacagacgtgagccaccacgcccagccagaaaattacatgttgagagagaaattgaaatggtaaaaagtataaatagttaagaaagatataaaataataaatctacttttctaatttctgcagcctccaatccctctcctgagcaataacactgttaactactgcttctctagtttttaaaaaaatttttgtggcatatactagtacacacatgcacaagaacatgcatgtgtgtgtgtatgtagtatgtgtgtgtatacatacatgtatatattcattttttttttttgaaacagagcctatctctgtcacccaaggtggagtgcagtggcgcaatctcggctcactgcaacctctgtctcttgggttcaagcagttctctgcctcagcctcctgagtggctgggattacaggcgcccgccaccacgccagctaatttttttttgcatttttagtagagacagggtttcaccatcttggccaggctggtcttgaactcctgaccttgtgatccacccgcctcggccttccaaagtgctgggattacaggcgtgaaccaccgtgcccggcctgtattcttttatttttaaaattaaatgaaatcattatacacactattctgaatctgtattattttcaccattattatcatatatgccttagataaatttttatgttagcacatacagatctacctcatttgtttatggtgatatagtatttcattttctgcatataccatcttttgcttaatatatcttcttttgatggatattcacattatgagtgtttacagttatgaaaaatactgctttgaacttcctcatatatatacatatatatgtgtgtatatatatatttgcttatacttttattcataggataaattcctagaaatggaattgttgagtaaaagaggatgtgaattttaaattttgattattttgccaaaaaaaaaaaaatttttttttttttgggacgaagtctccctcttttgctcgggctggagtacagtggcacaaccttggctcactgcaacctccgtctcccaggttcaagcggttgtcccatctcagcctcccaagtagctgggactacaagtgcgtgccactacacttagctgatttttgtatttttagccgagatggagtttcaccatgttggccaggctggtcttaaaatcctgacctcaagtgatctgcctgcactgggctcccaagtactgggattacaggcgtgagccactgtgcccagcccagatttgcttaacttatagtttgctaacagtgaatgaatatctttctctgctttcattactgagtattagcaaatgttaaaattttattcgaagtgaaaaaaatgtcttctggttttgatatgcttttttaaataagtagaacatactttcctaagtttactattttaatttctgtttttggaaactgctgttcatgtcttttttctattgggttatggttgtctaattaaggaagtaacctgcttgtcatttaaaattactgttttttcctcattttattgtttggttgttttttatctcatatgtaaatttatttttgccaggcagaagcgttttattttttacatagtcaatttttttttccttcatgatttctggactttgtattatgtgacttttccctttccaagagaatttcagaaagaaaaaaaatatattcacatttccctccattttcgggggtaacagggggttctttactcatgtttaaatgcttttcttttgaagtagtttcaaacttgaaacattccaaaaatagtgtaaagaaggtttttttttattattatattttaagttctgggatacatgtgcagaacatgcaggtttgttacataggtatacacgtgccatggtggtttgctgcacccatcaacccgtcatctacattaggtatttctcctaaagctatccctcccctagcccccgacccctcgacaggccccagtgtgtgatgttcccctccctgtgttcatgtgttctccttgttcaactcccacttatgagtgagaacatgcagtgtttggttttatgttcctgtgttagtttgctgagaatgatggtttccagcttcatccatgtccttgcaaaggacatgaactcatccttttttatggctgcatagtagtctatggtatatatgtgcagcattttctttatccagtctatcattgatgggcatttgggttggttctaagtctttgctattgtgaacagtgctgcattgaacatacatgtgcatgtgtctttatagtaggatgatttataatcctttgggtatgtacccagtaatgggattgctgggtcaaatggtatttctggttctagatccttgaggaattgccacactgtcttccacaatgctggaactaatttacactcccaccagcagtgtaaaagtgttcctgttttgcaacatcatctctagcatctgttgtttcccaactttttttttttttttttgagacggagtctcgctttgtcgcccagcctggagtgcagtggtgcgatcttggctcactgcaagctccacctcctgggttcacgccattctcctgcctcagcctcccgagtagctgggactacaggtgctcaccaccacgcccagctaatttttttgtatttttagtagagatggggtttcaccattttagccaggatggtctcaatctcctgacctcgtgatctgcctgcctctgcctcccaaagtgctgggattacaggtgtgagccactgagcccggccccttttcccaactttttaatgaccgacattctaactggcatgagatggtatctcattgttgttttgatttgcatttctctaataaccagtgatgatgagctttttttcatatgtttgttggccgcataaatgtcttcttttgagaagtgtctgttcatatccttcgcctactttttgatggggttgttggtttcttacttgtaaatttttttcagttctttgtagattctggattttagtcctttgtcagatggatagattgcaaaaattttctcccattctttaggttgcctgctcactctgatgataatttcttttgctgtgcagaagctcattagtttaattagatcccatttgtcaattttggcttttgttgccattgcttttggtgttttagtcatttagtctttgcccattcctgtatcctgaatggtattgcctaggtttccttctagagtttttatggttttaggtcttacatttaagtctttaatccatcttgaattaatttttgcataaggtctaaggaagtggtccagtttcagttttctgcatatggctagccagttttcccaacaccatttattaaatagggaatctttcccccattgcttgtttttgtcagatttgtctttaaatagggaatctttcccccattgcttgtttttgtcagatttgtcaaagatcagatggttctagatgtgtggtgttatttctgaggcccctgttctgttccattggtctatatctctgttttggtaccagtaccattgctgttttggttaccgtaggcttgtagtatagtttgaagtcaggtagcgtgatgcctccagctttgttctttttgcttaggattgtcttggctatacgggctcttttttggttccatatgaactttaaagtagtttttttgaattctgtgaagaaagtcaatgataacttaatggggatagccttgaatctataaattaccttgggcagtatggccattttcacaatattgattcttcctatcagtgagcatggaatgtctttccatttgtttgtgtcctctcttatttctttgagcagtgttttgtagttctccttgaagaggtccttcacatcccttgtaagttggattcctaggttattttattctctttgaagcaattgtgaatgggagttcactgattatttggctctctgtttgtctattattggtgtataggaatgcttgtgatttttgcagattgattttgtatcctgagaccttgctgaagttgcttatgagcttaaggagattttgggctgaggcattggggttttctaaatatacagtcatgtcatctgcaaacagagacgatttgatttcctttcttcctatttgaataccctttatttctttctcttgcctgatttccctggccagaacttccaatactatgttgaataggagtggtgagagagggcattcttgtcttgtgccagttttcaaagggaatgcttccagtttttgcccattcagtatgatattgtttgttgctttgtcataaatagctgttagtattttgagatacattccatcaatacctagtttattgagagtttttagcatgaagggtgttgaattttatcgaaggccttttccgcatctattgaggtaatcgtgtggtttttgtcactggttcagtttatgtgatggattacgtttattgatttgcatatgttgaaccagccttgcatctcagagatgaagccaacttgattgtgatggataagctttttgatgtgctgctggatttggtttgccagtagtttattgaggattttcacattgacgttcatcagggatattagcctgaaattctcttttttgtgtgtgtctctgccatgttttggtagcaggatgaggctggcttcataaaatgagttagggagaagtccctctttttctattgtttgggatagtttcagaaggactggtaccacctcctctttgtgcctctggtagaattcggctttgaatctatctggtcgtgggctttttttggttgataggctattaattactgcctcaatttcggaacttgttattggtctattcagggattcgacttcttcctgatttagtcttgagagggtgtatgtgtccaggaatttatccatttcttctagatttttgtagtttatttgtgtagaggtgtttatagtattctctgatagtagtttgtagttctgtggaatcagtggtgatatcctctttagcattttttattgtgtctgtttgattcttctcttttctttattagtctggctagcagtctatgtattttgttaatcttttcaaaaaaccagcacctggattcactgatatttttgaagggtttttcgtgtctctatctccttcatttctgctctgatcttagttatttcttgtcttctgctaccttttgaatttgtttcctcttgctcttgcttctctggttctttaattgtgatgttagggtgttgattttagatctttcccgctttctcctgtggggattttagtgctataaattttcctctaaacactgctttagctgtgtcccagagattctggttgtgtctttgttctcattggtttcaaagaacttacttctgccttaatttcattatttacccagtagtcattcaggagcaggttgttcagtttccatgtagttgtgcggttttgagtgagtttcttaatcctgagttctaactggattgcactgtggtctgagagactgtttgttatgactgccattcttttgcatttgctgaagcttgttttaccttcaattatgtgatcaattttagaataaatgtgatgtggttctgagaagaatgtatattctgttgatttgggggtggagagttctgtagatgtctattaggtccacttggtccagagctgagttcaagttctgaatatccttgttagttttctgtcttcttgatctgtctaatattgacagtggggtgttaaagtctcctgctgttgttgtgtgggagtctaagtctctttgtaggtctcttaagaacttgctttattctttaagaatgttgaatattggcgcccactctcttctggcttgtagggtttctgcagagagctctgctgttagtctgatggtcttccctttgtgggtaacctgacgtttctctgtggctgcccttaacattttttctttcatttcaaccttggtgaatctgacgattatgtgtcttggggttgctcttattgaggaatgtcttagtagtgttctctgtatttcctgaatttgaatgttggcctatcttgctaggttggggaagttctcctggataatatcctgaagagtgttttccaacttggttctattgtccccgtcactttcaggtacaccagtcaaatgtaggtttggtctttgcacatagtcccatatttcttggaagctttgtttgttcgttttcattcttttttctctaatcttgtcttcatgctttatttcactaagttgatcttcaatctctgatatcctttcttccgcttgatcgatttggctattgatacttgtatatgcttcacgaagttctcatgctgtgttttcccactccatcaggtcatttatgttcttctctaaattggttattctagttagcatttcctctaaccttttttcaacactcttaggttcattgcattgggttagaacatactgctttagctcagaggagtttgttattacccaccttctgaagcctgtttctgtcaattctgcaaactcattctccatccagttttgttcccttgctggcaaggagttgtgatcctttggaggagaagaggcattctggtttttggaattttagcctttctgcactggtttttccctaatctttgtggatttatctaccttgagtctttgaagttggtgaccttcggatggggtttctgtgtggacgtcctttttgttgatgttcatgctgttcctttctgtatgttagttttccttctaacagtcagacccctttgctgcaggtctgctggagtttgttggaggtccactgcagaccctgtttccctgggtatcaccagcggaggctgcagaacagcaaagattgctgcctgttccttcctctggaagcttcgtcccagaggggcacatgccagatgccagccagagctctcctgtatgaggtgtctgtcgacccctgctgggaggtgtctcccagtcaggaggcatgggggtcagggccccacttgagaaggcagtctgtctcttagcagagtttgagtgctttgctgggagatccactgctctcttcagagccagcaagcaggaatgtttaagtctgctgaagctgcacccacagccgccccttcccccaggtgctccgtcccagggagatgggagttttatctataagcccctgactgggctgctacctttctttcagagatgccctgtccaaagtggaggagtctagagaggcagtctggctacagtggctttgctgagctgcagtgggctccgcccaatttgaacttccaggcaactttgtttacactgtgagggaaaagctgccttttcaagcctcagcagtggtgattcccgctccccccaccaagcatcccaggttgacttcagactgctgtgctggcagtaagaatttcaagccagtggatcttagcttgctgggctccatgggagtgggatccgctgagcaagactggcttcagccccctttccaagggagtgaaaggttcatcttgctggcattccaggtgccactggggtatgaaagaaagctccttcagctagcttgatgtttgcccaaatggttgcccagttttgttcttgaaaccctgggccctgttggtgtaggcacccgagggaatctcctggtctgccggttgcgaagactgtgggaaaagtgtagtatctgggctggagtgcaccgttcctcatggcacagtccttcagggcttcctttggctatgggagggagttccctgatccctttgtgcttccggggtgaggcaaagccccactctgcttcagctcgccctccgttggttgcatctactgtctaaccagtcccactgagatgagccgggtacctcagttggaaatgcggaaatcactggccttctgcattgatattgcctggagctgcaggttggagttgttcatattcagccatcttgccagccaccagtgtagagaagttttatccccagtctgttagagagtatgttactacctgggcgtggtggctcacatctgtaatcccagcacttagggagcccgaggcaggcagatcacttgaggttaggagttcgagaccagcctggccaacatggtggaaccccgtctgtactaaaaatataaaaattagccaggcatggtggtgggcatctgtaatcccaactgctcaggaggctgaggtaggagaatcacttgaactctggaggtggaggttgcagtgagccaagattgcgccactgcactccagcctgggcgacagagcgatactccatctcaaaaaaaaaaaaaaagaaagtgagttaatgtcccattactcctgaatactttagtgttttgttgtattcttttcctagtctgttggtgagtttttttgtttctttaattgtcttttggagggcaaaagtttaattttgatacaattgactttagcaatattttctctagatattgagctttttgtatcacatctctgcaatttttgcctaatttaaggtcaagaagatttttccctatgtttttttctagaaattttttagagttaggttttatacttaggtctctcatccatttaatttttctatatggtgcttgtgatgggatcctctttctagttttacatctgcacttagttatttccattttgtttgttaaaaagactattcttttactattgagttgactatatatgtgtaagtctatttcagactcttccagtgatttctgtgtctatcatttccatctgtttctgtccttttgttgatatcatactgtcttaattatactataacttcatgtcttgaaatccagaaaggttagtcctccaactttttgtatttccaaaatgttttcgactgattcctttgccttttagaatcaacttatcaatttccacaaaaattctggctgagatttggatagaaattgtatcattaatttgggagaattaacattttagcagtattgagtctttcagttcattaacatggtatatctctccatttgcttaggtctttttaagtttttaaaaattggttatttgtagcttaagcatccgtttgctaatatatgttgttaaatttgtacatagtgtatgggctgaattgtgcccttcaaaatttatatattgaaccctaattctgctatttcacattgtgactgtatttacagataggttctttacagcagtgattaagttaaaatgagaccactagggtgggcgctaatccagtttgactggtgtctttataagaaaaggaaatttggtctcacagagacaccagagatgcatgcacactgaggaaagcccatgtgaggacacagaaaggaggtcatctgcaagttaacgatagaggtggcctccagaactgtgagaacatagatttctgttgttaaagtcacccagtctatgctattttgttatggcagctctggcaatctcatatacgttttggtaccaagcagtgagttgttgcttaacaagcacttagaaatgttgaagtggctttagaactgggtaatgggcagagactggaagaattttgaggcacatgttagaaaaaaacctagattctatcgtttaataaattattgatataaaatatggacgttcaagctgtttctgttgagacctcaagtggaaatgaggaacatgttatttgacattgaagggaatgtggtccttgttataaagtggcaaagatcttggttaaattatgttctagtgatgaagttggatatttagctgtggagatttctaagtaaaatgttgaaggcatcgtcttatttctcattgcagctggtcaaatcacttgaggccaggagttcaagaccagcctggccaacacgatgaaatcccgtctctactaaaaatataaaaattagctgggtgtggtggtgcacacctgtagtcccagctactcagaaggctgtggcacaacaatcacttgaacctgggaggcggaggttgcagtgagccgagattgtgccactacactccagcctgggtgacagaaggagaatctgtctcaaaaacaaaaaaaaaattgtacaatatgtggttaatatgtgtttgatttattacaaagatgccagcctagctaagtgggggaaggatcaccttttcaacatatggttctgaaacaaccggatttccatgtggaaagtaaattaatttcaacccttatcttatatgcggaatttaacttgaagcatagacctaaatataaagtccacaagtgtaatttctggaacaaaaaatgtaggttaaaattttgaatccttgcagtaggtaaagataccttaggatataaaaagcgcaaatataacaggagaaaaaaataaataaattggactttataaaaattaaatttttctgctgtttggaagacattgttaaaaaaggtgaaaaggcaaaccatctaaccatccacttgggaaaaatagttgcaaaaatatttttacaagtccagacttgtatctagaatatatgagaagactaacagctcaataataaatgactaaacaggtagcatgaaaagatgttcgactttattactcaccagaaaaatgcaaatcaaagccacatagaaatactactacacaatggttagaatggctaaaaataagaagaatggcaataccatgtcaaggtgttgccatgacaaggatttaaaactctcatatgttacttgtgaaacttgaaaatagcataaccctttgtaatttagtttggtagtttttaaaaataaggttaagtatatacttaccatatgacttgggaattctactcctaggtttttacccaagagaaatgaagtcacatgcctaccaaaagacttgaactagaatactcacagtagggttattcataatagtaaaaagttgcataaaacccaattgtctatccagaagtgaatggataaggaaaaatagtatattcatacagtagactactactcaggaaaaaaaatactaatacatgtagcagtgatgggcagtgattgagtgtagggggagcttccctcaaaactccagggcattttagggaatagaacgcaggattacttggcaattcatttaagaacttaacaaaacttgtattctaaaacctaacaactacattataaaagaggaaaataatagcccagtttcactaataaatgtaagatacaaaaatttcaaaacattaaaagttgaaattaaggtaacatagttgttacttttgggaggatgcctaatgattgcaaggagcttaagggaggcttatgagttgcttgtaatgtttcatactggacctgggtggttggtaggttgagtgtgtttactttctgaaaatgtattgaactttagagtttatgtacttcgtgtagtagattataatgtgcttaaaaaaaatgctgctgctgcttccaaaatgagcagaatttcacagaatggcaaacacaaataaccaaggaagctatttgtgtttgatatgatatgtaaccgttatgcatttgtgaaattgtaattaaaactaggatgacatggccaatgagactgatataatttgaaatctttgaacaccctaagcattgtgaggatatggagagatagaaactgtgctgctggtgttagtgtaatgtcttatcaccacttttgaaaatggtttgatagtgctcaataaggtgaacatatataattttactgtttgggaaagttttatccacaagcacctatgggcatatcaaggatgtttatagtagtgctacaagcaaaagcaaaaatctataagcaacacagatactcaccaacagtatagtggacaaataagtagtggtttcttcatcagtgcaatacaatatcacagtaaaattcagttaactatcagtgtggttaaaatttaaacattgttttgtaaaggaagtcacaggaaaatgtatgtcatatatgctacagtttggaaagaggcaggggtaaacgatgcattatttagataatcattcataggtgctttagtacaaacaactaaataaaagcaagatcatgatgagaggtagggaacgtgacaaggaggaatgagatccgggaggaacacataagaagatgcttctaggtcaggatgtggtaatgttttattgcttggctgggttggaaaattcagatgtgtcttttattattatttttttaaactgcaaaatttgtttttatatatgctgtatttctccaaactgtaaaaaagtaaatttcctgaaatacctttcagagatcaaaaataaaagtaagttcctcaattctagaggctttaagtattgtgacttgtgtgttcctcacagatgtcctgatttaatactatgttgacttaaaatataagatctgtttctactcaaagcctgtcatcaaggacattattaaaacagttctacaatttttatttagccttaaaattgtaaaactacttctttaaaatctgcgttttataatgtatttttctaatttaaacctgattatcttctcagttaattcaaattggatagctttttgtcaaaactgttgtagaactttgaataaacattttttgaataagcggtgaataaacatttttgtgctaatcaacattgaattacttttctttcagattcaaacatctacttctttgggaacatcacagatttcacagaaaataattcctctcttggaacttccatctgtttctgaagatggtaaaatgaaactgcttaaggatatttttcttattttattaaaataatttctgttttgaggcatatttttctcaaaggaccacacagaggaaggaaaatatcttttccttttaaaatctaggttcttgactgaggctctatgaatggaagacagattaacatgagaaaacaagcagatttactagcattcatatttcatgggtacatgcaagaagctcaggaatgagtaactcaaggtggtgattaaaatttgggtttatataccagtttgggcttaaacaaaggaaaagaggttttgggcttcagggataggggttgctggggaggcaaggtatatgggaaggcgaccagaaaaagtatggtacacaagggtaaagtttgttacgcagatatgtcagtgttttctccgttgataagaatgtcttgggagtaagagtcatcttccctggtacagaaaggaagatacctttacaaggtagatttctcttataaatgttaatttcccttagaaaagggaaacttaggatctgtcttcagagcttttcctgtgtctgctgtttcttaaaataattgactcagtgtaatccttatgccaaaaagacatgttttcgagtggcgtattttggtcttctgtagtcatataagaaatttaaggcaatagcagatatttgtatattttcaggaaattttaactaaaatttattttaaatagcacaattccttaaagttgcttttgcaatgggatttttttggtataaagttgaacagaaaatgacaaggaccagccaggcgcagtggctcatgcctgtaatcccagcactttgggaggccaaggcgggcggatcatgaggtcaagagatcgagaccattctggccaacatggtgaaaccccacctctactaaaagtacaaaaattagctgggagtggtgctgcacacctgtagtcccggcgactcgggaagctgaggcaggagaatcgcctgaacccaggaggcggaggttgcagtgagcagagatcgtgccactgtgctccagcctggtgacagagcgagagtccgaatcaaaaaaaaaaaaaaaaaaaatgacagggaccactaataagttaattatctttatttggctgtgagttaaaaaacaccacaaaacttcacagatgtcttaatttctaatgtgttttttagttatttggaaaattttgctatagtatatttaaaacatttttaaaaatataattattaaaggaaaatcatcaataattatctacatttacatataaaaatatataactattctgataccaaatatgtgctttttaatgaccgtattagaaaaggtgtatgtctatatttttaagactttaaaaattgataaatgttaaataacagaaactgccatgtcgattcttggtttcttagagaacaatttttctttatttatagtcaccagagagaagttgtttgtgagatcatctactttaacttcagtcttagtttattagggatatacttctgattgtttcatttaaacctagttttaatggttttactaagttatctaatgctttttcagtcctttttaatatcagcatatgtgtatgctgatgtgtattacatatcaacgtatatgtacatatacctatatttgtgtatatatatgtatacaaagtagtgcttgatctcagtttacttcattcagactctgctgctaatattgcagagtttatacctaagtcctgttacactatccaggtagagtgagcatattaacatattactttgagtattcatggtgtgtataatcatcggcattggcatttcctgtaaaatttaagcaattttaaaatagactatttcaaaagatgggcttcttaagctaaagattacatcttaataatgttccatgcttctttataaccaagaatgttatttaaaagtagagtatccctttgtttaaaatggacaataaaaaagtacagtaatgtctatattattttctgtttatttcggttctcatgttaatatttgatatttaaaagagagccttagtgttttagtgttcatatttatttctattgaaatactgttaaattgatcattttaattattgacttaaataatgttctgtgaaatgtagattcagaggaggaattttttgatgcaccatgtagtcccttggaagaacctcttcagtttccaactggagttaaaagtattcgaaccagaaagttacaaaagcaggattgttcagtaaatatgactacatttaaaataagatttgaagtaccaaaggtaggtactacggtaaaattaacatggcttaatttgtttgctgtttctatatttacagcttactatatagtctcattgttaagaagcactatctttttcaccctaattaaagtaattccagacttgctgtgtgattcttggtcactccccgccccccccttttttttttaaataagattaacttccttaatcaagagtgaaggatttaaatttattcagtacatgtttttgtgaaaacgattatttatgttgtgtgtgtattgtatgtctgtgtgggtataaaatctctcctaaattttaaataataatatatcaattgtatgtatacctcatatattcacatgtaaccactatgcacataaacatgtttttgttttatgtagtggtaatttcttttttctttcttctccaggttttgatcgagttttatcaccttgttggagattgtgaactatctgtggtagaaattcttgttttaggattgggtgcagaaattgagattagaacatacgatttgaaagcaaatgcctttttgaaagagttctgcttaaaatgcccagaatacttgggtaagaatctctattttttaaaataaataaattaatttcattgtttgactacctgctagagagttttcaattctttaggctctgaatcagtacatttgctgaaatattctcagagaaccattcctttttgagttaatctttaacttttatagttggtaatgtggggggcacaccggagataaaatgaagataattttattcattatggaaaatcagatgataatggttgaattttaaatctacttaactgagtattggaacacttaattagttttctattgttgctataacaatttaccacaaacttagtgcttaaaaacaacacaaatttattatcttagagttctgtatgacagaagtctgacacaagtctcactgggcaaaactcaaggtgtcagtaggacttccttttaggaggctctagaggagggtccatttcattgttcagtcaggtgttgacaaaattcatttacacatggtttaagtctatgtttccttgttgcctgttagcggatggctgcccttaggcctcagttgcttttttgcacgtagctgctaaccacaataaggcatcagatcctcctcatgttgccatatctctaacctcctcttctgtgttttgcttccactcttaaaactccagtgattagattggacacacctctataattcaggataatatacctttaaccttaaccttaatcccattttccaaggcccttttgccatatgagttaacatattctcagattccgggggattagagcgtaggtatctttgttgggggcagagggcagtattctccttactgcaaaccttttgtgttcgtaatggatatatgatccctaagaaactattctgtttcctatgttaggtaattaggagggttgtatttatatttcttcatttacattttttggatttttccttgaaagataattgtgaatagtagaggcaattattaggacaccagtttcattttattaaactcctttgtagcataataatattatgtatgagcagaggtggaaataaaattttttaaatagactattttttagagcagttttagatcatgggacaattgagcagaaggtacagagatttcccatatactccttgtacccacacctgcatagcctttttcattatcaacatcctccactagagtggtacatttgttacaactgatgaacctacactgacacatcgtaattaccaagagtccacaatttacattaaggttcactgttgctgttataccttctgtttggacatgtataatgacatgcatctaccattaccttctcatgtggagtagtttcactgccctaaaaatcctctgtgctccacctatttgtccctccctcccacttaacccctggcaactggtgatccttttagtgtctccatagttttaccagcatgtcacataattggaatcatatatatccttttcagattggcttctttcacttagtaatatatgctgaagttacctccatgtcttttcataactgggcagcccatttcttttttagcaatgaatgatattctcttgtctggatgcaccacagtttatttatccattcatgtactgaaggatatcttggttgcttccacggtttggcaattgttaataaagctgctgtgaacatttgaatgcaagtttttgtgtagacataaattttcagtttcactgggtaaataccaaggaacatgattgctaaatcatcaagaaacagtttgctctagtaattggaaagaaaagtaaaccaacgtgacagtgttccctagtaacccaggaactttatagcagttactaagttttttttattattattagttttatttatttttattttttgagatggagtctcgctctgttgcccaggctggagtgcagtggcatgatctcggctcactgcaagctccacctcctgggttcatgccattctcctgcctcagcctcctgagtagctgggactacaggcgcccgccaccacgcccagctaatttttttttttttttttttttgtatttttagtagagacggggtttcaccatagtctcaatctcctgacctcgtgatccgcccgccttggcctcccaaagtgctgggattacaggcgtgagccaccgcgcctggccacacttattaagttttatgtttattcttatgtttgctttgccaagaacaaaggattaaaaaacccttgcaaacagaaaaaagagtatacaattattattgcgcttatttctgtaatatttttgtttctgttttctcagagggagtgaatagcagtttcttgcacaaagtaaatgatcagtaaatggttcaatgaatgaataaatgtgtaaacaaagtgggaacttttttaaggcttcaagtgtggctagcacttggagtagaaaacaggtttatgtgctaagcattaggtttggagaactctgtgcaatttgtggcatttttttctcaggaattgtaggattagtttgtagtcctttcttccagtctttagatactaattttctagcaaccgtaagtcatttggtgatgagagttttaaaagctttctataaattctcttctacactggttttcttagtatagcacattttgagcagaagcagtaatattaaaatgggagagttcctttattcccctcgcaggacatgccacaggggtgtgtatttccctagagggagcatgcagatgggcaggtgcagaggctgtggggagtgcttttgggctccggccccaggacagcatctaggggtaggtgtctacaacccctgaagcccaaggggcatgtgttacagtatgctctttcaactttgccatctgcagacagcttttgttaatcacctcgatagaccgtcttccttatcgcaagggcagggggccattgtgactgcctgagttcttgcccagtgtaccagaagaattggatgacatgtgggctggaaggatgagtgcaaggttttattgagtggtggaggtggctctcagcaagacggatggagagccggaagtgggggatggagtgggaaggtggtcttcccctgaggttgggccacccagcagatggactcttcactgacagcccctagttgaactaccccagcgtccggacgtccacgtccttcctcttctctctttttctgccatgctgccctgccactctctgccactctccaccactcttttcctctgctcttctcaatgctcagctgcttgtatctgtgcccactaaggccttgggcttatatgggcacaggatggtgggtatggtgggccaaaaggcaacttttcaggtgcaaaaacagaaatgcttgttctcgtttagggcctccagtttttaggcttgagggtggggcctttgctggggaactgccctcttctacccagtatttccctgtctgctgtccatatcagtataactaataaagactgattacatggtaatagggtttattttaatctaaactaatatacagaaaacttaatgtttcatctcattcccggtctgtcttctgaacagctgggttttcaaggactctgatgatttcctttttagttatttcagtgatccagggccagaattctcttcctgccctttcattgttcctaaaaaccattctagtttctctttagttgattcctgttttttcttaccttacctcctatctaggtttagaagggtatgagacttcagtgttgtggcacatgaggaggtaagggaattgtgaggagaaattaaatttttagagtttaaagaacaaagaagtaacttgacttgggtgaggtagaatccaaggtccagaactcatataggaaagccttcttttgcaattacataattaataagattgcttgcatttattttcagttacctttccgatgaaaagataatttttaaaaaattatttttagatgaaaacaagaaaccagtttatttggttacaaccctggataacacaatggaagacctgttaacgctggaatatgtaaaggtaagcagtttcatttatatctgcttaatatggtaagtatgctgctgaaatgttaagttttgtaagtttggtattattcagtttatttaatcttcactgtaacataatctctttgtaactcctaatactaaggttttttttattttgtcatcttgtattaaatagttgtgatttataaatacttcatatagcaaaataagaagattgtgttctaagtagaaatgacctggagtttgattttttttttctcccaacaggggtactgagaaagaaacacactttttagtcttgttagagtgtattgttttatgtgatacaagatgatgctttcactttcttttccactgttttgtgaagttacttgatattcctagggtcaataactccattccttttttattgatttatgatattcattttatcgtttgttaagcttttctatgtactatggtctatttctaatttttccatgtttctgctgacttccgtgtttctgcgtcagactattttaataattactttataataagaataatgcagaaagcatttaatcactttaaaaccatttttgctatccattattgactagatgtcttaagatttttgttgtatatgcattatatagcttttatgtagcaaaagtattctagacctaaagaaaatggataaagaaaatgtggtatatatacaaaatgaaacactattcagctttaaaaaagggggggaatcctgtcacttatgtcgacatagatgaatgtggaggacattatgctaagcaaaataagccaagcacggaaagacaaatacctcatgatcttctttatgtgtggaatctaataaaactgaacttatagaagtagagagcacagtgatggttaccagagggtagcagggatgggagggagggaaggagagggaatagagagttgtcaatcaaatggtacaaagttccagatagacaggaagaataatttttgagatctgtatacagcaggggaactgtaatcaataataatgtgttgtttattttaaaacaaccaagaaagtgaatttcaaatgtctcaccacaaagaaagataggaaagcgaggtgacagatatgttagttagcttaatttaatcatttaacattgtgtacatatatcaaaacatcacattgtcctccataagtgtatataattatgatttgtcaatcaaaaatattaaattttttaaaaagaaaaagaaaacacagagtatttggatacttggtggacaattctgtcacaaattttgtttttaaatacaggaagaattaggaagaaccgtacagagttgttgatgaccgaatgattattctccacacttgataatatccaacatttcctctcttaataataagaatgatagtacgtaacatttattgaatacttgctatgtgccagagagtccaatacttacattttcttttgttctggtgaagcggttgcttatttaggtaattatatgtgtgtgtatatgtgtatatatatatatatatatgtatatgaacagctggaaaattatataaatgtgtattaggactataatgtgattgtatatgtatgtcttcctaacgtgttctaacagatttgttttctctttggataggctgaaaagaatgtacccgacttgaaaagtacctataacaatgttttacaattgattaaggtatgagtagataatttattttttaattatgtactatttcttatggaaattattttctaactggaattgtaagatccttaaagataagaaaatattataaattatatcctttatgccacaaagcatagtgccttgtagagagctggcaagcaaatatttattgacctatcactaaaatcagctttgttctttaggtaaatttttcctctttggatattcatttacacactgaagcacttctgaatacaataaattatcttcataatatccttccgcaatcagaggaaaaatcagccccagtgtccactacagagactgaagacaaaggagatgtcattaaaaaattaggtatgttttttaaaaatttagcatcaactttttttttttttaaccatgtaggtcaataaatctagaccctgactttattattaacttcaaatattggcttcagaattctgttgcctaggttaatatctagaaggattcattatatgccaggataattttagaaaataaaggaaactactggcgaagaaaatgttgcttttgtttatcgtatataataattgtttttagtttaagattatatagtaggagtattagattaaaaaattttttttcttccacctcccagtaggaggattagatttaaattaaaatttatgcatttcatgacattattttagattagacaaatatgactaacaaaatttgagtattgtcagctgggtgcggtggcttatgcctgtgatcccagtgacccagggaggtgagcgctgtggggattgaggctcaaggatcacttgaggccaggagttcaaaactagcctgggcaacatagcaagaccctgtctccaacaaaattttaaaaattagttgggcatggtggtgtttgtctgtagacccagtttacttgggaggctgacacattagaatcactggagcccaggaattcaaggttgcagcgatctttgagctacaattgcaccactgcactccatcctgggtaacagagagagactctgtttcgaaaaaaaaaaacaaaaaagagtatcagagcatattttaaaatcagagtatagtactttcgaagcagtgaaaagttgcaattttgataatgacaagtatcacctagtaattattggttctcaaaaaattttgaaatttatagctacagtgttttagtttcaaatgtttagtttcttcttgaaacagtgttgtctatttgcttttgtttttgttagattttattgttttttagaattttcaattcagtagggaatatcataccttgctttcaactgaattgcagatcaggttttctctgatatcactatttgtggtgatatttcagttactttataagtatagtgaggtaactactaaatgtttttcctcatgttttataatatgaatttttttttgcagctttaaaactatccacaaatgaagatatcattactttgcagattttagcagaattatcgtgtttacagatctttattcaagatcagaaatgtaacatttctgaaattaagattgaaggtaataaaatttcacaaaaagcaaattaaaagacattaaatgaaagaaaaggcagtcattcttttgttcccttagggcttgattctgagatgattatgaggccttcagaaactgaaataaacgcaaagctaaggaatataattgttttagattctgatataacagctatatacaaaaaggtaagaattcttttaattaaataatagtacatcattaaataggattgtcctttaagagtggtcataggtatcatttggacatttgtcagaatttagtagtatggcttattatgtgcatgggttttggagtcaggcataattgggttcttagctctactccttagtagctgtgtgaccattagcaggttacctaatcttggactctgtttctttatttgtaaaatgaggattacagtatctcataaatgagataagtacgaataatgctgcaggaacaaagttttgggagagaacctagtaaatacctttttcactttttttttttttttttggttcatgtactctgaatcttgtaatgcattttagatacatttgagggtctgaagtctgaggaagtgagattttttataaagcttattgtcatcagcgatcactagtatcgttgttgtaataatgataagagagtcctttgaactggatgattagttgttgaaggttaggtaatttgttactggttataaaacagtgaggttcctgctgcagagttgaacaggcaacatcctacctgaagcaggcaggattatgtatttaaggaggttaaaggaatatcagatagtaggatcaggaaaaactgaagtacttgttgagtcaggaagtcagcatttggaatatgttgagaagaaaggaaatagataaatagattttgccagtaatactgtagtgatgaactgatttttatgtttaaaaaattcttatttctaatatcttcttgttatggcttatttagtgggatagaaaaacagttccaacatcaaaaagaagtgactcatagcaataaggaacaagaaattttccagaagccgtggttttatttgcttctattgcttttattttaaaaatcataagtatcagagtatttaagaaataggttatccattttattttccctatctagaaagtaaagctcacagaaataaagtatctacgaaaagttatacagaactgagagcatgatccaacccattgatttttttctctgtaattttattttattttatttttttattttttttgagacagtcttgctctatcacccaggctggagtgcagtggcgcagtcttggctcactgaaacctccacctcctgggtttcagtgattctcgtgcctcagcctcgtgagtggctgggattacaggtgcgcacaaccacacccaactaatttttatatttttagtagagacagggtttcactgtgtttggccaggctcatctcaaactcctggcctcaagtggtctgcctgtcccggcctcccaaaatgctggtattacaagcatgagccactgtgcccggcctgtaattttatttttaatatatctacaaggttaaaaattcagtttacagaaagttacaaaataaaaaaaatctttctccttgtcttcttgcacgattttcatttccctttccctgtttctttgattccattgtacatggtttttaaacaaactgccttgtttagtaactttccacgtgtcaaagaaccagagaggcataaggtttttgcccttatgaaatcagacctgattatgaatcagtttcataagccttgtacagcgatatatattattgtgccagttttaagtgtactgagacattgaggccctcaactttaagggtgggagcccccagaccatttgtttgactctgtcttggagcagcatcctccatttactgtagcaccattggacaaatactgtttttatttatatatgccataaggtaaaaaggattcttgctgacctgatagtctcatgaaaaacatatcatagtaaattagtttctgatatcttcttcataaaaaatattttgaaagtaaaggcttaaaaaaatccaatttttaatgcttaattcttggtgatgggtacacaagtctttctaattattctcaacttttctggccttgttattaggccaacacttgcttcatgaaatgagttgggaaatgctttcttcctgttttctgaaaaatttgtatagaatttgcattattccttaaatgtttgatggaattatcagtgcaaatattttttgtgtatagttgagtctgggattcactttattttattttccatatggcattcagtatccaaaggagatccacacactgcatttgattgatataccacttaagtctgttatagtttatgaatttcctttagtttcttctctgcccttgtgttagccatttgttgctatcttatttattctgtacaattttccatagcctgtatcttgctgattatgttttcatgctatttaacatgttactgtatcctgtgtttccttaaatcggtatttaaatctcagggcacagtgagattcagggtttgggagtaggggttggcaagatacttcatagttggtagtgtgtgttttcataggaggcacatagtgtgtagctgtcttttttttcttttctgttttgcactgtcttggaatattttcttttttttatgttagaagctatttgttgttatttcctgtaatttggtcttgaagtctgtgtctggagagtggccataagccaaaatagccactttctagcttgcaggcatgttggtcagatgggacatcggggaggcaacacaacaaaacaccctcgaggggtgcccaccagggaggctgacaggaagtctggaggcagtagggacgtttcttcatttattaaatgggagagttcaccagtctttatgctggtatcaccaatcattttggcttttcaaaagtttattctccagtagatttcttaggcagggctcataggaacaataatccttatttatatttgcagggtagtttgactggattttaaattcttgccttgaattttcttttctagatgatcttaaaacatattactccatgtcttatggcctagtattggtgttgacagttctgatgacagtttgactttctttcgcttctaagaactttgccattttccccagacattcagagctaatttgaagctttatgtagggactttggacaggtagacatcacagttgatggtcaggaactggtctagcaattttatgggttctcagattgagagtatctcttgttcttaggctagttagtttccgttgagaaaaatactattaagtataagcctggcagcctacattccagaagccaattggttgaaagaagtggaggcctcatcatttagtttatagatttttgcttaaaataaccactttttaacatggtgttttattaaccgtctttctgtacctgaagtctcctagaccacagcctttctgctctaaactctgtcgagcaaatctgttctgttgaactcggagaggaacagtcatatagtcctactcatgtgacatgcagaggctattcggtttattctaaactaatttaccagtatttatataattatatagatacaatttatacattaatatatatgtaaattatatatgtataaatactggtaaataaattaagaaaaaactaattatatatattatataataatatattttatatatacataaaattctctctctctctctctctctctctgtctccaatcacacaatcacagctcactgcagcctcgaccttccctggcccaggtgatcctcccacctcagcctcctgagtagctaggactgcaggtgtgtgccaccaggcccagctgatttttgtagagatggggtttcaacattttgctcaggctgccctcaaactcctgagctcaggcgatctacctgcctcggtctcccaaagtgctgtgattacagacatgagctgagccacagcgcctggcctatttgagatactatagtcagcaaaagataaaaagcccttctccacgtggaataaatagtagttaatcagtaatataaaacaatattagagagtgatatgtgctttgaaaaccaagaaagcagggtaatgtgacaggtaataattcacgtggcgtattaggattatcaagaaatgcttttttacagtagaaacatttgacagaaatctgagctgtggatttgagccctgttgaaagagctttccaggtggaggaaagagcaactataaaagccttgtagcaggaaggtgcttgctatattctgggaggttttagggccctcagtaacctttgggtagaattatttattagtttctgttttggtttagtttttactttttaaagtaagatttattgagacaatttacctatagtaaaacttacctcttttagttataattctgtgagttttgacgaacatatactgttgtgtaacttaccttcagcatatacaatgggtctgtcaaccctaaatattcactactgccctttgaggttagcccttctccccatcctagcaccttagaatcactgcactgtttttcgttcctgtagttttgcagtttccaaagtatcaaataaatggaatcatgcagttatgtagtctttcacgtttttttttcttagcatgtgagattataatttttgtctttttatgtcttgatcagcctggttaacgatgtatcgattttattgatactttgaaagaactggcatttgtttcaattgaatgttctctgtttttaattttatttatttatgctcttttaagattccttccttctgcctgctttggatttaatatgctcttcttaaggtggaagtttaaattattgatttgagaatgtctttctgttgtaagcatttgctgctataaattttcctttaagcactgctttagctgcttcctgtaagttttgatatgtcatatttttattttcattcaattcaaagtattttctaatttctcttctgactttcttttacccattgtttatttagaaatatgttatttaacttctaaatattttgagattttcagatccctttctgttactgatttctagtttaaattcattatggtcaggggagaaaccgtttcagttcgtttaaatttgttgatgtttgttttatggcccagaacatatatgattaatcttggtgaatgtttcaagtgtacttgaaattaatatgtgttttgctgggttgaatgttccatttgggcaagtaggttggtggatagaattattcaggctactgattttctgtttactggttgtgttgaagcctctgattataaccattgatttgcctgtttctcctttcagttctttaagttttttgctttgtatgttttggagatctcttgttaggtacatataaatgtgtatgaattttatgccccttttgtgattatgtgatgtgtctttttatctgtggtaactgtgcttgttctgaagtctactttggtagtaatatagccattccaggtttcttcggttaggtttgaatggtctatctttttctgtcctttagcttttaatggatgttttcttgtttaaagtgggtttctgttttttgatgcaaagtctcactgtgttgcccagggtggtcttgaactcctgtgtttaagctcgcctcagcctaagtagtaagtagctgggattatatgtgcatgccaccacatctggcttaaaatgggtttcttacagtcagtgtatatttagatctttcttttttatctaatctgacaatctcttggcttttaatttgtgtttagactattttataaaactaattattgatatgattggattgtaatctgatatctctaattgttttctgttctctaattttgtttatcctattgtattcctccttttggcctgatttttgattaattatcatttattttatggtttctctagggtttacaatgtatatatctttaatcatagtctatcttccaataatattttattgttgtacatatagtgtaagaatcttacaataccatgcttccaattcccatttcctatctttcttggtatcatcataatttgctttactttggtgcatgttgaaaactcacaatgtgtacctattgaatttggtttagtcagttttctttggagcaattagttttctaaagatgttttatatttttcttcattgcaactctttctgtaactacttcatgtagtttctgtctattgtttgtatttctctctgaaatactttctcatttcttttttttttttttgagacagagtcttgctctgtcgcccaggctggagtgcagtggtgcaatctcagctcactgcaacctctgcctccggggttcaagtgattcttctgcctcagcctcccaaatagctgagattacagatgtgtgccaccacacctggctaatttttgtatttttagtagagatggggtttcaccatgttggccaggctggtcttgaactctttgacctcaggtgattcacccacctaggccccccagagtgctgggattacaggcgtgagccaccgcatctggcactttctcattttttataatgcaggtctgccagtaatgacttctctcagttttttgggtatagatgagaagggagctgggaaaaacctttatttcaccctaatttttctgagtgacatttttgctgggttgtgttttccccctttccaactgttaaaagatgtgatttcattgttctttgttacacatacttttgatgagaaatctatgacatttcttatttttgttcctctgtacataattggtcatcttttttgactgctttcaggatttatatatggtgtgactagatgagtttaattgtgttttgatatttgtcctgtttgggcttttctgagctacttggatggatctgtctttcaatatttttcatttttttcttcaaatagtttctttgcctctgtctccctttctctcccccaccccctggctcccctgttttctcctcctccactttttccctgttcctcttcttgaattcctgaaattcttgctggatttctgtttatagtcccacagcctttggatgttctgttcaagttttttccccattgttttcttagtgccttttaattcaaataatttatcttgacctattttcaaatctactgattttgtccttggctctgatgagtgtactgacaaacccactgaaggtattttcatttatgttaccatgttttttaatctttaatatatccctttgactcttcttttttccattttctctgctataataatattcaccatctattcatgcatatgttccactagaagcctttaccatattaatcatagtaattaaaattaaaaattttagtttcaacattgatgttatagatgagtctgattctgttgattcctttattatttgcttgaattttttcccttgcttttatagggcatctcataattattgatcgaatgtcagacatcatatcatgcatagcaggagtccccaacccccgggctgtagaacggtaccggtctgtgacctgttaggaactgggccggacagcaggagttgagtggtgggcgagggagcattattgcctgagctccgcctcctgtcagatcagtgggggcattagattctcatagtagggtgaaccctattgtgaactgtgcatacgcaggatctaggttgcatgctccttgtgagaatctaaagcctgatgctctgaagtggaacaatttaatccccaagccatctccccaccctccaaccccccagccccacttttgtggaaaaattgtcttccacaaaacagctccctgttaccaaaaaggctggggaccacagatgcatagcataatagagactgaggtaaatatcatagtatttatgtctggaaacggggatgcctcttttctgctaagctattagcttggggtggggggttgagcttaggttggtttgaattccagattaatacgatttccttcactacattactgcttcagtttcctttagttgtaccttgtgcttagggtggctggaggctgtgttgctcagattttgctccgtgctgagcctttgacctttcttctactcttgtacctcagaaaattctctttccacattcttagctctttcctagatgttagaggctcctgctgcttgtttcttagtgcttgtgagcttgatgtatttggggagaaggcaaggtggtttggataggcttgttagtgttcttgtccattttcactcctagccagggctgtttctgtgagtctcagaaatggagtattcttggccatcctgcccctcctcctcatggcatctgattgatatctctcgtatttcctatgtgggattgactatccttcccttccccagcagagggagacctctaatcatctggccccaggagagttcttgttcttcccctagagttttattttattcttgtccctaggatactgtatcttcacctgtgccctgagggaaacaaggtttactgcccttcccctagtttcttatggctattgttttgagtagttgataatcttggtggtgctttgggccttttctgcagtggaggctcctcaccttttccagggtcataccaaggaaagccttctcttgtttcccacttgcacccatctcccgtctttctcaagagctcctcacgtgtgtggctctcagggattctgcatctcacattagtccacacttatcctttatcattttagctgaattattcttacctatattgtatagtatctgacatctctttctcctctctaccacaagtgagctggtgcttattttctctctctccctgaaggtacctgtttgtccttagatttttagggatctttgttgtcctgtgacctcagattgctaatggttttaagaaagttatgatatcatagtttatcgggttttttttccttttcttaaggtttggaggggccctcactccagctttgtgcaccctaggcagaagcaggactgtagacttcttttcagccctgtcttgtacctcagccttcggaggtcacttatacctctggttctggaggattctttgttctgtagttgtaactgatttgcttgttgatggctcttcagctccctgttcttgcttgcttctagcatttaggagaattgagaaagttatgagcttagtgctctgtccctcttccaaaattttttttaacattttacatctcctgttgtcgccaccatttttaactgttattgcagagcttgagatttttaaccactgtaggtaatttctggttggcaattaagatggccctttacaatctgataaggaacagaagtatagcaataggaggagactcctttgaagaatccagaaaaatctattcacatacctcaaatcaggaatagatttcagtaaggtgtagatatacagtgtttttcaaatttttgtcagtcaatcaagaaatacatggttactctcattacgaaagtatacttgcaaaatgaaaatgcatattcagatatttcctcttctccattaaaaaaaaaagaaaaaaagctggagccacacctactaccttgattttatgacccacaaaggaaattgccaccaccaatttgtaaaagtttgtagtgtaggttccaataaaccagttacagtagaattgttgcctcatttgtacttggcttgtgaatacttgggagattttctaactatgttttgttattttttactgttttatttttgtactgaaaatacatcatttcaaaaatggattgtgataattaaattttctcttattaaggctgtttatatcactggaaaagaagttttcagcttcaaaatggtttcttacatggatgcaactgctggttctgcatacacagatatgaatgtggttgacattcaggttaatttaatagttggttgcattgaagtagtttttgtcacgaaatttctatattctatattggtaagtattttattaaattattatttattttatactaattggaaattgctatatgtcaaatatggatgaagactagtaagaattccttgcttgagattttttctgattttttaaatcttctgggtaccatttattatacataataaatgtgtagttccttatttatataacatcgttttgacataggaatattctaattaattgaaatatatatttcatatagtaacattaagtttatgtgcattatatatcataaatatgttatatattaattagaaccttcgttttatatgtcattggcttaagtcttcgttttacctgacttgcaactataatttaaaaatactgaatatataattgaagtttgttttggtctgaagtcatcattaagaaaaggttattttaattttctagagacaaggtcttgctctgtcacccaggctggagtgtagtggcatgatcgtagctcattgtaaccttgaactcctggattcaagtgatcctcccgccccaacctcctgagtagctgagactacaggcacatatcaccatgcacataccaccaagctaattttttttttcttcaagtttttatagagatggggtcttactctgttgcccagtctggtcttgaactcctggcctcaagtgatcctcctgctttggcctcccaaagcgctgagattacaggcattatgtctggcccaagaaaatcatattttcgattgcattgtcattctgtgaatatcagggactttaaggagttagatttaacccctatatgactccaccctaaggcatttcggttcttatttcggcttttcttgtttcattttgtttcggtttttgtttttcccttgctgtcagctgatattttttcctgtgggtgtcacacctatctccataacatcactattcattcttttaaaatgctgtctcagtgttttagtgtatgaactaggtaatcaaatctaaggctgtagtggaataaataggccaagtgtggcaattcttataagcaagaaaagtatttgcgtgttcatttgaatgtatttgggaatgtggagccctcttttgttatttcaaaattctaagttaattccatataatgttgctgttttgtgatcttttaagccataacatcattttgtacacaaaaatgtaaagataaacaagtattccttgttgaatttcttctcttttaaaaaaaattagagttgggttcttgctctgcagcccagactggagtgcagtggcgtgctcctagctcactgcagcctcaaactcatgggcacaagcaaatcccatctcagcctcccaagtagattaaattagtagggacaacaggccctgctaattttttatttttaattttttttttaagacacgatctcgctgtattgcccaaactggtctagaactactggccccatgttatcctactacctcagcctcttaagtagctaatttatttttataaccaaaaaaatcatgtcacttgagccctcttgtacttatacttagaaattactaaaatgttaattttttctttgaacatgaaaattaggtataagagtataaatatagataattatattttatgtcattgaagtttttttttggaatttggaaattggaaaattattttgaaacttcttaaacatattttatttatttatttaccttacaaatataaataagctctctgtccactgaggttgtatagagaaatagggttgtttttcattagggaaagtgagataagggaagtagatatctgtaagacattccagtgatcccatttagctttgttctgaggactagatttttattttatctgtgtctttgtgtttctcagtttttgtggcagaaaattaagatttaatatagacagtaagattttgaataaataatgcttggttgtatcaagtaaaagtttttttttaaatggaggtaaaaccataaatatcaatatatatttaataagtcgtatttattaataaccttaagaatataattctgttatcttacaggcttttatagataattttcaggcagctaaacaagccttggctgaggcaactgttcaggcagctggaatggctgctactggtgtaaaagaactcgcacaaaggagttccagaatggcactggatattaacatcaaagccccagttgtggtcatcccgcagtctccagtttctgaaaatgtttttgttgctgattttggactaattacaatgacaaatacctttcatatgataacagagagccagagctctcccccacctgttattgatttgataacaataaagctgagtgaaatgcgactatacaggtaagcttttcacaagtatatttgtgtggaatgcaatatttttctaactttttaaagactttgatgtcttgagtagtctgtttacagtgagattttattttattaattatacataacttagtgattctctcttccttaagtatattttggcaaaatcaattatagtctttgcattttaaaaaacctagaaagtgtttgaaaatttctccttaggtaattaggaaaactataaaatttattatctgaggaagtatatttgtgcttttttgtggttcattataaattacatggctatggaaaaaatgaggaatttctaatgtaatatgtttattcactttgcaaatacattatcatcttatcttctctgtcggttgttgctgtggctctgatgctgtaatttaaacgaacatgcagtagcatacaaccttattcgttaacctgtattcgttaagcatagggttaggaattaggcggataaccaaatgttcaaatagttcgagagcttttatactgtgtcctctgtgtttctgtgctatttctaattgcccattctgaatttatgccctattttccaacttgaatccttctctatttatacttctcaactgccctcttccttctttctgtcatttttctttgatataattctcttgcttgtctcttcaccttatttttgtctcattttttacttaactaactcccattctctacttctctttagcttcctatgagtctgtctttccctcctgtgctttctttgatcaattgtatatttttaaagcagctttattgagacataattgacacagaataagttgcatatctttaatgttataccattttataagttttgatatgcatacatttctgacagtttatgtacagttgtattacttcttccttaagtattaggtagaatttaccagcgaagccatctcgtcttagagtttgcttgtgggagatttttaaatgatagttttcatttctttaataaatttggggctattcaagttattttttcttgagcgatcctccctaatttcttaaaagaatttatccatttcatctaagttgtaaaatttaatggcataaagattttcataatgctccttatttattaatatctgtaatgatgtgtcctccctcattcctgatatttataatttctgcctttgtactgatcaatctggttagcgatttatccgttttattgatcttaagcagtttttggttttatttttttttctttttttgttttctcattcattgatttctgattcaatatttattattctgcttactttaggttcaattttgctctttttataagtttttttaggtgatagctaagattattgatttgaaacatttcttcttttctaatatatgacgtgctataaattggagtactttataatattgtgctatgaattttaagttactctataagtctgtgtagctctcttctctctggtattttatcatataaactagctaccttggtttctcttggactctcagctcttatcttctctactctggggctttcctggccttcccctgggtcccccctccctgtaccatggcctgttaattatggtaaaacaatagtaaactgggacaatcgtagggctcacctcatttttttttccaactctttggaatcactatccatttttgatgtcttgtgtcttgaaaactatttttaagtcaattttgtctgtcttttttttgggggggcagggttgtttcaagcaggagtgttaaaccattcatgttactccatcctagatggaaggagaaatttctgtcacttgagcatttattaagcaccaaatctatcccaggcattgtgctaagaataagaaatataatagtgagcaatctttataagggattaataagtaatccctacctcattgggttgttgtggtaggtactgtttaataaatatagtgggctggtgcataaaatgggatcacattttgaaaaggttctagaaattaggtcaaaaggagacaaaactagaggttggaaggataatttggtaactattgcagtaattcacataagaattataggtgacttagtctaaggtaagggagtgaagtagtggagagctaaccagaatttatagtaactgatggttgaatgggtgtgggagttaaaggagaagagaaattaaaattcactttaggttacaggcttggaaatcagcgtttgatgatgatacacttcactgagataagacagaacaatgcagaaaaacccagtagaatagagatagtaattatttctctaatgggcaaagtagcctgaaagtggttgcatgacttctacatggagagatcttgaaagaaatccagaaggcagtggaatatatgtgcctaggtgatgcacataggtgatgttgtttagacttctaggtttaggagttcttagtaataatttgtgctagtcactgaagcctttggaatgagcacagtcacaaagaaagcttgtagagtgggacatatgaagaagaatgctgaggaataccagtgtttaaataattgacagaaagaggaaccctcaaaagagacgaagtaggagcagacagagagatgagaagccaggaaaatgtatttgaggcagcagtgagggtcctgctgatattgttaaccatgaattaatagtgtatcatttttttttcatgcagtacttggtattttgtatttggaatccaacagtcagttggattgagacaaaactgaattttttgccaagcaagtgtgaccgaaggtagtggaacaggattttaatgattgagaatcatgttgatggataatagagaggtgatatagtttggccatgtccccacccaaatctcatcttgaattgcagctcccataattcccacatgttgtgggagggacctggtgggagataattgaatcatgagggtggttcccccatactgttctcatgatagttaataagtctcacgaactctgatggttttaaaaggggaaacccctttgacttggctctcatcctctttttgcctgccgctgtgtaagatgtgccgctgtgtctcctttactttctgccatgcttgtgaggaaggggtccagtttcagttttctgcaaatggctagccagttttcccaacactatttattaaatagggaatcctttccccattgcttgttttttcaggtttgtcaaagatcagatggttgtagatgcgtggtgttatttctgaggcctctgttcttttccattggtctatatatccgttttggtaacagtactatgctgttttggttactgtagccttgtagtatagtttgaagtcaggtagtgtgatgcctccagctttgttctttttgcttaggattgtcttggctatacgggctcttttttggttccatatgaaatttgaagtagttttttctaattctgtgaagaaagtcagtggtagcttgatgtgaatagcattgaatctataaattactttgggcagtatggccatttaccacagtgagataccatctcacaccagttagaatggcaatcattaaaaagtcaggaaacaacagatgctggagaggatgtggagaaataggaacacttttacactgttggtgtgcgtgtaaattagtgcaaccattgtggaaaacagtgtggcgattcctcaaggatctagaaccagaaataccatttgacccagccatcccattattgggtatatacccaacggattatgaatcattctcctgtaaagacacatgcacacgtatgtttattgcaatactgttcacaatagcaaatgcttggaaccaacccaaatgctcatcaatgacagcatgaataaagaaaatgtggcacatatacaccatggaatgctatgcagccataaaaaagaatgagttcatgtcctttgttgggacatggatgaagctggaaaccatcattctcaacaaactaacacgggaacagaaaaccaaataccaccacatgttctcactcataagtgggagttgaacagtgagaacatatggacacaggagggggaacatcacacagcggggcctgttggggtgggaggcaaggggaaggatagcattaggacaaataattaatgtatgtggagcttaaaatctagatgacgggttgatgggtgcagcaaaccaccatgccacatgtgtaacaatgtaacaaacctgcacattctgcacatgtatcccagaactagtataaaaaaaattagaattatattgttttgtgctgtaaatagcttttttcttaataatatgctgtaagttttcatgtcattattttgagtgcataaatttttccaaatattcctgtttttagaaaatctaaatctgccttttgttagaaatttgattctaatatatatacagttttgctattataaataacactatattgatgattgatatctttattacatcagtacttttgtaattgtctactcatttctttgggataattcatttcctgaggatgagttcctagaaatagaattactcagttatagagtgtagccagtttttcctgaaataattttaaaataattgataattgaaaatgcagttgctgggcacgttggcttacgcctgtaaacccagcactttgggaggttgaggatggcagattgcttgagctcaggagtctgagaccagcctgggaaacacggtgaaaccccatctccacaaaaaatacaaaaattagctgtgtgtggtggcatatgcctgtcatcccagatacttatgggactgaggcaggagaatcacttgagcctggaagattgagactgcagtgacctgtgttaatgccactgcattccggcctggatgacaaaatgagactgtctcaaaaaaacaaaccaaaccccagaaaatgcagtttagttacaacttcttagaaagtgcataaagaaaaataggaattcatgtttgtgactaggttctttatacattaatccaacttgactgcaatttagcaaatatttattcattatatggcacatgccaatcatctaagtactgacaaaaagcaaagaataagatgaacatagttcctgccctcatgaagctttcattctaattaaaaatatagaggacataataaactattaaaatgcaatatattaaatgcagtgatggaaaaagtataaggtgcatgtgggagcacgtaggaaaggtgtattttatccatatattgggtagtactgataagaaaagtttttccagagaaagtaatcttttgacataacagttttctttctcatagtttgtccaaaggacagaaatttactcaaagatatatagatgaagatatagatatagatatataaaatacaagtatttattatggtgaagaattggaaaatatgaaattttaatcatagaaggttaattaaaatactagtatagccatttattctgatatggctattaaaattatatatgcatcctagcctaactgaaaaaaagaaaagaaaacctatgtgtgcagcattccctatggggcttttagattccttaacctattaccattaagcggagactgcaagcatgcaggcatatgtaagtttggtgtcactctatcattcattcattaaatggcttggtacaaggcattttgggagatccctgatgaactctcatatttctctcctattgattaaatgattgccaaaattctacagtcatggtgttatatcttagtttaaggatttgctgctaattaaaatataagtacattattgaggagtaacactttgagattgtcactttgaggtacaatgggaggcttctatggtcacattgttacttgaaggggttcaattgacctacatttttcttcattcctgagcatcagtcttacctttataagtgcttggaaaggcaaatatagttcaatttaaattgtatgtattcagctattttaactcatagaaataaaaattgcatatggtgctacttattttttataaagtaagggaatatgtgatattctgttacttacctaaatcagtgagttaaaatgtttttataatgatgtcttatataatgtttgtttacaaattacatagagatattttttttttttttcccgagacagtgttttactcttgttgcccaggctggagagcaatggcatgatcttggttcaatgcaacctccgcctcctgggttcaagtgattcttctgcctcagcctctcaagtagctgggattacaggtgcccaccaccacgcctggttactttttgtatttttagtagagatgggatttcaccatgttggccaggctgatctcgaactcctgacctcaggtgatccacccgctttggcctcccaaagtgctgggattacaagcatgagccaccactcctggcctacatagagataattcttattttaatggtttactatacaacttacaacttatatacttttgcactttttaccatattccaaaattgtatcgaaaaatacatatttttcccctttttttttttttttttttttggagacagagtcttgctctgttgaccaggctggagtgcagtggtgcgatctcggctcactgcaacctccacctcccaggttcaagcaattctcccacctcagcctcctaagaagctgggactacaggcgcatgccaccacggccagctaatttttgtatttttagtagagatggggtttcaccatgttggccaggctggtctcaaactcctaacctcaagtgatctgcccgcctcagcctctcaaaagtgctgggattacaggtgtaagctactgtgcgtagctctatttctgtataatatagaacactcagctcagtgtaagtcacccaggtttctagtgggatagaacatcactcaactcattttgacagataaaaaaaaagtctgatagatattttccctttatacccaacaaattattgatttctgctatttgcatataaaaggataaatttaagttaatctttttttaactacctgaatgtatatgaaacaatttaaaagaatgttatctctacttatagatctcgatttattaatgatgcataccaggaagtactggatctactcctgccattaaatcttgaggttgtggttgaacgaaatttatgctgggagtggtaccaggaagttccttgttttaatgtaaatgctcagctgaaaccaatggaggtaactttttttggatacttatcaatttttgttttgcttgttgaaaaatactgcttggggacataaggcatcatttgagtggaatttgtatatacataatcaccttggtcagaattgaaatagtgattatattaaactagaattcattttaaaatggtcttgatttattcttttaacaaatattactggagataaagtggcaaggaagcaatgacattgtctctgacttcatggaacttgccagtctaatgcaggggttggtggtgatggtgatctggaaggtatagtagtagttagatagtaaaaaagtaatcagacacataattaaaatagttataaattgtggtaaatttaatgaagtgaaggggtggcctgcacctccacacctgtgggtatttctagtcgggtgggatgagagactgagaaaagaaataagacacagagacaaagtatagagaaacaacagtggacccaggggaccagcactcagcacaccaaggacctgcactggcaccggcctctgagttccgtcagtttttattgattattattttcattatttcagcaaaaaggaatgtagtaggaaagcagggtggtaataaggagaaggtcagcaaaaaacgtgtgagcaaaagaatctatgtcataattaagttcaagggaaggtaccatgagtggacgtgcacgtaagccagatttatgtttctctccacccaaacatctcagtggagtaaagaataacaaagcagcattactgcaaacatgtctcgcctcccaccatagggcggtttttctcctatctcagaattgaacaaatgtacaattgggttttataccgagacattcagttaccaggggcaggcaggagacagtggccttcctctatctcaactgcaagaggctttcctcttttactaatccacctcagcacagaccctttacgagtgtcggactgggggacggtcaggtctttctcatcccacgaggccatatttcagactatcatatggggagaaaccttggacaatacccggctttcaagggcagaggtccctgcggctttccacagtgcattgtgccccaggtttattgagactagagaatggcaatgacttttaccaagtatactgcttgtaaacattttgttaacaaggcacgtcctgcacagccctagatcccttaaaccttgatttcatacaacacatgtttttgtgagctccaggttgggtcaaagtggctgggtcaaagtggctggggcaaagctacaaattaacaacatctctgcaaagtaattgtttaaagtacaggtctttttcaaaatggagtctcttatgtcttccctttctacataggcacagtaacagtctgatctctctttcttttccctacaatgaaggacacaaataataggcatggtgctgtagtcaattagatatattaatatagaatttattggaaagatctaggttagaaatactaattttggtgtcaccagcatatagatggcatttaaagccatggaaatatatgaaataatctatacaaaggaagagaaagtattagaagaattcataagttgaaaatgaaaatggcaaatgtgtcaccaccttagttttactttcttattggttgacattgcttcaaagatctctcatggaactgcccacaagttcatatttttttcccttgactggatgaaagtcaaaagtgtgtcataggctttgctgaagtgatagcaacatatgctctgggaggtttctttaagaaacctacttaacaaatccttctccccacctcacagtttccctttctatttctttctgtaaaaattttattgattatgagaaaaccatcattttagagatttcagactttttttcttttttttttttttgagatggagtctcgctctgttgcccaggctggagtgcagtggtgcaatctcagctcactgcaagctccgcctctggggttcacgccattctcctgcctcagcctcccgaatagctgggactacaggcatccgccaccgcgcccggctaattttttgtgtttgtagtagagacgggatttcaccgtgttagccaggatggtcttgatctcctgacctcgtgatccaccccccttggcctcccaaagtgctgggattacaggcgtgagccatcacgcctggccgagatttcagacttttaagtcaaacgtatattcagagcataaaacatgatggcattatgaaaatcttagtgtgtaagataataatggctgctttaacttacagggtaggagatggaagttatctttttaagataaatatttgaagtctatttatattggtaagataacagatagaaactcataaaacatatagaaacttataaaacataaatattatgttccacccaacatgctggggcagttgctatcccactgggcccagttattaggcatatttgtgtggggcagcaaagacactgctttctcatgctcttcccaggtagaatccatacagaatgtcctggtgatgctgccaacaatctgcaagtgcccagctgccttttgaggccaaccctctagggtaaagttggggcttcccttactctaattcacctgagtagttggttagctgctgttgcagctcaccccagagcccagatatttgttctctcctgggcctcatcttctgtgccagggagaggctagaattggttgtgaaatcatttagtctaatgcatccagaccaagtggagcagcttgtgatttctgacttgtcagattttcagtggttgcatacacagcctgtcctgacatgtagatactgcagatcagcagccccaggatccttacagttctttgaacttcctccactgagctcctggcaaaagtgaaggaagagtgccaattaataatcagtatttgaggtgcatgcgatagacagatactaactggaagacatggtttagaagttgtaatatttattttcatcttattatatgaactctttttgcagtgtctgctacatagttacaaactaagtgtcatgaataaagaatgaaggaatgaaagcttaaaaaaaaccccaaacattagtagtatgtataaggtacacatggacttaattttaaaacactaaattagtgtgtcatctttgaaatgcagtcaaagaaagcttggttacaagtaaaacttgttaaatattgtgggattcaaattatctccttggggtcataacagctaaaaattctttttgttgttttgacaaacttagaagtgagccaaactcaaagatcttttttacattatttctgttgtgttagggttctccagagagagagagagagagtgtgtgtgtgtttgtgtgtgtgtgtgtgtgtgtgtgtgtgtgtgtgtaaagagagggaaaagggagagacttattttaaggaattggtgtacatgattgcggatgccaccaagttcaaagtcagtctacagggtaggccagcaggaaggatatccagggaagaggtagtgttggagctcgagtctgaaggcagtctgctggcagaattcttgcttagaggaggtcagtctttttttattgaaggcctccaacttcaatacaaagcaattggatgaggtccacctacattatggagtgtaatctgatttacctagagtctagagatttaaatattaatttcatctaaaaaatattttcacggaaacattttatgtttgaccacatacctaggtactgtgactgagccaaagtgacatacaaaattaaccatcacagctattaaggcaggtcttatgctgttgatttgggactaaatttgtaacagctaggatttgaaattggctctttattttttttttttttttttgagacagagtctctgttgcccaggctggagggcagtggcgcgatctcggctcactgcactctctgcttcccaggttcaaacaattctcctgcttcagccacctgagtagctgggattacaggtgtgcactatgcctggctaatttttgtattttcggtagagtcggggtttcaccgtgttggctgggctgttctcttaactcctggcctcaagtgatctgcctgcctcagcctcccagagtgctgggcttacaggcgtgacccatcacacctggcctgaaattattagctctttgagttagttcctagtttatgtgtggacctaagcatattaaccatttagcttcagtgtcttataaatataaatatcaggattgcattagctgggcatgttggtacatgattgtaatcccagtttcttgggaggctgaggtcagaggttgagcccaggagtttgaggctgcagtgagctaggattgcaccactgcatgccagcctgggtgacagaatgagacccattcactaactacctaactaaataaatacatttcaggatcatattccatagacctaggactttttcgaggttcaaataaaatagttcatgtaaaacacattgtgaactctaaaatttttggtaaaccaaatgtatcattttttattctacatttgtaaaatgaggtgcttactaaccaaaaaaatccaaagtagacagataactactgaaagttcattttaaaggtttaaaattactatattatttggtacattaataacaaatagttctttattcataacttcattggtattaacacctaatttagttctatatttcacaagctactaaagagcacatggtcatttagaaaactgaatattcagtttgtaaaaatgtttaattggtgtggtagaggattgaaacagtctttcatttttctcctctgagaattttaactgcagttaaattctgcaatgaagtagcagtgctaaaaagaacaaatcttttttttttaacagttcattcttagtcaagaagatataacaactatttttaaaacattgcatggcaatatatggtatgaaaaagatggtagtgcctcacctgctgtaacaaaagaccaatacagtgccactagtggagttactactaatgcttcacaccattcaggaggtatgtttttaacttcaaatttctttctgctttcctctttctctcttttttcttctatcttcttccctccccttccttctgtcttttccctccttcctcccctctttctccctcctttccttctttctttccttctttttgtttagtttgggcaaaataagatttgtaaatctgtttctaatcagctaattccattcagacatctctaaattgtctatgttattagtcgttgtgttgattttttttctttgaatgaaagttcctagttctgttgtaacaaaattcctcagtatatattcatgttttcctgacttccctgtagctcctcattttccatttttctccctttcccccatcttctccctatccctagtgtggcatatatcccaaatgaatcttttatattgatattaggaatatcaaagtattagaggtgcaaagagaggatgatcattagtagatggtggagtttaacaaatatttgggagatggatggaacagagtagaaggaagcagaacttagaaagagccttcatctaatgttggatccagtgtgctctgtggaatgtggctggtttctgagctcagcaccagcgcatacagagggtcagttagtgctgggatgacattgctgcataagcataaagttctcattctggcattataggggatcctcagacctacctacctcaaaatgaaacctactagttcacaagactcacctttgcaaagccctgaggtgttacacagcatttttactcagggagaatcctaacagaaaaccagctttacatttacagcattgtaggaaaccccacccttactagctggaataatcaaactagtcctttattgttaaatatgaatggtcagatatgaagaaaattgtaaaaaccccaagcatgaatgaaattaagataaatagaatcatgttttctgaaggaaacagacaattgaggtgacagaaaaggaagtagacaaacaaaaaagaagctctgacattctaagaggattttgagaagataatataagaaatggatcccaccaccaccagctcacccaaggataggagagttgctggaaatccaaatattattgctgaaaatttgaaacaaaaacactgaacatgtaattagaagtattgagttggaatatttggttgaggcaatctcccaggacggagaataaaaaagcacagggatggaaaatgtgataaaacttaagagtgatgttttagttcagaaggtccaattccagaatgagtgttacagaagaaataattgaggaaatggaaggcaattctttaaagaagtatagtactctccttttatctgcagggaatatgttccaagacccgtcgatgcctgaaactttgggtattaccaaacctatgtttggatagtacccaaactatattttttcctatacatacatatgtatcataaagatgaatttataaattaggcacagtaagagttgaacaactaataaaatagaacaattataacaatatactgtcataaaagttacgtgaatgtggtctgtctctccaagtatcttaatattttcagacaccagttgacctgaccacaggtaattgaaagtgcaggtaagggtgagctgctgtaaactgtccagacctaagtaaatattgaaggaagctcttagctataatgaatctactgagtttccagcagattgggtaaactaagattccacatacaaacacattttcatgagatgtcagaatggtaaagctaagattttctgaagtttcagaaaaaaaaaaggctgcctgtcagggacttagaaaaaaaatgattgcatgattgatttttgttgttttttatttatcatcaataaaacatgatgaaatagaatccctggatggtagaagacaatggaggaatctattcagaattctaaggaaagtggtttttgaagctcagattctatacacagccaagccatcacccaaaatgtgaaaagaaaataattctcagatttcctgtgactcagttttcttagacttcttcatacccattcgtaaaagaaattagtttgaaagtgtatttcagaaagtcaggaaatctaggaaacagaaaaatatggggttaaaaaaacctaggcctactcaggagtgcactgaaaaggaatctccaaattatctatgtgaataggctagaaattaactggctttcattaaaaagtaaatgagaatgctttaaggaaagaaaaaaaaagccatatggaagaatgtcttatagaagaaaaatagcatgaattccacatagtatgtaggatacagagttagctatattatataactgatacagacaggaaagtgttttctgcgcttaagaaagaaatttctataccatggtgcagaagtgaagtggactaaattttgcataattttgagccattgttagaatgtgagaagagaacctcttatttttcagagatgcactcatcgtgacagtgtagcagcagaggcagtattactgtaaatctcattgaaaaatactacatggtcatagttaaacaacacatggaatacttcttatgtaaataaaaaagtaaatgttatgaactatgataacttagaagtaaagacattactaaccaaagctgtaaagaggaagatggatcaggggaaacaaatagtaaagccttaaagagtgagagaaaatgtctgcaattgatgtaacaagaaatagatgtttgaatatgtcattttaatcgttttcttctggaaatttttacacatataccaaagtagaaggaataaggtaatgaacccacatgtactcatcacccactttcactaattttttttttttttgagacagagtctcgctatgtcacccaggctggagtgtagtggtgcaatctcggctactgcaagctctgcctcccgggttcacgccattctcctgcctcagcctcctgagtagctgggactacaggtgcccaccaccacacccagctacttttttgtatttttagtagagatggggtttcactgtgttacccaggatggtctcgatctcctgacctcgtgatccccctgcctcggtctcccaaagtgctgggattacaggcgtgagccaccatgcctggcccactttcactaattaatatcatatggctactttgttactgcccacactctgctcttcccccttcttcctccagcccataagattattttaaagcaaatcccagatactataccattaattgctatttttccataagcaataaggacattactttttaaatatagtaacatcatcaccctaaatattagcagtgcttccttaagaccatgaaaatatccagttagggttcatctttctcctaaatgtctcattacaaggcctggttttttttaaataatgataaaagtgtcaattcacaaagaagatgcaacaatcctaaatgtgtgtatacctaataacagaactttaaaatatatgcagcaaaattgacagaactaaagaagaaaatacacatatacagaatcatagttggggatttgaacacaccactcttggtaaatgataagatatgaacaaaaaaatcggaaagaatatagaagatttgaacacagtcaacaaaattgacataattaatgtaatacaatgttacactcagttgcagaatacctttttgtttttaaacacttcctggaatgtttacaaagatgcaccattttgtggaccattaaattttctgaccacattggattaaattagaaggtagtaacaataggatgtgaaaaagcttgaacaatttctaaataacccatagatcaaaaagaaatgacaagggaaattaagaagttgtttgaactgaatgatcatgaaaataaaatatatcagaatttgtggaatgcaactaaaacagtggtgaaagaaatttgtaactgtagagtaagatattagaaatgaataagttttaaaatcaaagattaaatcttctaccaccagaaactagaaaaagaataggaaattaaacccaaagtaaatgaaaagaagacagtaataaaaataatagaatccaacaaaagaaaaacagagaaaatgtttaaatgtatattttttcaaaattttagatttctgttcattaaagatacagtaacaagataggagaaacccaagcctcagacttgatgtatgtatcttttatccagagtacattagcacttttataaattaatagcaactttttaaaagcaaaataatgaccaaaagatttggatacttgagagaggatgctatgtaaatgggcagtgaacacatgaaaacttgttcatataattttttttttttttcttttttgagatggagtctcgctttgtcacccaggctggagtgcagtggtgtggtctcagctcactgcaagctccgcctcccgggttcacaccattctcctgcctcagcctcccaagtagctgggattacaggtgcccgccaccatgcctggctaattttttgtacttttagtagagacgggttagccaggatggtctcgatcgcctgacctcgtgatccgcctgccttggcctcccaaagtgctgggattacaggtgtgagccaccatgcccagccgttcatataattatttatcaggaaaacttcacagttcaccagatgagataagttgtagaagactgacaacatcaaaggttgacaagaatgtggaacagctgcaattctcacatacgactgataggaatgtgaaatagtattaccactttggcaaagaatttgaaagttaatatgtacctacctttaacagagcaattccagacctaggtatctactcccaccccaccccaaaataagtgcatatatacacaaaatgactcatttaggaatacgtatagcagacttatttatagtagcccaaatctggaaacaactcaaatgttcatcaataggaggataaactatttcattccatagagtgcatgactagctataagagtgaactacttgtacatgcagcaacatggttgaatctcagaaacattattttgactgaaagaagccacacacaaaatagtacaatctgtattactccatttatatggaatttaaaaaatatacaaaattcgtctatgatgattgaaattagaatggtagagaggttgggaattggctagcaagtgttaagagggaactttctggagggatataagtgttcagtatcttaattgaagtagtgactatgtggaaatatacacttatcaaatttcatcaaatagttcatataagatacatgtatttcattgtatgtaaatttttatcacaattgaaaatacattacctggcataatggtacttttctctgaagttagatataatgagaattagaaagtgctgcgttttcattttaagctcatttaatatgtgcatataatgccttgattcaaaattcaaatgtagaaaacaaattttgaattcttctgattagtagaaaaattttaaaaatgtctcttggttttagttttttaaagtaaaatttgaatactgaattatgtgccagttactgtaatatgcattttacatgtgctattttacttaatctccaaacatactcagtgattagttctatttttccttggaacagaacagaagtaggaacagaagcatcaagaggaaatagaaacaccaagtgttcaattaatattcccaaattattatggaaagagtcctaagccagaagttactgagttttacatctgaattttctaatattttattttcttgaatgtcattttactatacctgtttaataattctattaaatctatttcaagggtattttaatgagctacttttcatgatattttcttttattaaataactttaattttttcaaggagcaactgtggtgacagctgctgtggtagaagtacattcacgtgccttactagttaagacaacactaaacataagcttcaaaactgatgatctcaccatggtgctgtatagtccaggtcctaaacaggtaagtccaggaagaaaagaaaatgtattttcacatgtgaaatttgcataggttgatgtttttaaagtaacaaatgttaatatttaacatttattttgtagtatctgtccctctgagaaaaatgatctttttactttaataataattataactatttcccttttaaatgagttatctatcatatagctaatgtgaaaaataaattgtaaaattaaagtgatatgtatatatttttagcctttcattagagcccttcggagacagaattttgatgtttgttataagcagaggcaataatttgtagtagttcatatcatgaaatacactttagacttgtgtttctttgtaattttgtgttggtttctcctttcataggcttcctttacagatgttcgtgatccttctctgaaacttgctgaatttaaattggagaatattataagtactttaaaaatgtatacagatggctcaacattttcttccttctcattaaaaaactgtattttagatgataaaagacctcatgtcaagaaagcaactcctcggtatgtattgtaatgatgttctaaggttttacttgagaaatcgttgatatattttacagaattcatctccagaattgcacgttcattttctgagtgcatcctaggttctttaaagcttcaattcagtcagctcgtagtactcggttaacatttaaaatgtcctggttctgttatgtactattcttactggataattgatagattggttgagtaactagaaataatcagtgcaattaaattggtttttacattctttaaattacattctctaatataaatctaatataagttattgttaatccatgctaattgcaatgggaagtacataaaaaattgaaaagaaaaaatatcctgagattcaaactcttataatttattgaacatacacttcctcatttatgatacatttgtgttccagaagtttgtaagtttgttatttggaacactttatggatcttcccaagagacatgacttcagaatgcttttttttgtcagtaaaagagataagaggtctttgagttttactcatatgtttgattacttctaagttactcatacataggaattgttgttattgtgttttccagaatgataggactgacagttggttttgacaaaaaagacatgatggatataaagtacaggaaagtcagagatggttgtgtgactgatgcggtctttcaagaaatgtatatttgtgcaagcgtagaatttctgcagactgttgcaaatgtctttcttgaggcctacaccacaggcactgctgtagaaaccagtgtgcaaacatggactgctaaggaagaaggttagttattggctaaaatatttaatatttgttttattgaagtgctacaacaggacttaaccttgattagccttttagatcatcaaagtaaatgctttaagaaattaaaattttatttttcagagtagaaggaaaaccttaatgtgttttcttggaggatgtatagtttgcattttttaaaggtgtcagtatatattgcatttaaaaattatgaaacctatgttagaataagtaattgtacttctcttcaggcagtaatttgaaggaatttgtctagtggaaaaaaacaagcagagcaaataatgaaccaaccataccttttcacaattaagataatatttcaatttaaagcactcatttatttttgttgtatttattcctagcttttaacgtacggtttctctattatctttttataatatgtgatttactgtggtatagtagaaagagtatcaagttgagagttagaaactagattagtttctaggctttccaattaaatagtggagatttcccctcatttaaaaatgttcttatgcctatagcttcttcaagtctttactaagggttgtagttgattcctttgggatctaagattcttttgttttactttttactattatttcattttaatattttcttataaataataaattattcataatatatagcaaatattttaatctatttttatttgttttagtacctacacaggaatcagtgaagtgggaaattaatgttattattaaaaatcctgaaattgtgtttgtagctgacatgacaaaaaatgatgctcctgctttagtcattacaacacaatgtgaaatttgctataaaggtaaccttgaaaatagtacaatgactgctgccattaaagatctccaagtgagagcctgcccgtttcttccagtcaagagaaaaggcaaaatcactactgtgagttaactatttgatcatctgcttaattgtaactattttggatgtagtgtataccattttaggaaacaaaaactacctacatgctttccaaccttgctctgtaaaatgtctttctctctgcttagagagcttaatttagaatattatttaccagctttgaaactctttcattcttccagatgctgctcattattgttagtatttgtgggaatattgtcactaagaagttgggttcatcttgacagttttcagttaagatctactttgactttctaaccatgtcaattccaaattgctctttggacttttaagactttctgccagttgtttgctgtgttgtttcaattttattgtttcaacttttttctcccgtttggatgtttttgctcaaataatgagtttttccttgtctccatgtaacttcatttgaaccttcagccatttgctttgacatacttcacattgatattttactctctagtaacctcttggccttcctcctcttcataactctacttaaaattcattcctttacagacatcttttcaagttaactggctgacttccagcgaatacttacaaaaatatttgagcttctgaaggagtaatagaagcataagtttttgtttgtttctttgtatttttttcctgatgcttggtatgcatctatagaagcataaatgttctaaacattgtcaccatagaaatataagatgtaattttgatacaatgaatacatatatattaggatataagataaactgttgcccaaatttgcaagacagttggccctccactaagcaaagagagagaatagaaaatggagggtataccaattctctcttagtttttgacttagaagttttaaatatatatttcttctattcacatcttttttggcttgaatatagctgtatgaccacactttacttcagtaaaggttggagactgtggtatttttttctgagctaccttgtgctcagataaaacttctattactgtggaagaatagaacagatattaggttctagatgtcctttatatgggataattaaggagtgtattattaagtcactttttaaatagttgtttttattaacttgtttatttgacatacctattactaggaaagtctttaaatagaaatatttttatatttaaacattaatttagtggtattgatttttctctcataggttttgcagccctgtgacttgttttatcaaactactcagaaaggtacagatccacaagtgatcgatatgtcagtaaaatccctgacactaaaggtaaattaaaatataatcatttgaatatttagtgcacttaaaaaaagtagtaaagcctagaaagttattatagcaagtcttttaattgttatgcaaacaaaataggtgtgtttttgaaaatacgtttttatgagatatttacaaagtaatattatttaatacacattttatgaatgttattctatattttattatttacatttgtgtggttaacatctaatatccctaataaatattattgaaattactttatacttcatcagtttaataatatctgcaattcatgtatattaataatatcatgtaattcatggaataatatctgcaagattcatgtaaatatctgcaagattcatgtaaacacataacaagaattatggtaatttaaaaaattttataaacaataaattgtatcttctattttgtggtagtaatgttaattcagtatttaatttctcataatatatatttaatatttcttgacgtagtatgtttgaaagtgttttgtatagacttattaatttttttccatttaggtttcaccagttattataaatactatgattaccataacttcagcactgtatacaactaaggaaaccatcccagaagaaacggcttcttctactgcacatttatgggaaaagaaggatacaaagactttaaaaatgtggtttcttgaagaatcaaatgaaactgaaaaaatagctcccacaactgaattggtacccaaaggcgagatgataaaaatgaacattgattctatttttatagttcttgaggctggaattggtcatagaacagtacctatgcttctggcaaagtcacgtttttcaggggaaggcaaaaactggagttccctaataaatctgcactgtcagcttgagctagaagtaagcatatttttccagttttataacagataatgatacgtatggaatattatgacagataatgatacatatggaatattatggaatcttgtgtagctatttaagcttattgtaaatatgatattgggtcaaaaacttttagaaaaaagttttcaaattttgcccttgaataattgcttttatgtatacattccttttacttttaaagtacatgtccacattaagtttatatttcaactgattttatcaacttaaagataatatattattcgacagttgttgattagattcagaatattttttttaaagagttaaattgaggccaggcccagtggctcacctgtaatcccagcacgttgggaggccaaagcagaaggatcgcttgagcccaggagttcaagatcagcctgggcaacatggtgaaaccttgtctctactaaaaatacaaaaaattagccagtggtggtggctcacacctgtagtcttagttattcgagagactgaggtggacgatcacttgagaatacctgggaagtcgaggctgtggtgagctgagatcttaccactgcactccagcctggggttcaaagtgagacccagactcaaaaaaaaaaaaaagaaaagaaaagagttaaagttgaatacccttttttttttaaggatatagacagaatttctgaatatgtggataataatctcttctaatagaaatatgaagaattagaaatatatgccttatacttttatgtaatgtagaatcaaggaaagatgcttaaaaaggggttttatctggactaaattgtgaagagcgaatatgtactatgaagttagccaggtgaggaaaatgctgagggagtgcttataggaagctactgaatggcatgtagactggtttttatatagaagaaataacagggctaaaaaacatggtgggaaacaggatggaagatcatttttaatttaaaaaattctctctgtaggtgcattattataatgaaatgtttggtgtatgggagcctttgcttgaacccttagaaattgatcagactgaggattttagaccatggaatcttggtatcaaggtatatctatatatgtctatgtgtgtatatatatatatatgtattttaaaagactttatttttttaagaacagatttaggttcacagcaaaattgagaagaaggaacagagatttcccgtataccacctacttctgcacatgtatagcctccccctttattaacattccctcatcaacgtatatttgaagactgaaaaaattttccaaaattgagaatgtttataccacactcgacactttattttaatcacaacaaggttcaggttgtctcatcatgagccttgcccacatgcttccttgtttgccctctgaatataattttcaaatctaaggccaatgttgcctatgcttctaatacaattatgtaacaagtattatgttacttgttacataatttagaacaatttagaacataatttagaacacagtttagacattgttctaaatattttaatccttacaacaactcttggaggtagatacagtttttatttaacatgtgaagggactgagaccagggaggttaagagacttcttgaagtaataatagctacaaagtggaaaagatgggatgcaaatccagctgcagaggcgttaaatccactctaaaccactatgctataatgcctgtgtcatcatcttgtaggttgttgtctatcctgagtttccttcatcctttggatgtttgcatgtgtgcaggaatgtatattatttgtttgaaatatattgtggatttatataatcatgagaatcggggcctttaggtggatgaaattttgcttctgaagcaagagactgcagaattactcacgtgtttcctacctaataatgacttggtcaacctgcagacagattttcagtggcttaaagccagttaaagtaacaacagaggtgactagcttagcatgttgagctcttttcatattagatcacttaattttattttccagatattttagatgaaggatatgaaaaggaattccttggtggtttttaggttagaatacacatggtcagcagatctgtgactcctaaaaaatggtaaagggtattgattcttatgagctctaggtttataacactgttctgctactattgtctgcctttgtaagtctctaggtttctgttctttattattagcatgaccaatacattaagttacttttttctgtctgagtttttatgttgctttgaagtatgtgcttttatattcagatcccgggtacacatagtaattttaggtttttatttttccttctaaattgtgtctgccattttactatcactgatgatgacatgatttattttctctaatacttctgtcctttatgaccttagttggctgatgtccaagtaatttcaataaggcaatagaacttactgaaattagaaaagataaaatgtactgacctttctaatgttggtattgggatttgtctagttatgttgtgttcttagaatttttccttatatttctatgatttatcattttagatgaaaaagaaagcaaaaatggccattgttgagtcagatcctgaagaagaaaactacaaagtgccagaatataaaactgtcatcagtttccattcaaaagaccaattaaacattacattatccaaatgtggtcttgtaatgttaaacaatttagtcaaggtaagaaaagaaatttgaaactttaaatattgagatacttgtctgattgatctgtctgttgaataagaagtttaataacttagttgtcatttgtcctttactgttctccttgtcatttaattttacacatttcattttatttagcataactctttcttattaggcatttacagaagctgccactggatcttcagctgacttcgtaaaggatctagcaccatttatgattttaaattcccttggacttactatttctgtttcgccaagtgattcttttagtgtactcaacattcctatggcaaaatcatatgtattgaaaaatggagaaagtttaagtatggattatatccgaaccaaggacaatgatcatttcaatgcaatgaccagcctaagcagcaaactcttcttcattcttcttagtaagtagttgaaaaattaccttcctggggctattttgttttaaattacaatttacatgttattttactcttttgtagaatcttagcaaggttttttttgtttttgtttttgtttttttaaaatatcctttctaataggtcaagaactgttttttgtctttgcagtgtcttggttactattgttactaaaactttgtattccaaactctttctttatcctctgcattatttagagcatggcaatttactgctttgttgttgggaggaaaaatattagatctcgccctcattctgcttttatagaccgtggatgtttagatgtttgtgggggttcttttattcacatttggtatccgttgatagtattccaccagttttgcaactgaaagaattctaagtgtgaattcatgcagatggcaatttttaatggctttaggatttataaatggtttttttttttttatgttctgcctgttgagatgaaggttttttcctttgtcttttctgcttcccaaaagtttttcatttttattggaggtgaaatatatacattcttaaagtatcataatatgtagtcattgtgaagttaaatagtcccagagcctcacctacaccactttttgatactctggcatttaagtaattattgaggagggcatcatttaaaagattaattagacataggggggtaggctactaaaatagcttgtgtttctagttagaaaataacatgtaacaggtgtttcaggtgttgtcatagcgttgtaattaatgttcttataaattttacgtctttttttttaacatttttatggatgggatggtaaatgaaatttatgcaagtaagtaattttatccccaatacaacatgtgttttaggtaaatatatataaaattttatttaatcaagtccaagatataaaggaaaagtgacacaagttgttggaaaaattaaaaacaaaaattgtagtcaccttgatatttaccaatgtctaccaaaaggtattatgctctggttattctgacagcaaaccagagatcagtattcttgtattttatagtacttgctctcattactcatttttgaaacgtttgctattgttgtcttgggttaaactcctgaatgggagttttttaattaatgctgtggaaatatatgctggcttcttaaaatatcccttttatggactatatccaaagactctagtgactattatttataagtttaagaatcatctgaaatttctaatatgtaacatatgtaaaattaatatgtaatgaattataataaaaacttttaaacatacttacttaatttagcacctgttaaccattctactgctgataagattcctttaacaaaagtgggacgacgtctgtacactgtaagacacagagagtctggcgttgaaagatctattgtttgtcaaattgatacagtagaaggaagtaagaaggtcacaattcgctccccagtgcaggtatgaaatgatcaattttgggggatgtcctgttatgcatatctgtgtgctaataaaattaaaaacaacaacaacaaattattactgaaagaatataaaccgtaacagtaatacagctgatatcaaaaagaagactcactaccaccagttgcgctacttggttatgacgggtggtaggaatttgttcaatatacttcttataattttttaataggaatattttgtaaaatcttcttacggtattttttataaatagtcatcagtgttttgctttaggtctttgtaatgtatttatatcctttctatttgattagataatttttagagaaataaaaaaattttacagctttattgaggtatgtacaataaactgcatatatttaaagttgatgacttttgacacaaaaatgcacctttgaaactgtcatcacagtcacggtaatgaacatatttatttcttagaaaaattttctgtttccccactttcccattcccaggcatccactgatctgtcctcattgtacattagttatatggcctaggattttacataagtggaatacagtacagatggagtttgactttcattcagaaaaattttgtatgtatgtgtcaacttatgtgtatccatgttattacatgcagttacttgttgttgctcagtagtaatctattatatgtatatgccgcatagccattttgagtgaacctttgtatacagtgtgaagttaagaattgaggttttgctttttttttcaccatatggattttttttccagaggattttaggtccttctcatttttatataaatttgagaatcagattatcaattttataaaaaatctggataaaattggcttgtcctttaatttttaaattctgattactcattgatagtatttagaaatacaggttatattaacctctacttgcagatttaactagacttacatattctagtagatttgtgtagatttagatagttatgatagctgcaaatgaagacatttttactttttctttttcaatctggatgtgttttattttatcttgtttatattgcctatcacactggctagaatacaattcgagtagaagtggtgagagcatgtttttgccttgtccattctttcacctttaaacatgatttgtgttgttttgtagatgccttttcttaggttgtaaacgttcccttctattcctagtgtgctgagagtttttatcagagttgattttggattttgtcagatgctttttctgtacaagaggaggatatattttttaatttgttagtatgatgaattacattcactgattctttttaaatattagatcaaccttgcattcctaggattaatctcacataatcatgacgtcttactaaccttttagtatattgttggattttgcatttatattcatgagggatattggtctagagtttcaatgtctgtctttctgtctttcttttcttgaatcttgctctgtgtccaggctggagggcagtggtgccatcatggctcactggagccgcatctcctgggtttaagcaatcctcctatctcaacctcccgagcagcaaggactgtaggtgcacaccaccacacctattctcccatcttgctccgcctctcattgtttaactttttaactcattaaagcagcagtacccaacctttttgacaccagggacctgtttcatggaagacaatttttccacgggtggggggctggggcatatagtctcaggattcctttcttaggaatagaaagctccacccatgtgtgttcccatcccctgcagggacaccaagttaacaactatctacacagaaaaaacaccttcataagaaccaaaaatcaggcaagtactcacagtacctggatttaaccacagatcatcaggcattagttaaattctcataaggagcatgcaacctagatcccttgcatgcgcagttcacgctcctatgagaatctaatgctctggctgatctgacaggaggcagagctcaggtggtaatgctctcaagcctgctgcttgcttcctgccgtgcagcccacttcttaacaggccacagaccggtacagcccatggctcaagggctggggacccatgcattaaagtatatttaacgtggggtttctgtagccaccatgtagttagaccttgttttttttttttttttttaacataatctgaaaatctgtgccttttaacagggataattaaaccacttatatttaaagttgttgttgatatggttgggcttaaacttgctattttttttttctatttgtctcatttgttctttgcttccatcttccctttgttttctctttttttttattaattgagcatttttgttatggattcattttatttccttgttggcttattggctgtatctctttatacttccttgtctttttgttgttgttgttgatactttagggctttattacatacatattgtattagtctaccttcaagtagtattttgccccttcacatacagaatcaaaactttagaccagtatacttccacttctcatctcccacattcgtataattatgttcatacatttttgtgtctatgtatgctagccaccccataatacaagttactatttttcttaaatgaattatttatgttttaaataggtttaaaatacaaactgtatttgatatttattatcactttttcttctttcagtaatctcacagtgtggatctgctggtgatgaattctttcagttttttcacatatatgtattacagatattttcactgggcatagaaatctagattggcagggtttttccccccatactttaaaaatgttgttctgctgtctgctgtattgcattgtttctgatcagaagtctgctttttttcctatatttgcttttctacaaaatgtgtcaatcttttcttcagcagcttttgagattttttttctttatcattggttttgagcaatttggttatgatgaatcttactgtagttttttttatgttccttgtatttggggtttactgaccttaaaaatgtggatttatagttttgatcaactttagaaaactttttgccattgtttctaaaattttttctgtctttgccctctcttctctcctttaggtaccagttagatatacgttagggtgtttgaacttgccccacagctcagtaatgctctgttcatttttacttttagctttttcctcgtttcttttttcatagtttctcttgctgtgtcttcaatttcccttctctttttcagtggccaatctgctattgaccccatctgatatatttttctcaatagtagtctggatttttttgtttttttattttccattgtctctttttaacatccttagtcttctaactttttagtgatattggatataattttaataaatgttttaatgtccttgtctaccaattctattacatgtcatttctggtttgttttattgatgtttcttttcattatggtaattttttcattcctttaatgtacctgataattttttattggttacctaaaactactgtatatatcagaaccagacttcattcttcctgtttcttttagacggatctttactgagccttagataatctacacatgtcctgatcattactcagctgaagttttgacagggaggggacactcagttttccagaattctgtccgtacagctcttgcctctccatgcaggtctctcccctcaagtacaacatgctgtgaatttcagtcacgttggcttccccagattttcagatcttgtctcttcaacttggctgcctgctcctcacacagcagactagaaactcactctccagacagcaagctgggtagtcatagggcttatgtagtttttttgtttttgtttttcccttgtgccgcctcttgccccgtatcggaaactgtggtttgatgtttgttgtttttcttcctgctttttagttgattagggtgggaagctatatctggtccccgttattctagcatggctgaaaacagatatcccttctctttcactttttatttagttaactattttaaaaggtgactaacagctgcactcattactgctgattattttgccatttaaatagttgaacatgaattttgaatttcttacaggtactatgtgtagaaatatttctgttgcttcaaatgtatagagcaaatagtttttctagaattaaaaatatagtacagttaagattattcatttatgaaattcttagttctcatgttttatatgctgctatgaagtttttaaagtagattttggtaagatatagaaagattataagataattgttttactaaacaacttgttattatctattccaaagataaatatgagtatttggaggttttctgatattattattattattattatatattaatcagaataatacatttttgcctgaccattatttgctacttactggatgagataatcttcatacttttctctctaaagaaaattgcaacaattcagtcacctcttcaggctccaattctaattctagttctcttgctatatccaccatatctgcagtgacttgctccattgaagtcctgaattcctcaaagtcgtccatgagggttggaaccagctgttaattttgatattttgacctgttctcatgtatcacaaatgttattaatggcgtctagatgatgaatcctttccagaaggttttcaatttactttgcccagatccatcagaggaatcactatctatgggagctgttgccttaaaaaatgtatttcttaaataatgagactaatattatttaagtcaaatatacaatgttacatataatattaagaagttgaaattactccttgatcaatttgctacagaatagatgttgtgttagcaggcatgaaagcaacattaagctcctgtacatctccatcagaactccagtgacaatgtgcatggccaatgagcagtagcattttgaaaggattttttttccctgagaataggtctcagtagtgggctttaaaaattcagtgaaccatgctgtaaacagatgtgctttcaaagtcagtctttgtttttccatttatagagcacagagtagagttagcatattcttaaaggccctgggattttcataatggtaaaagaacattggctaacttcaggtcactagcttcattatccctttaagaagagattcagactgtccttcgaagctttgaagctaagcattgacttcccttctctagctatgagagtcctaaatgtcatcttcttgcaacagaaggctgttttgtctagtttggaaatctgttgtttagtgtagccatcttcatcaatgatcttagctagaccttctggataacttgctgcagccacttgccacttcatcttgcacttgtgtgttatgcaggtggtttcttcccttaaacctcgtgaacaaacgtctgcttccaactttttttctgcaacttgctcatgtctctcagccttcatacaattgaagagagttagggcctatcttaggagaatgttatagctggtttgatcttctatcctgtattaggccgttttcatactgctgtaaagaactgcccaggacttagtaatttataaaggaaagaggtttaattaactcatagtgcagcatggctggagagacctcaggaaacttacaatcatggcagaaggcaaatgggaagcaaggcactttcttcacaaggcagcaggaaggagaagtgaatgcaggaagaactaccacacacttacaagaccatcagatctcgtgagaactcattcaccatcacgagaacagcatgcaggaaactgtccccatgatccagttacctccacctggtttctcccttgacacatggggattgtggggattacaattcaagatgagatttgggtgggggacctagccaaactgtatcatatccagaccactagagtattcttcctgtcagcaataaggctgtttcactttcttatcatttgtgtgttcactgggttaggacttttaattttattcaaaaacttttcctttgcattcacaacttggctgtttgatgcaagaggcctaccttttagcctatctctggttttgacatgcacttcttaacattaatcatttctagcttttgcttttgatttaaaagtgacagacatgtgcctcttctttttatttgaaagaggccattggagggttattaattgtcctaatttcagtattgttgtgtttcagagaatagggaggtccgaagaagagggagaaagtggggagaatgtccaatttgtggagcagtgagaacacacacatttattgattataacacatatagttaaaatgaaaagattgaaatattgtgagagttaccaaaatatgacagtgaggcacttagtgagcacatgctgttagaaaaatggcaccaatagacttgcttgatgcagggttgccacaaacctttaatttgtaaaaaatgaaatatctgcaattcacaataaagcaaaacattataaaacaaggtatgtgtatatatgaatttactacttttgatagtcaggagaaatggtattattcaaaataaaatttgcccacagttacacagctagtaatcagcactgccagtatttatctcaggtttttttcagtttaacatctatgttcatcctgctatcatattgctgttgtgtagtcataaactttaggaattgttccagcaggatagcttaccagcttacctgcaacacgcttctgtttctttcttacctttgtagtttttgagacacagggtcttgctctatcgcccaggagtgcagtggcatgatcagtgctcactgcaaccttgacctcccaggctcaataatcctctcacctcagcctctgcagtagctcggactacatgtctgcaccaccatacctggctaatcttttaatattttgtagagacagggtctcactatattgcctaggctgctcttgaactcctgaggtcaagtgatcctcctgcatcagcctcccaaagtgctggaattataataggtgtgagccactgcgcccacccacttttatacagacggatgcttccttttcctctgctcccttagacttttcaagcttatgctcattccgttttccagacttttgatctttccttgaaatttcaactactagttattctcagcttccaaccaactttttccgcactaaatttgaaagggaaaacaaaggaagcaatatcagactttggtaactaacttcacattccaaacaggcaccatttagaagcatgtgtttcttaataggctccatttacatcagtgataagttgaatgtgaagtttatttggaattatatttataatcagaaaatatgttggaaaacttgcagttaatgtctgttgtggaatgctctggatgttggttattggtttgatagtggactttgaagtttattgtaatacagatgtctccatccacaccatggaatttaaaaaatatagacatttaaaaatgtttccctcaaattaaaaaaaaaaatacatgaagttgaagtcagctgttttgtttccctcttagtccacattccctccttccttcttccttgaggtaatatcaatttggtgatacgttgtgtatatttccagtaccatattttaaaaactattattcctgtccagaaaatatatacttgtgtttttagtgtcttacagaaatgttacactgttcaccttgttttgctatgttctgttttcattcagatattcgaagtgtaaccatatactgatatataggtcattattttaatgatgttacatgattatatggatttgaagaaaattttcttatttttctattattgagattgttttcattttcatttttttttataatgaaagtggtgtggtgaacatcagtgtcttgaatgaatgtagtgaacctgaatgaatacacatgtgtaaacatttctctaggtatggaactaggagcagaattcctaagaagaaagtacattttcatttttactaagtttttgctgaattattcttcaaagttattttatcaatttacattctaccagtagtgtatgtgagttcctgttcacatcattttcaactgttgatatcaccatacttctgattttttttgcagtttgttggtattaaaagatactccatgaatataatttgtattttcttgattactaggaatgtcaagtatcttttcatctgtttattggtcagtttttccattctgtgaatcatgtttacattctgttcctgttttcctcttgattgcaacttttttaatgatttttaggctttttgagtgtggtggttataaaccctttgtcaagtatattacagatatttcccagcctgtagattgtcacttttatcatataaatatttaaaattttgatttttttctgtgaatttttttctactatttttatctaaacaaaaacttatctttaaacaaattagtccctatcctaaaatcaaaaagatattatcttattcccctgtaggatgcttaaagtctgtttttgagattcctattatataaaactatagagatttttcttgtatgttttaggataaataatatgtttgtttcttttctaatttatataagcaagatgaatattgcctgatagttcctttgttaagatagttacatggacatattttttttacacatctttagattcttagattaatgatactaaatattatttgtttttctttcccagataagaaatcatttttcagtcccactgtctgtttacgaaggggataccttattgggaactgcctcacctgaaaatgaattcaacataccattaggatcttaccggtattttgtctttatcattttatttactctaaaatctcttgtagaatttttagtttctgatttcacatggataactttgatcaaatccatcctgctaatagcttatctaacgtatttaggtttcagtgcacttagatcttaaaaaagaagtattatttaatttattgtaataacttataccaagcacactatatatgcttttctcttaaatataattatattttgattgcaatataaccgtcataagcatagtcatatgattatgagttttaaaaatgtctaatagatcatgcctggtggtttctgaatttatatatactattatgaagtaatttgtacttctcaaaggttttataatacaatttttttgaaattcctttagtaaacaatattttatccttttcttttcatatttgttcattgttcagggttggagttgtaatataaatagaagtatatactatattaattttaaatttttaaagtaattaaatttgatacaatatgttttaagaaaatattaaaattataacaaaatatgagctagtcttatagattttatatcataacaagtaagtattagtcaagatatgtaatctggaattgaaaataatctcttatgtggaaattgaaccttattggagaataaaactgttctcagaattaagcattgtagtttgtttaaataccattttagaatacacactagaaataggtacttacctcaatgctacagaaggacagaggcaaaactgcaaacagtgcttacctgttctcttgtccagaagttcagaatgggatcctcaatgctccgaagacaatctagcagttttaggcacctattttcacatagatcgacctgctaaacctaaagagtgttttattgcttagttcagacttgctgagggaaagaattgtattgttgagagaacaacaaaatagtcatttacagtatctgaccttgctctagagaggatttggggtgggttacaagactagattaaatatggcatgtaagatatatttaaaaatttctgtgaagaactttcattttcttcttggataataaaagttaatgatattctactttttaatacatttctgctatatattttgtatctctgtccatagtagagaaaacagtacctttatactttttccaaggctgaatattaatttgttacatgatagttaatccatcttaatgagaattagtagtgattaattcatcttaatgagaattgttactgactaagtacttcatcttaagtagaattattagtgactaaccagcttggatttctcattaggcattttttttttttttttttttttgagatggagtttcgctcttgttgcccaggctggagtgcaatggcgggatctcagctcccaggttcaagcgagtctcctgcctcagcctcctaagtagctgggattacaggcatgtgccaccatgcgcagctaattttgtatttttagcagagacagggtttgtccattttggtcaggctggtctcgaactcataatctaggtattcttttaatctagtacttcagtataggtgcacttatatttaagatgtgaggttttaaattaacaaatggctatctttctctattctatttctattcttagattaatgatacagataaatatagatgcagataaacacaggaaaacaatttatattttattaaaatatttaagtagaatttaaatatactgattcttttattcatttaacaaatatttatcaaggttttctgtgggtgagacactcaataccaagatgaattgcatgtggctattgccatcaaaagatggatatattacataaatgtataaagtaggaaacagtgggttatagagagttatagaaagtgttagagttgccaaaaactgtggaaaacataaaagggattaatgactgactcctgggcaagatacatgaagtacggtaacatctgtaatatagtaatatggagattagaaggaaaaggctatctaagaggaaggcatgcatgaacaaagataaggaagcatgaaagcatagtgttaaaaggaatagttgggaatttgttggaatgtagagtgcatgttggaagataaaatttgaaagataagttcacagttagatggttgctccctcattttcttgctccatttttataaattttatctccatctattagtttgatctgtttttttcttcttgtctcagataatttgatgttctgtttcaagaccattcacactaccatatcttctcatttaaaacctcctgtcattgattatctttctttcctgttttccttattcattccttgaactttcctttgacgttttatatttctcttactcagattttctcttcagaacaccctttttgggaaaattgtcacttggcaaataccttgcagtctgtctagaaagagccaaccactctgccctcagtctactctaaacatatgttttttggtacctatcacaatgcagtagttatcttttaacattttaacatttcccacctgattatgatcttactcatttgtttgttttcaattttgccttcttgttggtacataataggtccaataaatgttttgataaactggataagtgtattacgattagtttaatttggaaaaaattaaggttttgtctttaagtattagaagtaagagtggaaaatagaatgaaaattatagaaggaatgtagaagtagaataggctatatctgttaactgttttgacaaataatttatatgcttcagtcaggtaagaaggaagtctaattgtttcacagtccagggtgccagtagctggaagtcactgaaaaaggacatgcagaaaagtgggtagagtgggttcagtgttcagtctagcaaatttaaggtgccatcagaaattactacagaaatacatcatagatatttgacattttaggagtagagcttaggaaaataatcagggttgaagatagttttgaccattgttcatctataaaggacagtgttgtctcataactatagctaattagttttacaaatataaaaatatttatgaaatgtttattcttggctacagtgtgggttcaaaaattaagtataaaatattgctgaaatgtaaacaatgtaatattcaaatataaagattaaccatgtgacaaccaataattttgtcaccattttcttaaaactactcttctgcaatggcaaaaaaatccaaaattgacaaatgggatctaattaaactaaagagcttctgcacagcaaaagaaactatcatcagagggaacaggtaacctgcagaatggggagaaatttttgcagtctatccatctgacaaaggactaatatccagaatctacaaagaactgaaaaaaatttacaagaaaaaaacaacccatcaaaaagtaggtgaaggatatgaatagacacttctcaaaagaagacatttatgtggccaacaaatgtatgaaaaaaagctcatcattactggtcattagagaaatgcaaatcaaaacaacaacaagataccatctcacgccagttagaatggcaatcgttaaaaagtcaggacacaacagatgttggagaggatgtggagaaataggaatgcttttacacttttggtggtagtgtaaattagttcaagcattgtggaagacaatgtggtgattcctcaaggatctagaaccagaaataccatttgacccagcaatcccattactgggtatatacccaaagaactataataaatcattgtactataaagacagatacacacatatgtttattgcagcactgttcacaatagcaaagacttggaaccaacccaaatgcccatcaatgatagactggataaaggaaatgtggcacgtatacagcatgaaatactacgcagccatagaaaagaatgagttcatgtcctttgcagggacatgggtgaagctggaaaccattctcagcaaactagcacaggaacaaaaaaccaaacaccgcatgttctcactcataagtgggagttgaacaaggagaacacatggacacagggaggggaacatcactccctggggcctgttgtggggtgaggcgctaggggagggagagcattaggagaaatacctaatgtagatgatcgattgatggctgcagcaaaccactatggcatgtgtatacctctgtaacaaacctgcactttctgcatatgtatcccagaacctaaagtataattaaaacaaaaacactaaagcagaaaaaaaaataataaagtaaaatatcatactgatgtttaaaaaaaaacagcactgttccgcatctattgactacgttttaataacattaaatattgattgaaaactttcatttgattaatgttggaaagcttgcgattattttttcaatagtaattttttttagtttatgaattcagtcatggcatttatttccttttaggcccatgtatccagaaaagccaaattctttcagttatatatgcaagtcacagatgattctatgtggttttctttgcatatataactgatacgattcatgtatttttatatgaaaccatttataagtgtacttttaagatagtaagtttgtaagaaaaatattctcctcttaaaagtcaaacaacttgatgagcttccagaaagttaagatgatatctatttatctatcttttttttttttttttttttttgaggctctgtcgcccaggctggagtgcagtggcgcaatctcggctcactgtaagctctgcctcccgggttctctccattctcctgcctcagcctcctgagtagctgggactacaggcgcccatcaccatgcccggctaatttttttgtatttttagtagagacggggtttcaccgtcttagccaggatggtctcaatctcctgacctcgtgatacgcccgtctcggcctcccaaagtgctgggattacaggcatgagccaccgcgcctggccttatctatcttacttatatcgtaaaaagtatatgaaaatataaaaatgtactacaatattatgaaaggaggtaagtttgttattctaaagctgtaattatatagtttaatatgttttcctttaaaacattttaaactgtatcatttaatctcatgcagatcattcatttttctgaagccagaagatgagaactatcaaatgtgtgaaggaattgactttgaagagattataaaaaatgatggtgctcttctaaagaagaaatgtagatctaaaaacccttctaaggaatcatttctcattaatattgttccagaaaaagataatttaacatctctatcagtgtattcagaagatggttgggatttaccatacataatgcatttgtggccacctatcctgctccgaaatcttcttccttacaaaattgcttattatatagaggtatcggcaaactgatttagtgccttcctgtttttgattttgtagtttcagttttttaagattaagatcaataaaaactattttaaagatctaataaaaattagaatactagtaaagaataggtaatgcagatattcttttgcaacaagtatgagaattattattgaaataacatttaagaactagacttcagtgacaaaaaagcatgctacattatgttgtattcttttagtgctgattttcttaaaagattgtatactttgtgaagttgctttttttctttcatactctgtgtggtttcttcctgttgttataggaatccatacatcttaagattttatgtaaatatttcatttgcagtgcttatcaaatggaagaaagtagttcttcattgtcatctattataggtttattttacttttagaattaccatttgctttttaaaaaaatttttttgagactaggtttctctctgttgctcagactggagtgcaatgatgcgatcatagctcactgtagtctcaaacttctaggctcaagtgatccttccacctcagccccccgagtagctgggactacaggtgcatgccatgcctggataatattttttaatttttaattttgtagggacagggactcactatggcttgtcttgaactcttgggctcaagtgatcctcccgcttcggcctcccaaagtgctggaattacaggcatgagccagtacacccagccgtttacacttttctgatacatgtctcttttggaggaaaaagttaacatatttatggttttaaatgtgtatttccatattgaataacaaattatcatagtggttaagaatttgtactttgctgtcaggtagatttgaaattgcatcctagctctgtcatttgctagctgtatgttcttaagcaggctttattgcttttctaaatcttttgctgtggtctgtaaaatgagaataataataaaatttgcttggttaagacatgggggaaatcaaattagattgtgtatgtaaaggatttggtacagtgcctcccagacacagggttgccatttatttatcactctagcactaccaccaccattgttattttgtggaatattatttaacttgtaaagaatcaagaactccttacttttgctttaattaatttaaaatcatgagatgaagagattcctatattataataataggaaaagaataggatagagatgctggaaaaactggtgagatattcagatgtactgtcaatttatatttctgttctcatagaacttttaattggatgctgttagtgatcacattctgtctgccagtttccaaagggtgtgatcagtttttagaaagacaattgagccatggtgtggggaagggactagaggggacaagagcggttaggggactcttaaactgagacgtcatatagtgacatgaactaagataatagaagggagggtcgagggaaatgagcagtttggagagatacatatgacgtaataatataaacagtgattggaaatgggtgatgagggattgtggaggtagtagggattacttattttggattaccatcagtttttgcccacattttacgttgttttgtagttttcaaaataaaaatcacgagtggttaagattgtctttttgtcgttgttttaccaattatagtgttttatgtttataatttccaggggagtttcccattatgttatttaatcttcacagtttgtcctttgaagtaagtcatttagaccattttacaaatacagtagctcaaatctcagattaaataccgtgtagaggtttacacagttgacaaagttagaacttgaatgtaagtcttctgacttgttctgataggtatttcaaaagcattttttgcagcatttggaatacataaatagaattttgaggcatattattctgcaacattttaaattttgttttgttttttttttttttattacagggaattgaaaattcggtttttactctaagtgaaggacattcagcccagatttgtactgcacagttgggtaaagccaggctacatttaaaattacttgactatctcaatcacgattggaaaagtgaatatcacataaagcctaatcagcaagacattagttttgtcagttttacttgtgttacagaaatggaaaagactgatttagatattgctgtccatatgacttacaatactggtcagacagttgtggcatttcatagtccttattggatggtcaataaaactggccgcatgttacagtacaaagcagacggaattcatcgaaagcatccacctaattataaaaagccagttctcttttcttttcagccaaatcacttttttaataacaataaggtatgcgatgtttattctgtttttcccttgtctttagctacttgtcactttttagtttttaaagttctgagtaataaatattatgaaacttggatagaaataacttgttaaatatttgaggccaaaaagattagaatttaatattataaaggtttagtgcattaacaatataatattttgtttatgctaaaaagtaatttatcagtttaagcaggaatttttaaaggtacctaaattgtgatgtatttggaatatttttttcctaggttcaacttatggtaactgatagtgagttgtccaatcagttttcaattgatactgttggtagtcatggagctgttaaatgtaaaggcctgaaaatggactatcaagtgagttcattctatgcttatcaagaaacttttattttaaatgtttctattaactacttaattaaattttataaagatgttatacataacagtttttgagctgttaatttttttttcttaggttggtgtcactatagacctgagcagttttaacattactagaattgtgacatttacccctttttatatgattaaaaacaaaagcaaataccatatatcagtggctgaagaaggaaatgataaatggctctctcttgatttggagcaggtgggtagatgaatttcaaaaatatacctctttggattctattttctccttgaagttagatacctaaagtcaccatgtaatgttttaactctccccttactccaattttgttttagtttcatgaatctttattgaatatttgtgccctgctctagatagatgggaaggttcaatttttaataattaggtaactaggaatgcccagcttgttaagggaggtagacgtttaacaattactaaccactttggttaaataaagcagccaaagactagataagatgtaaatgcaccaaagagaaggaaattacttattctctctaggaagctattaggaatgctttcagagagtagggtaagccagactcttcttcaagttatttgaggagagtagtaacttagaagtgaaattttgattttgtgccatcattaaatctttgaataagagttttctgaatgactgacagaggttgatggaatattttatttttgaagaacttttattctaaaagttaggattagagaagtttttgctgtttctattcattattcctttttgcatacaaaaccgtccttgttgggattattcttgaagtatattctttagaatttcttttagagctggttttgaaggtaaataccatcagtgtctctagaaaaatctctctggcgggagggacaatgatcgggatataaacccaggcgttccagggggcaacggcaaccccctttaggtcccctcccatttatgggagctctgttttcactgtattaaatcttgcaattgcaaaaaagaaaaaaaagaaagaaaaatctctctggctgccttcagtcttctctttgtctttgatgttctgcagtcacactgctatatgtctatatgtggtttactttttatttacccttcttgaggtgctttacccctagatctgtggattaatgtatttcatgctttctgtaaaatttgctactattgtttctttaaatattgcctctcctccattcttccgtttttttccatctaagccgttaaatcagacatgttggacattcatactctatcctccatgtctcttaatagctcttttatattttccaactctctttgcttcattctgagtaagttctacatggacatctttcctttttttttttttttttttttttttttttgcttttgctgtgtctgaactactatttaagtcttcaactgagtatttgaataattatagttcttattcccagaaatttcaccttttttcaagtatattcattctttcaacaaatattgtttattttttatgtgacttgcaatataatagttaaagccacagtagttaaagcccatctttatgtagtttacgttttagtgggtataaggggaaacattaataataccgtaatcaattagtatatagtatgtttcaaagtgacaagtctaatgtgggaaagtctgatgtaggataagggacattgagagttcaagagccaggggtggtctctaattttatgtaaggtagttaggatgggactcattggagtgacatttgaacagtgccttcgaggaaatgagaaagttagcaattgtcgagagctcagctgaggaggagagagctgagctgccaggtgtcggaatagctgattaacacaaaccacaatgaaagtaacagtcaaacctttaatcacttactgtgatagtacagattgagcatccttaatctgaaaatacgaaatcaaaaatgctccaaaattcgaaatattccaaaatccagaacttttcaagtgccaccatgatgccacaagtgaaaaattctacacctgacactttatgtttttcactttcttaactgtcatttttttttttttactgttaagtacttatgtgtgaataagtgtaagaaaatgattgtttattggtaacacaaattgagagtcagaaatgatggtgatgccacacaaccacagattgtcaacatgggtggttgagatagtgacacattctctttctgatggtccaatatgtacaagttttgtttcatgcacaaaattatttaaatattgtataaaattacttttgggctatgtgtataaggtgtatgtgaaacataaatgaattttatgtttagagttagataccatccccaagatatctcatcatatatatgcaaatattccaaaatccaaaagaagtccagaatgtgaaacacttctggtaccaagcatctcgaataggggatactcaacctgtgtaagcaggaggctaaatcagagaaagcacaattaccacctgtgctggaatggcactggacaagggttaggtggatcagcacaaacatggggattgtctcaccgtctaggaaaccttgaacaaagtgtccggcagttttatggacctgggggatggagtaggacaaagcggaggagctaggaatggaaatatgctgagcactgagagtagacaaaaagtgtcttcactttttgtgaagtgactatacccttgttttaaactgatcatctgtgttccagttctcagctcaggcgctccctttcccccgataaagaggtcctgcaggagctctcaaggaaggcctctgccaaaaagctctcataaagagcttccgaatgaagtgcctgggctaggaatgcagacatggataaaagctttgggacagggttgcttgaatccttaagactgcagtgccctggctgtgcgcaaagtcaggttatattcctaagcatgtctcatatctagttccattaattccattttatggttgaataaaactgtctttaacaagctaagacacttagctctaacaaccaggttctgctacattgtcctcaagtcatgtgatgatgatcaggtatcacacatgagcagtctcactgaaatatatgaagggatcagtctggtcagggcctaagatggagttgacttaatagcttacagacaaggctggttcttcattctttttcttttagctctgtttccagattcttttgtccagtcttctctgtagtaccttgactatctcctattcttttagtttggtttccagatcactcacgttgaagttatttcgtacaattctgagcttctttcctactctgaactttgaatactacttttacttttttacccttatttgacaaccagatgctagatttaatacttgttttgcgtactttgatttctgcctaatttccagataatgttcatacctgattttgatttttagtaactgaatgtacacttgttttaagcctgatcatctgtgtcccagttctcagctcaggtttcttgctgatttttcaacccttctctgtaagatcatgaccacattaaagtctcttttctcgccagcagttcacttaccatagctcttcaatttgctatccactgcttcttgaatgcatagtgctgacaagtgacaatccatcttcaagttgaaagtttacagctgtttaaacaacccaataactagagcagtgttaaaacaggtttttttatagtttaagtctattctgatgggaatattaagatgatttatatatttatggtgaaatctgtttatttttataaacatatataatgtatattttagtgtatccccttttggcctgagtatgcttctagtaaacttcttattcaagtcgaaaggagtgaagatcctcccaaaaggatatattttaacaagcaggaaaattgtattctattgcgtctagataacgaggtaagtttttttttcttttttgcatgtgtcattaggaaagctaaaatatactgactagtattgtatttattttttgtatcaaataattacttctgttgatttttcccctttccccaaaaacgaacaaacatttctttttgtagaaggaaacagagatctaagataatttaattgttaaataaaaagttagttggggccgggtgcggtggctcacgcctgtaacaccagcactttgggaggccgaggcaggcggatcaggaggtcaggagattgagaccatcctggctaacacggtgaaaccctgtctctactaaagaaatagaaaaaattagccgggcgtggtggcgggtgcctgtagtcccagctactcgggaggctgaggcaggagaatggtgtgaacccgggaggtggagcttgcagtgagccgagatcgcgccactgcactccagcctaggcgacagagcaagactccgtctcaagaaaaaaaaaaaaaagttagttggaatgcctggaatactagaatataccacatctggaatgtcacctatctgtaatacagtgattgagattatagatttccagaaatgcagtacaaaattctgaattgttttctcagtcatcccaaaaattaaattatcaagttatgaatagtctgttcttaaatgttattagttaatattcttgggaaaatgattacattaaaatgttttctttttctttcttctagcttggaggtattatagcagaagtgaatttggccgagcattctacagttattacatttttagattatcatgatggagcagctacattcctcttaataaatcacacaaagaatgaacttgttcaatacaatcaaaggtaagattatcacaaatacagtaactcttgatggtgtaagtctagatgatgaggcacagttttttttgataatttcttaagagtataaacactgataatagcattgtagctgtgtaaaacagtgttccattaaaaaatgtacttgaagcatgtaggggtaaaactgacttgatgtctacaatttattttgaaatgcttcaaagaaagaaaaatggaagagctgaagcaagtgtggcaaaagcttgttcattgttgactctgatgaggagtctgtcagagtttgttaggagtctctgaattttgtctatttttgaattttttcatgtgtttaatatagtgtaaatatgtaaaatttcagatttttttttcaaacagtaggtaccctcttgttgagctgtcttggggaaaggactgcttccttaaaggctataattgaatcttcatggtttaggactactcttcaacattattcattttatttgctgttatatcttcttagtgccactacaggttatgcaagtttctgatcctctacttagtagttccaggctgtcttgaatttattttgtttcctttctttctttcttttcacctgttacttttcaacaagcacatatttatcattgcacttccactttccttccactgctaactgtacaacttctaatcattgattaaaatcaaacagacattgagtagggaccacagggctggactagcaagtacctaaaactcgtttggggtagcattctctcatctatttaagatgttaagaaagagggatgcctgttttttttaattatccatattataaaaataataagttgtttctaaacatgtgtgcaagtgtctttttaatataatgacttctcttcctttgagaagatacccagtactgggattgctggatcaaatgatagttctgcttttagttctttaaggaatctccatactgtttttcatagtgtttgtactagtttacattcccaccagcagtgtgaaagtgttcccttttcaccacatccatgttaacatctatttttttttaatttaaattatgatcatttttgcaggagtaaggtggtatctcattgtggttttaatttgcatttccctcataattagtgatgctgagcttctttttatatgtttcttggccacttgtatatcttcttttgagaattgtctattcatgtccttagcccacttttgatgggattattgtgtttttgtttttgttttcttgctgatttgtttgagatccttacagattctggatattagtcctttgtcggatgcatagtttgcaaatattttctcccattctgtgcgttgtctctttactctgctgattattccttttgctgtgcagtagctttttagtttaattaggtcccatctatttttattttgttgcatttgcttttgggttcttggtcatgaactctttgccaaagccagtgtctagaagagtttttccagtattatcttctagaatttttatggtttcaggttctacatttaagtctttgatcgatcttgagttgatttttgtataaggtgagagatgagaatccaattttattcttctacatgtggcttgcccacgatcccagtaccatttgaataggagatagtcaaagtaccagaaagaagactggacaaaagaatctggaaacaaaagagctaaaagaacaagagtgaagaaccagccttgtctgtaaaccattaagtcaactctatcttaggccctggccagactggtctcttcacatctagtcccttcactagaataaggtgtcctttccctacttcatgtttttgtttgttttgttgaagataattggctgtaagtatttggctttatttctggtttctctattctgttccattggtctgcatgcctatttttataccagtaccatgctgttttggtgactataggcattgtagtatactttgaagtaggataacgtgatgcccccaggtttgttctttttgcttagtattgctttggctatgagggctccttttatggttccatataaatttcaggattttttttctagttctgtgaagaatgttgatggtatttttatgggaattgcattgaatctgtagattgcttatggcagtatggtcattttcataatattgaatctaccatccatgagcatgagatgtgtttccatttgtttgttaaatttaaacttttaaataaatattcccttcttatgtaatctcccctgccattatcctagttcagtaaccctccatttcttatctatttgagtagatttttatgcgttgttttgttttatttgagtagatttttcttttttgttttgttttgagacagtgtctcaatctgttgcccaggctggagtgcagtggtgcgatccaggctcactgcagcctccaccttccaggctcaagtgattctcatgcctcagccttccaagtagctgggtttacaggcatgtgccaccatgcctaactacatttgagtagattttttatctatctctatatatctagtcttatctttagtaaatctcccattttccactagaatgagttttctaaaataagaaatataatcatatctctctagtttaaagtttttctttttttacccatttctttaaaaatatacttctaggctgcctttctaaacatttatctttccgtggcctaaatcttaccctatacaaagtgaagtttttttttttcctgaatgctctgggtctttccatgtgtttttacctgaataggtgtttctttcagctagaaaaatgccattctgtaattattaaaaaatcaagaaacaacagatgatggcaaggctgtggagaaataggaacgcttttacactgttgctggaagtgttaattagttcaaccattgtggaagacagtgtggtgattcctcaaagacctagaacccaaaataccatttgacccagcagtccccttcctgggtatgtactcaaaggaatagaaatcattctcttataaagatagatgcacacacatgttcaccgcagcactattcacaatagcaaagacatggaatcaacccaaatgcccatcaacgatagactggatgaagaaaatgtggtacatatacaccatggatactatgcagccgtaaaaaggaacgagatcattcctttgcaaggacatggatggagctagaagctattatcctcagcaacaagaacagaaaaccaaacaccgcatgtccctgcttataagtgggagctgaacaatgagaacacatggacacagggaggggaacaacgcacactggggcctgttgggggcatggtggcagggagaacatcaggataaatagctaatgcatgtggggcttaatacttaggtgtaggttggtaggtgcagcaaaccaccatggaatacatttacctatgtaacaaatctgcacgttctgcacgtgtattctggaacttaaatttaggaaaaaaaaaaagaaaaatgccattctatgtgatcccttcccttgccaccttaatctatgtaccccagtttttgatagcacctttacatatgtagattgcagcattcgtcacattgtgttactttcttgtgagtttgagacatgtacacacagatagtgaatagtctgaggactatggttagtttcccttttcttggaattttcattgcctgtcccaggtagtccagtacgtttttgcataaggaatactctgcaatgaattaaacagattaaaatttgtatgaattaagagcatttttaaatatttttaaaccaaatttatttgataatcaacacatttacatttgattttttttttcatggaaaaatgaagagtatgattttgttttctcctccacatttccttctcttggcttttaaaaaaatatggatgttatttcctgcatataaaagtaatagttgttaaattactgttttaaaaaatactacagaaaaaatgtgaaagaggaccataatccctgtaatccaaatactgtcaacattttggttcattgcttttcctttcctttcctccctcctttgttctctccctccctccctttcttccttccttatgtatctctcacatttgacagctattgtgagcatatcaatttgcttcaaagcacaatttttttttctttctaacttttattataggttcaggggttacatgtgcaggtttgttacatgggtaaattgcatgtcacggggttttggtatacagattgtttcattacccaggtaataagcatgatacccaataggtagtttttcgattctcaccctccttttactctccacccccaaataggttcccgatgtcagttgttccttctttgtgtccctgcaaagcatgatttttactgaatgcgtgatattctatcatttagatgctctacaattaaataaatacttaattgttcagaatttttatttcaacttttataattttagaatcagtttatcttctttttttgttgttgtttatttgttttttgagatggaattttgttgttttgcccaggctggagtgcagaggcgcgatctcagctcactgaaacctctgcctcccaggttcaagcgattctactgcctcagcctcctgaatagctgggattacaggtgcgcgccactatgcccggctaattttcatatttatagtagagacagggtttcaccatgttggccaggctggtctcaaactgctgacctcaggtgatccacctgcctcgacctccgaaagtgctgggattacaggcatgaaccaccgcgcccagcccagtttatcttctaataacgatcctcaacccatttgtaatcattgtaataactagtttataattccttaccatatttttttgtagtatattgtcttctaatgattttttggaaaatacatattctgtttcggttatggataattccttttttgttattgaaggtttcgatacatttaaaatcaattttaagattgaaacagtatctgctagcttacccataaaaaattgtaatgcttttttaccttttcttcaacctctttccaaattcttactttcttgtgaatataatttggtatgttttcaaacagattaatataaaatggttagcttttcaaaatatgtattatttcattcaaggcccttttggtatttgcattgattttaatgttttaacaaaaaaatgactttcttaaactggtttaattgttcactacaggttcctcaatatttctatatcctagttgttaaaatgttgttctgagttcatctctagcttggttggaaaaagtctgagttatttttttagtaaagatttgtggatagtgttatgctattgcttgttcgaaatgtcttattcttacaaatttatgacaatttgacataaaattttaagtgataacgtttttctcaaaattgtataggtattgtgccattgttttttgatattaaacatcattgaactgtgagagtaacatttttattttcttgcgagtgactatgattttcctagatatgtgttagggttttttcccccctattttcttacaaagatatgtctagaatgatactgttttcatttatgtctgatacccagtgaagtcttttaaatctgcagagttaattccttcttctactcagaagagctatattttattacttgtttggtttataacttttgtaatgtttttttctttctgagcatctttttgtgagtcaactgaatttcttagatgtgtatttcatgttttgtgattttaaagaataatttagttactttgtttttgctctagtaagaccaatacttaggaaagagttaccaattaaattatcttagaattggtataaatagggtaaaatagttggaataattttccataattaatttgtattaaaaaattgacaaaacagttttaaagacttgaagacctttatttcctaagtagaacatgtattttctaagtgggaaaataatgagaaatattcattagtgaacccttttttaattgtataaggtaagaatttcagccttgttttaatcagaacgatcacagatctcagtgaactaagaattaatgaagtattattttagtttttttttaatctcttcgtgtacttgcatttaatttaacgcgtatttttgctactgtgtcagttctctcagtgaaatagaagattccctccctcctggtaaagccgtgttttatacatgggctgatccggtgggctctagaaggctgaagtggagatgtagaaaaagccatggtgaagtaacacagaaggatgtaagtattgggttattatggtgttcccagcagccttttttaaaaaaggtatttgggccgggtgcggtggctcacgcctgtaatcccagcacttttgggaggctgaggtgggccatgagttggagatcagcctggccaataaggtgaaaccctgtctctcctaaaaatacaaaattcactttgggaggccaaggcaggcggatcaccaggtcaggagtttgtgaccagcctggccaatatggtgaaactccgtctctactaaaaatacaaaaattagcctcgcatggtggcgggtgcctgtagtcctagctactaaggaggctgaggcagaagaatcgcttgaacccgggaggcagcgattgcagtgagccaagatcacgccactgcactccagcctggcgacagagcaagactccgtctcaaaaaaaacaaacaaaaaacaacagtatttgattttcagccttcctagttttaaggactttttgtggccacacttctgaaaaactgccaaacgtcttcaaaatagtattcaagtatttacttaaccaaaaatgtttaaaaccaaaagtagtcttattttgtttacatcatttgcttctactgtgttataaagaataaagttgtgtttagagaagtgctttcagcattcacctgaaaaacaaatatgttctctgcattgacaatcatactaggtagatttagcttctgtaaggaacatttaaggatccactgagtgaactaaaacaaacttatttctgagtggcaagctatgatgataaagttatgcacatatattttctggtaacattttaaatactttcagaaaatttttaaaagtttttaatccttcaagattcatcttaatttgactcctgatgtttttttttcttaccactggtgattttttcttcctgcttatcagtaggtggtattttctcattgtctttcagtgctgctgttgaggagtctgctgtgggtattgtttacattgtatttaagaggattgcctataagtggcctttcagttttaaaaattcattactattagatttattcaggaaaaaaaattgtactttgatataaaaagtcttattcatttgatctgttgattagtactttgcatatttatatcatagtgatagtttgaagcttataaagataaatcagacattcactgtaaaatattagaaagacttcagtgaaataagttagtcttcttgattctcaatgtggttttagtgatatacatatatatacttagaaagtattacaagtaaggtaagtatccccagataattattttatggtaacaactcacagtttttaatttctgtatattgcaacgtgaaggtatactatatagtaaaattttctgaaaatcagaatattaactagaaattaatggctgaatattaattatgagaatttgctatgtttatcttgtcattgaccctcaaaaccctgatatcagcacatttatgtgagattcctgcagaaatagcctcatgatgaatatacatgctttgtagaacatacaattgagatacaagatattttttatcctgtttgattcagctatgaaaggaaatgtgaatttcaaactgaaacaacttttaatacatatcacattgctgtagtcttagaataaagcagaaaaaaatactttgtgttacagattagcctacgtgggaaggttcaattttattaaaatgtttaaattaaaaaagtaaacaattggcctgtctttatgagtaataattttataacagataacatcaaatgatttcaataatgtaaatttgcaagtattctacaaatattaattcatttagttgccactaaccccatgaagtaggtgccattaatagtctcattttataaatgtgaaatctaaatttcatgttctttgggaccaaattctaattttttggtttttttttttttttggtggttttattctaggatatgatgatgcctatagatttgggggaaaagacaatatatttagtttcattctttgaaggtttacaacgcattattttattcactgaagatccaagggtatttaaagtaacatatgaaagtgagaaagcagagttagcagagcaagaaattgcagtggcattacaagatgttggaatttctcttgtcaacaattacacgaagcaagaagtagcctatataggcattacaaggttagatgcattaaattttggatacatttaaatgatcagtttctaattgttaagaaattgttattgtaaaatctcaaatgatttagtttcagttttgtgctttgactattcattgatactgtggtagtgctagttttaaatgtgcttgagggaattttttgccttttgaaataaagatatggcagaaatcaaatttataaactccttattatgttaatccttccacttatctaaaaagttatatttattcaacttgccaaaagtatgttttgcatatcatacaaaatgcttagttcattttccattaccatctagcacagttcagggtacatatgctgtagctgttggaggattaacatagacaatcactttctaatttgaccttggcactttaagatctaataagatctaataaggtgatcactgtatttatcatttctcgtataagacatcaccattaaatcttttatctctcccttatgtccttattattcctattcataaacagttgttttaatttacatatattagtgcttaatgtgagaatatttcttctgtataaccaggataatgtaattttaatccttttcttgaattaaattcttgaatatatataaaggtatatgatacagatgtaaatttagttttctatgtacattaatctatacgtgtccctgacctcttattgaattgaatcaatgccattttaaaaggaatattaaaatctatattcttaagaatttttattctcaaaaaatgtttttactatttaaatagatcaaatacaccatagatttttaagacctttagacctattatatgttatcttctaagctaagtgatgttaatgcaaagatgaataatacatggtctctacctttctgtttcttaaatgaatataagttctataaggaataaacaaatagaatgctttaataaaattaaacaacttaaatatttaagtaacatatgaaagtaacatatgaaagtgagaaagcagagttagcagagcaagaaattgcagtggcgcactctatatcctagataactattttatacttgtctccccttaaacccccattgtgtcagcttactaccttgcattccacttcactgaaaaaattgaacccatcaaaagcaaacttccagagacccatctcaccccccaatatcacagcttgctatctaccagcgtttgcatactacttgctgtactgacatactctcaacagtttacagtagatatatgtgctcctgtttaaacagatttttctctacttttgcactgtacttcatttcctcttacctacttgaggacattgttccagcagtcctcttcttcatctctcctaagtcaacagcttttgggtctctactgaattgtttcagtgttacttctctcaacataaaaaattctcttgagcctactttccttgctacctgttgctcatttctttctttgcatttataaccaaacacctcaaatgtactgtctgtttcaaaggaacttaacatatcctgtgttctccaactatttttcatccattttctctttaaccactccaaacagggttttgctttcaacacaccatgaaactggttttgtcagcattaccagtgacctccataatgccatatccagtgtagaattatcggtctttacttaataacatttaacacagatccctccttgatgtagtttctttcacgtgacttccagaatacctcaccatcttggtttttcttcctatccagtctcattcattggttccttgtcttctctcaactgcttacattggctaaatgccttgaggctcttagacctggtccttttctcttgtggatttcagttttatgatttcaaatactgcccagaatttctctcttaggtatgtcttctgtcacacctgtcatctgaccttaagacttcatatatccaactgtgcatgcaaaatctctattcagatatctaagagacttcttaaacttcatatgtgtacactaaaccttttatttcctccttctaccaaaactccagctttccaatcagagttaataaaaaatagctccttctagttatgcagcccaaaaatattgaaattgtcttcgattcctctctttatcttacaccccagacctaattcatcaagaagatctgtgctggttctaccttcaaagtgcacatagatctgaccacttttctagtatctcactgttaatagcctcatcagggccatcaccatttttcaactggcttactgtagtacactaacaagttttcctgcttctaatcttgactccactcttttttctttccatccacttcaacacagagtgtattcttaacgaaatgtaagtcagattatgttgttagttgtcttataaccgatcagtggtatctcatctcactcagaataaaactcagagtctacagtggtctacaatgctttacattatttggccccccactataagtcttactttattttctattcctaatgtgttcctgacatgccagcctccttgctcttcttcatatactgcaagtgtgcctcctgctttagctggcctctctacctgaaatgttttcctcctcttgtctgctggataattctctcagctcatttaaggttgccaaaatctcactttctcaatgaatcccccattgaccactctaatattgaagaccccaccactttacatattgcagttctccggatcccccttgccttgtctacattttcttctttcaaaagcattttcacctcctacatattaaattttactaatttattttgtttactatttattttcactcccccactaaaatgaagctccagaatgacagagatgttcactgataacggctgtaacacctagaatagtgcctcagtagtagcttaataggtagtagttgaatgaattcatgtttttaaatttgtaatatgctcacttgtaattgaggctgttctgaaattttagtgaaggtattgtaattcatgtaataaaccagttaaaataaatgttaataacttagtattaaatactatgatttttgctttcttaaataagttctgatgtggtttgggaaacaaagcccaagaagaaggcaagatggaagccaatgagtgtaaagcacactgagaagttagagagagaatttaaggaatatactgaatcttctccttcagaagataaggttattcagttggacactaatgttccggtaatatttttaagtactgatgtgaagttttaattttttgcctgtcgtagtttggtgaatcactagtgaaatttaaggaaagtttggcttccttataaaacaaaataatcctgtcatacataccttgtataaaatgttttaaagaggtgtttatctatattaagaaatcaggctgggcgcagtggttcacacctgtaatcccagcactttgggaggctgaggcaggcggattacttgaggtcaggagttcgagaccagcctggccaacatggcaaaccctgtctctgctaaaaatacaaaaattagccaggcatggtggcaggcgcctgtaatccccgctattcaggaggctgaggcatgagaatgccttgaacccaggaggtggaggttgcagtgaaccaagatggccccactgcgctccagcctggctgacagcaagactctgtctcaaaaaaaaaaaaaaaaaaaaaaaaaagaaaagaaaactttcttttaagatactagatgctaatgatctgttctttgggttagcaggaaacttaaaaatgttttattttttcactgtactttctttaaatattttatttttcctttattcatttttattgtggtaaattttagtacatttatgtaaaaagtaatgcagtgaagctttgtaagaattatatgaatatgtgaattttatggacatgggatattaagatctaaatctaaactaatacaaatatgtagcttactgttttaaaaagtttttggcattaatttctaattctagtcatttatagataaattaattttttcatttggggggacatatttttcaggttcgcctaacccctactggtcataacatgaaaattctgcagccgcatgtaatagctctacgaagaaattatcttccagcattaaaagtggaatataacacatctgcacatcaatcatcatttagaattcagatttacagaatacaggtaagtctttctgaaaatataggcaaaattgtattctaaaggaatgcaataagaaaccagatctattcccatggtctgctttatctagtattcagtttcaatgttgtgctagcctttttttttttttttttttttgagacagagtctccctctgtcgcccaggctagagtgcagtggcggaatctcagctcactgcaaaccctgcctcccaggttcaagcgattctgctgcctcagcctcctgagtagctgggattacaggtgcccaccaccatggccacctaatttttgtatttttagtagagacggggtttcaccatgtgggccaggctggtctcaaactcctgaccccagatgatccacccgcctcggcctcccaaagtgctgggattacaggcgtgagccaccgtgcttggtcaccgctagactttttgattctttttgttcctcaaatcctgttattctggtcaggttgtataattgacatattaatatactgatgtgtttttattttcttagatccaaaatcagatacatggtgctgtatttccctttgtgttttatcctgttaaacctccaaagtcggtcaccatggattcaggtttgtttttatttttagatttccataaaagcagttgtattagctatttgatttactttactataaaaatatgaagtgaaaccattcttgggtttaatttttataggataattggaaaattaaactgcttgaaaaaggaccagcaagtactatacacaactaactttgataagattttgagtgaatcttgaagaaaagattgattagaaacatatattgaaatttttagaaatactaatttaaaaagcagataatctgtaaacctgcgatttaaaaacctttaaagcctttgaatgaacaataaggaagttcaaatctagagtgttttctaacagcagaaactgtcctatgttctccaaataagaataacggacaagtcctttctacccttttctttccctttgcctttcttgtttcctgcatatccctcttccccctactttctcttccctcctcactaccctacttaactttcttctccccttgctttcccacctccaccccacaccacttcttctaaactatcctggggggagtactctttataactcgctcagaagctttttggccagtataatgcgtaagcccttccacctagaggtctggagcaagtccccagaatctgttttcacaaagtttccctgatgattctaatgcatacttctaaactgctaattgtagaattagttatcttcagagtaactatagatagttttaaaaacaatgctagagtctgaaattaagattgtagtagattttgccaatatcagtaattttaactgatatttattatttagtaaatgatttaattttccattgtggtgtatattggaagaaaatgcctagcttttgcttaaagcatcatgggagtaattatatttataacctttacagcaccaaagccctttacagatgtcagtattgtcatgagatctgcaggacattcccagatatcacgtattaagtaagtgtcttaatacatttcttgtatatttatttaatgtttgatttaaatatatgaattgtttgtactctttaaatgttggacaagtcaaagatttaagcataaaatattaattataaacgtcaaataaaaaaatataatgttgtggctcacgcctgtaatgccagcactttgggagacctagacaggctgatcacttgaggtcgggagttcgagaccaacctggccaacacggtgaaaccccaactctactaaaaatacaaaaattagccaggcgtggtggcacgtgcccagagtcccaactactcaggaggctgaggcacgagaatcgcttgaacccaggaggcagagcttgcagttagctgagatcacaccactgcactccagcctgggtgacagagcaagactgtctcaaaaaaaaaaaaaaaaaggcggctctggatgaaatacatctaggtatttataatcattgtttctggattttggatattttattattctcttgtacttgtatttgttttttgtttggggttgtctataatcatatattgttttgaaaaaggaaaacaataatattttcgtcttcactcactacccattccaagaaacagaagatggactgaaacatctatgtaataatctcctgtctaatttcccttaccttgtcaccaagataacctatctttatttccttgctgtttaaaatatagttttattgttcatgtgtacctaaacattatgccttttagttttaatttttttctaatttttagaaaattgtttcaggccggaaatagatgttgggacttgcttttgttcattcaacatttttattaaaatttattcattttgttgtatgtagccatagtttattcattatcactaatatataatattctgttttatgactctgtatgacagtttacttatctggttcctctttatggccattttcatattttgactttgttgctgttattaacagtgttccatgattttttaaaatttagtcaactaaatagtcctaagtttcaaagttctaatattgatctcatacttttttctcatctaatttttgtaatacagttgttaattgatgatttttaaaaaatgttttctactttgtaatacaggtatttcaaagtattgattcaagaaatggatctcaggttagatcttgggtttatctatgctttaacagaccttatgacagaagctgaggtgactgaaaatacagaggtaagacttaaaataataacatttgatggaaaggattagggaaaagatattattataaatttttaaaggtattaaaatgactttgttgcattttaaaaatacaattaaataaattttattactctcttgtggtacatacctttttagaaatcttattttctgatgatagaaaattagcaaacaggaggaaaggcttggggtgaatagcagggagaaaaggataatttgtcatgttcacatcacttttttcctcttttattttcctggattactttggctttgctttcactttaataatttagaaatttagggtatgtccaggatatttaatgggagaaaggataggaaaattaaaaggtggtatcatctgggtgactggaagaccataaaatcatagttataaagtgggtcagatatagtctgtttttcacttgccctcatagattcatggatggagaaagagcaaattagtaacagtctattgaggtatagatcacataccatacatttcacccatttaaaagatagggttcaatgacttttaatgtattcacaaagttgtacaatcatcatcactctctaattccggaacattttcatcatccccaaaaggaactgcctgtgcagccactgatacactttgtgtctttaggtttgcctattctgaatatttcatacaaatagaatcatacactgtgtagtcttttgtgaagggcttctttgacttagaataatgctttcaaggtgcatctatgttgtagcatgtatcagtacttcattcctttttatggttaagtgatattccattatatggatgggccacattttgtttatccatatatctgttaatggacgtttgggttgtttacacattttggcttttatggataatgtaatgaatactggtgtacaagtttttattggacaaaaactttattaaaagtcttaaactatttaaacttaatcaccatgtgattaagcaattccaatcctaggtatatagccaaaagaaataaaattttattagaagtggaattgctcaatcacatagtaaccttatatttaatcatttgggactgttaggcagttgtgcaaagtgcctccaccattttacattcttaccagagcatatgagggctctgatttttccatattatccccaacacttgttactatctgtctttgattctagcaatcataatgggtgaatgtgaaatagtttgtcattgtggttttgacatgtaattacctgatgactaatgatgttgagcatctttgatatgttgattatcctttaatatgttaagtagttaatttgcatatcttatgtgaagaaatgtccattcagatcctttgcttattatttaatgagttatttgtcttttttcttataaaagttatttgcatattctcgatacaggtctcttatcagatacataattttcaaatattttctctcattctgtgtgttgctttttcactttcttgatgttgtctattgaaaatcaaaagttaaagttaatgaagttcaaattattttttattttgttgctcatgcttttggtgtcatttctaagaatccttagccaaatccaaggtcatgaatatcttacgttttacgaattttaaagatctagctcttatgattaggtctttgatcaatttttagttcatttttgtatatgatgtataaggatccaaattattctttggcatgttgctatccagttgtcctattaccatttctttaaaagactatttgttctttgaatggtcttgacaccctagttgaaaatcagttaacaacacacatgtgattttattccgtcgatctgtgcatctgcccttgtgcattgcacactgtcttagttattgttttgtattaagttttgaaattgggacatatgtatcttcctactttgtccttctttttcaagatgggtttggctgttctgagtcctttgaaatttcatatgaattttagaatcaacttgtcaggttcttcaaagaagtcagctggacatctgatagagactgcattgaatctgtaaatcaatttgggaagtattgccatcctaacagtattaggtctttcagtccttgcacatgacatgtttatccatttatgtagatttttaattttttttaacaatgttttgttgtttttcagagtgtaagttttacacatttttcattaaatttattcctatgtattatattcttcttatagtattatgaataaaattgattttttaattccatttttggattgttcattgctactgtataaaaatgcagttgatttttttatactgatcttgtattttgcacccctactgaattgttagctctatttgttgttccgtatattcttttgggatttctatacataagatcgtgtcatctgagaggagaggtagttttacttcattctttctgatctgaatgcctttgtttcttcttcttccctagttgttgtgtctagaaattggtgacacattaaacagaagtgccaagagcagacattcttcttttgcctctgatcttggagggtaaattttcagtctttgagtatgatattgaccctgggtttttcctagacatcctttttcaggttgaggaagttcttttcttagttggttgagtgtttttaatcatgattatatattttgtcattctttttctgcatctatggaaatgattgtacactttttgggttttgttctactgatatgttttattacattaatttttttttttttatttttttttttttttgagacctaggctcgctctgtctcccaggctggagtgcaatgctgcaaaagcaatctcagctcactacaacctccgcctcgtgggtttgtgcaattctcgtttttcagcctccctcccgagtagctgggattacaggcgtgtgccaaaatgcccagctaatttttgtaattttagtagagacagggtttcaccatgtttctgtgtttttttgttctgacctcaggaaaactcctatttgtcactttctctgattttctcctgcaaactattaggtctacaggttagccagtatcttctgtaaatcaatgactttccttttagttgtctttcaccacatctgctgtttctgagagcccttaggctcgaactgcactatatgttataagtgaaattagttcctttgggaagagattaatagttacctgttttaaaacctactttccccatcagcaaaaatccctaaaccaggcctctgaagctggcggtgggaacagttgtgacacccttctatttgagtaacaccccagtttaggagctgagcactatgtgtggtggggtaagaggggcagtggcctgagatgatctcagcttgcctttgctggcatggaaccaccacattacaggcctgggcaagagtgatcagaactctagtattctcagtggtactgtacccaaggcagagcttttttaccctgcacagaggctggacagagaaaggaagccctgccaagtacggtggctcacgcctgtaatcccagcactttgggaggccaaggtgggtagatcacttgaggtcaggagttcgagaccaccctggcaacatagtgaaaccccatctctactaaaaatacaaaaattagccaggcgtgttggcaggtgcctgtaatcccagctactcaggaggctgaggcaggagaattgcttgaacccaggaggcacaagttgcagtgagccgagatcgcgccactgcactccagcctaggtgaccagagcgagactccgtctcgaaaaaaacaaacaaacaaaaaaaaacccataaaggaagcccccgcctcacagttgcactcaaccataacttaacctcagcagcaggtagctgggaacaggatgagaaatgctgacgtcctgttcttcccaggaaggaagtcctccaattgaggactgggccaagaaggagctctgtgttcttgggtatactagtctagagtagaattctggctcattagtctgggagaggggacagagggaatggcctttgttaaaacaccacggattcgcttttcttaccaaattctttaggttttcttaaatagatgtttcttcatttgcttatgaccttaaaaccattcctagaggccttaaatttgttgttgttgttgtttaaattttatcagtttagctggggtgctggtttgaagagcttcccactgtcatttcagaaattgatttctaaatatactttttataaggctatcatttcttatgtttttatgaatatgttaaaatgtgaatcttggggctcatttttcaacacatagaagttacttccgtctgagcatttaaaggagaagtattgatgaatatcaagaatgaaaccaccaatcaattaatgcaaaattgttttcaacaccttctttattttattatattactgatctgtgtaggatgcattaaagcaattacaagtagactacaaaatacaagttgactgtatgattatgtttaaagaaacaaatatacccaagagagtgttgatggtatggattaatgtcattttgggataagatttatagtcacatggagaaaagcttagtgtcttttaatggtttggatagaaatatagaagataatgcttgttggtttgtcagtggcagacagaactgtcctatagatagagatgttactttcccttctgaggcaatcataagcaatgttgagtctggatcttatagaagagttttggcagtgtgtcttctatttgcttaaatatctcatgcaggtaggtccctttagttttaatattttgtgttccttttataggttgagctttttcataaagatatagaagctttcaaagaagaatataaaacagcctcattagtagatcaatcacaagtcagcctctatgaatattttcatatatctcctatcaaggtaggagaaagtcatttttattgtccttgataatctaggtaatagcaaattgatgtagcatttatattgtgttcttcagtaatatataaaatctgtaaatatacaattaaactaagtaacaaaggaattacccttttacatttttatttatttttaaataactttttatcatgtggagccacctatagcatgtatttatgtttataatttgacctaacattattttaccttgattttctgttaagctgttaggtgacaattttcaaaattttgcatatgatgatttgtgtattagttttaaagtaatttataaagtagccttaagaactgaagactgaatggtatcaaatctaagttagtttttagtgcaaaattcctataagctaattatacaataatagaagaaaattactaaacaaccatatatgtagagtatatatgcaatacaatacaaaagtgttttttaactggctattaacttctgaaataattgaaacatatacttttggagatacaaatacctttcagcttatgacagagttacatctcagtaaagccatcatgagttgaaaatcttgtaagtcagaaatgcattgaatacacctaacctactgaacattaaagcttagcctagcctgtcttaaacatgctcaaaacagctgggcaaaatcatctaacacaatgcctattttctaataaagttattataaagaattttgaatcaaaattcaaagtacagtttccactgaaggtgtattgcttttgcagcattgtaaagttgaaaaatcataagtgaaacataagtcatataagttggggaccatatgtatttgagtcattttcaacagcttcaacttttagatttttaatgttattaacaaatatataaaaattaatattttcttaggtttgccaaaagaatgggataggattaaatatcatgctatcttaaattgttgaattgaagatttaaatagagctatgttagattttaaatttcttcatatttctacttagtgattttaacataatccagataactttgaaatcttatttatggtgtagtgaatttaaaattaaactgattttttaagagttaaaattgtcaatatgaagaaaatacttttaaatatttatctctttatctttttagttacatttaagtgtttcactgagttccggcagagaagaagctaaagattcaaaacaaaatggaggactgattccagttcattctttaaatcttttgctgaagagtattggtgccacactgacagatgtacaagatgtagtttttaagtatgtttagtattcaaatctgtaaattgatggaaatatttctattttatatgtccctaaaaatttcgtaaatgaaaaagtgtgtgaagtacgttgcagatcataggcaaaatgaggtttttgcattcaagtgaagtgcaatctgaataacaccaacgtatgatttgctaacccctaattgctaaattacagaattattaaacaatttccttaagaaaaagagtcataggccatgcaagtttcacattttaaaagatctttctggcttagggaaggataggatgtgtatgcccaaagatatggtgcctgaaatgtatggatttgaagctaataggaataagactcttcaaagcatttgcaactagaacagaatgaatgcgataataggggaaatgaaaggatcaactttaagtgttgtaatcaggaatttatattttaatatgagtcataatgaagcttatagagtatctgaccaaagagattcagaatgtctgagttgagactttagaagagaataaccctttcaagtagcatctagaattgattattaagaacagtcgtaagaatcaataagtccaacacgaggtaacactgaacctgaagttaggtaagtgtcaaataaaagtacacaggtatgatgttagcagaaatagtattctacttagcaacaagaagcatagagcttttcagttactgtatcaggtatatgctatggatgggttataagtaagctaatcttagtatatattctgtgaatggagttataagtaagcaggcaaaacctgctgcagctgaacctggccattcgtgagcaacctctttatcagtgtgtcagacattttctatgtgggccatgataggacagaattgggaaataaagttctagtggtacatgaatgggattcacaggatctcagaactctcgaatttacatgaaaatttatgtgtactggtgacttgtctgaagataagatccatgtcttttatcagattcttagaaggttctttgattaggatatgcagagatgtatgtaaaaagtaaatttcctgattggcatgggaaaatgtactagaaggaaaggtttggagaaaagattctaaagaaaataaagccactcattaatattaaaaatactttcttcatacacatgtacagacaatatatttttacgcttttttcaggcttgcattttttgaactcaactatcagttccatacaacatccgatctacagtctgaagtcataagacactattcaaaacaggtttgtctaagattatattacagagggacagagtgatacagactggtaaaaccttttgtgtctatacatatataatgtggaactattgaggaactaaatagccattttcaaattattaaagcatgggtattttcctcagaattataaaaagaaattaagctcaatcactatttgaattttttgtccttatattttttagccactgagagaaattttttgtggatcagcaggactggaaataaataaatctttaaataaaatattaactaatttatcacacttaattaaaaaatgggttcatggaaactattagtaactaactgatgaacacgggatatttttagtgtaactagttgttaagtcagccagatgtatttttttaacagatgtttttccacttctagagagactcttgggttttaggatataacttagagtatctgatatagctgtggtatgacagatcactgagcatgactcaggagatttggatttctcccacttttgccatatacccactatgtgaccctgagtatcatctgacttatatgtttctccaatctataaaacggtggtggtaatgacagtggtcacagataattgtaaaagtgaaagtattttaaatattctagagctttacatgaatataatgtcatattatttttaatactataataccaaattactttttaaaagctaagaatagcgatcaataagcctggcatggtggctaacgcctgtaatcccaacactttgggaggctgaggctggtggatcacttgaggccaggagttcgagaccaccctggccaacatggcgaaaccccatctctactaaaatcacaaaaattagccaggcatggtggtgcatgcctgtagtcccagcttgggaggaggaggcacaataattgcttgaacccgtgaggcagaggttgcagtgagccgagatggcgccaccgcattccagcctgggcaacagagcaggactgtctcaaaaagaaaaagaaaaaaaagagtagtgattaataaaatgagatggtttaggagttgaaattggcattaaaggtgttggcctgagaaaactgggcgtgtgttttaaataatgtataagaaaaaatagatctaattatctgaattgattaatgttcatattttatttttaggccattaagcagatgtatgtactcattcttggacttgatgttttgggaaatccatttggcttaattagagaattttctgaaggtgtagaagcatttttttatgaaccttaccaggtaaaatagttatttttgtggttgtgcaatatgtcactaatacttttgaatagataatacttttctattgttaagttgagttaataagtgcaaacagattttggaacacacacaaaaggacatcattttgcagcaaacaatggtaagaggttttgggggacatttttacccttttcctcaaaatttaaacttaagattttgttaagctacgctgaattgtaagtgttctcttggaatataaaaggtggataaagtagaaagaagatcaccacatcttgctttgcacagtagtgtggaactataaaaataatcatgcaaactgacacctggccaagcaatcttaaaaatcagtgggaaaaattatgattgttctatgtcctttaaaactttttcccaaaagactcctacttccacgtataaatgtatagggaaataaaaaataaagttaacattaattttgcacattgtaattaaaaacattaaaagcattaagaattttaaagtgtttatttgaaatttttattaaagacttatcaagagtagtttgaactgtgcttgcattttgctcataaacttacaatatggaccaagcacctttctgtactttggtgagttgccgtactcctttctaagggtcagcgtctaacattatatccttcacactttcagcgtccagaaatatccctaggaattcttttaatgtgaaactttttgctgatattacttcctctgggacaacattatccatttttgttactacctctttcgtcgtatatatccgtaagctcatctttaaaagtgaatataactcactcactcatttatttactatttggccctttagggagccatccagggtcctgaagagtttgtggaaggaatggcactaggacttaaggcactagttggtggagctgttggtaagaaacagaatatctaccaagtatttttgtgctagaaagtaatggcatcattacttttactaaagataatttctgtcaggtggattggctggtgctgcctccaaaatcaccggtgctatggctaagggggtagcagctatgaccatggatgaagactaccaacagaagagaagagaagccatgaataagcaaccagctggttttagagaaggcatcactcgtggaggaaaaggcttagtttctgtaagaaatttcacagggttgtgaagattttgggaaatatcttttaaacaaacctacatttgcgaataaggaaatagacatgattctcactccttaaattattatttggatattttaagagcagtgggtggtagcatataaaacatgtcagtagcctctaaaacattctgtttaaataaaatacttaggagatctgttaattcttatgctatataaaaagcagaactctgtattttttgtgtaatccaaacttggttcttctaggcatcataaaaaagtattgtaaattttcagttgtgttttccttctagggatttgttagtggcataacaggaattgttacaaaaccaatcaaaggcaagtatagtagttcctttgcaagtctttctaagttgattctgttttcattcttggatgcaattgtcaaaaactcttttttctttccaggagctcaaaaaggaggagcagctggtttctttaaaggtgttgggaaaggtttagtaggagcggtagcaaggccaactggaggcatcatagacatggctagcagtacatttcagggaataaaaaggtaaatcctctttggtgtaagatatgagttaaaatgctgaagccatgagaaatggaatttatctgctctttggcttcaggcatttagttattgtctttgttttgtgctgctataacataccacataataccacagactgggtaatttataatgaacagaaatttattggctcacggttctgaaagttaagaagtccaagattgagaggcaacatctggctagggcctttttgcggtgtcatcccatggcagaaggacaaaaagagggcaagagaagaaaaaagggaaccaaagtcacccttttataaggaacccactcccacagcaacagtattaatgcattcatgggggcagatcctcatggcctaattacctctaattaggccccacctcctggctggggataaagtttccaacacatgctcttggagggacacattcaaaccatagcagttaccagcactacaatatggcaggttgcatatggtcttcctaattcattttgattttttttttttattattatactttaagttttagggtacatgtgcacattgcgcaggttagttacatatgtatacatgtgccatgctggtgcgctgcacccactaactcgtcatctagcattaggtatatctcccaatgctatccctcccccctcccccctccccccaccccacctgtgatattccccttcctgtgtccatgtgatctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacgttttcttaatccagtctatcattgttggacatttgggttggttccaagtctttgctattgtgaataatgccgcaataaacatacgtgtgcgtgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagttttcctatttctccacatcctctccagcacctgttgtttcctgactttttaatgattgccattctaactggtgtgagatggtatctcatagtggttttgatttgcatttctcggatggccagtgatgattagcatttttgacaaaattcaacaacccttcatgctaaaaactctcaataaattaggtattgatgggacgtatttcaaaataataagagctatctatgacaaacccacagccaatatcatactaaatgggcaaaaactggaagcattccctttgaaaactggcacaagacagggatgccctctctcaccactcctattcaacatagtgtcggaagttctggccagggcaattaggcaggagaaggaaataaagggtattcagttaggaaaagaggaagtcaaattgtccctgtttgcagacgacatgattgtatatctagaaaaccccactgtctcagcccaaaatctccttaagctaagaagcaacttcagcaaagtcttaggatacaaaatcaatgtacaaaaatcacaagcattcttatacaccaacaacagacaaacagagagccaaatcataagtgaactcccattcacaattgcttcaaagagaataaaatacctaggaatccaacttacaagggatgtgaaggacctcttcaaggagaactacaaaccactgctcaaggaaataaaagaggatacaaacgaatggaagaacattccatgctcatgggtaggaagaatcaatatcgtgaaaatggccatactgcccaaggtaatttacagattcagtgctatccccatcaagctaccaatgactttcttcacagaattggaaaaaactactttaaagttcatatggaaccaaaaaagagcccgcatcgccaaggcaatcctaagccaaaagaacgaagctggaggcatcacactacctgacttcaaactatactacaaggctacagtaaccaaaagagcatggtactggtaccaaaacagagatatacatcaatggaacagaacagagccctcagaaataacgccgcatatctacaactatctgatctttgacaaacctgacaaaaacaagcaatggggaaaggattccctatttaataaatggtgctgggaaaactagctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtccaaaacaccaaaaacaatggcaacaaaagccaaaattgacaaatgggatctaattaaactaaagagcttctgcacagcaaaagaaactaccatcagagtggacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaactcattttgatattttttaagttgctgccattgcattgtttcaactttatgaagttcccctttatttttcattcattcctagcaggcttgcaggagcagtttggcaagttaagcaagcttttcagttatcttagtttaaatacattaatgctatatatcaattataaaattagcaaatataatctgtatcctttttatgaaatgaagaatggcattttgtatttcttggttcaaactcagtttgtcttcacccttcctttattatcttattttgttataagttgttatagtagtccctcttgatctgcagggatctgcagtggatgcctgaaaccttggacagtacttagccctatatatactgtgttttctcctgtacatacatatccgtgatgaagtttaattttaaattaggctcagtaagatattaacaataataataaaataagacaattataacaatatactgtaatgaaagtaaaataaacgttacttgaacacaagcactgtaataccgcaatagtcaggatgataactgagacagctactatgtcactaatggactggtgatgtataaagcatggatatgctggacagagggatgattcatatcccaggaaggacaaagcagggtggcaagaaattttatcatactactcagaatggcatgcaatttaaaatgtagggattgtttatttctggaattttccatttaatatttttggaccacagttgactgtggataactgacactgcagaaagcagaactgtggataagcggatactagtgtatatgcatatcctttctcttcctttatgcaggtaattttaatacacattgttttttactccaaatgaaatttagtgtaagggtgaaatttagtagtttctttattgttacctgtgtcttagaaatttgtaacacatataacagatgataaaattaatgttaattagacccatcttagaaagttaggtgggtggctgtcttcctaatctttttcctttgtgttttctcttgctttctgctctatagggatatgtattgtcatcatatgagctattcctcttaagccagtatttcatactggttaccataattgggtgtttctggtttcggcatttagaattaaggtgggggaaaaaggaatcattctcctctacctgtaactttaagtttcataaatataatgtgttgagtcgtagtcatcagagaagctcaaaagtcaatgaaacgtaaggaatttgaaacatatgaaggcttctttcaaaagctgctagaattaccttctgtttatctaaaaccttataattctgtacccaggtatattacctttagggattgagggcacaatgaaacatttttagaaaaaataataaagactaagaactattgaaggatgtacctgtgaaaaaagacactgaaagtaaaaggaggaatgggttacaagattcaaagataaaaatataaattggataaatctaattgagctacatgaaagcaacattggaaacattattaaaacataataaaatgcaatttggggagagaatgattggcattaaatattgtcctatttgtaaagaggatgtatttactaatattaggtgaaacagacattaaggcaataaaagcattatttgggataaataaggtaattaggtaatgataaaaagaactaagtaggaagatagtaacaatttcaaacttctactcagttcataaaatagccttaatttttaaaagcacaacttgacaaaactgtaagaacttttcaaatgtacaacaaaggtggaagaacttaatatttttctcaataattgatagatcaggaagacaaaataaaagtaagtaaataattatctgaatagagttaacaagctacctaatacaaacataaataattattcagcacattttagggagcattgtctatgatctagacacttctctaatcacttgagggaccagcaatgaacacaattggcaatggtcctgtgttcatacagcttacattctagtgggagagtaatagacaaaaataagtaactgataaatatatgatatgctaaatggtgaaaaatgccatgaagaaaaataaagcagattaaaggaggtaaggagatgcaaaatggtagggaggagggttgctattttacatattcagtgatcagggatgcttaactcataagattatatttgaggagagacctgaaagaagtaaagggtgagccatgtgagaagaatgtcccaggcagaaggaacagcagttaaaaagccctgatgcaagaatgtgcttggcctatttgagaaacagcaagactagtttgcctggagtagagtgaggaacggggaaagttgaagaagatgttaccagggaacatgcggggaatcacatctcgtagaactcggcaagcccctgtaaggacttaggcttttgcttaagatgagaggccattgaaaggtttcaagccagagaaatgatgtgagctggctgctgcattgaggcgtaaccacaggggattagggcagaaacaacacttaaaaggcttttgcagtaatccaagtgagtgacaatggtgattcgactattagagtactagagattatgtcctgcatgtattttaaagatagtggcaatagcattagttgataaattggatgcaggatatgaaagaaagagaatcgtgaagaataattctaaagtttttatgtgtagtactggaagggtgaggttgtcgttctttttagggaaagggtattagacatttccttttgaatatattaagcttaaaatatctcttagacatccaaatggagacatcacgttattgttgagtagaggagtttgaagtatagagaaaggtccaagctagaggtaaaaattcaagatttgtgagcctataataaggtatttgaaaccatgagattggatgagatcaccaagggaatgagactgaaaagagaaaaataaggtccaaggacttggctttcaggcacaccaactcttagaagttggggaaatgaggaagacccagaaaaggaggctaaaaagaaatggtcattaagttacctaaaaaattttagggtcagtttgtcaatttctacaaaaaaggtagctaggattttgatgcagatggcattgaatctgtagttcaatttggggagtgtagccatcttaacagtattatcttttaacctgtgaaaatgcaacgtctttccatttatttaggtcttcttgaattgctttcaataatgttttatagtttgtaatgtacgagtcttatacttctttttaaaaacttattcctaagtatttttgatgctgtttttttttttttttttttttttttttgagacggagtctcgctctgtcgcccaggccagactgcggactgcagtggcgcaatctcggctcactgcaagctccgcttcccgggttcacgccattctcctgcctcagcctcccaagtagctgggactacaggcgcccgccaccgcgcccggctaattttttgtatttttagtagagacggggtttcaccttgttagccaggatggtcccgatctcctgacctcatgatccacccgcctcggcctcccaaagtgctggtatgctgttttaaatggaattgttttcttaattttattgttggattgtttattgctggtgtgttgaatacaactgtttttctttatatttgagtttctgcaatcttactgaacttgtttattagctctaatggttttgtggattcttttgggttttctatatgtaagagtatatcatctgagaactgaggtaactttacttcttcctttctgatctggatgctttttttcttgcctagttgtcctggctagaacctctagtacaatgtgaagtagaagtgctgagagaatagacatgcctatattgcttttaatcttagggggaaagctttcagatgttcaccattaaatgtgatgttagctataggtttttgtgtctttatcatgaaaacatgttagattttatgaaacgctttttctgtataattaagttgatagttggtttttcctttgtttcactaatgtagtatattacattaattgagtcagatcttaaactaatattgcatacctgggataaatcccatttggacataatgtgtaatcgtttttatattttactggatttggtttgatagtattttgttgaggatttttgcatgtatatttataagggatattggtctgtggttttcttgtgatgtctttgcctggtatgggtatcagggtaatattgtcctcacagaatgatttaggaagtgttccctcctcttcaaatttttggaagactttgtggagcgttgatgttaattaaaaaaaaaatttggagaattgatcagtgaaaccgtctgattcttacttttatttctggtgagttttaaaatgacaaattcactctctttacttggtaaaggtctagttaggctgtttcttgagtcattgtcagtagtttttataggaatttgttcaattcatctagatgttctaatttgttgatatatatttattgatcatagtaaatatttactagtattctcatataattatttttcccttatatagtatttattcctagtattcccttataattattttttgtttccataagattggtagtagtgttccctctttaattcctgttattcataatttgggtcttcttttttttcttggtcagtttagtgatggcgtgtcatttttgttgtccttttcaaagaaccagtttttagtttcattgattctattttttctattctctatttcttttatctctgctctaatttttattattttcttccttctgctagctttgggattagtttgctttttctactttctcaacttgtgaagttatattattgatttcagaccttcttttttaatgtagacattcacatctataaatttccctctgagcactgtctttgctgcatcttataagttttggtgtgttgtatttttgcttttatttgtttcaaagtagtgaatttcttttgtgatttttttctttgacattttgttatttatgcttctatgttttaatttccacacacttgtaaatttcataaatttctcttatttacacatttctagttttcttccatgtggtcaggtatcatacttgtatattttcagtccttttttttttttttttttttttttgtgagatagagtctcactcttgtcacccaggctggagcagtggcgtgattttggctcactgcaacctctgcctcccaggttcaagagattcccctgcctcagcctcctgagtagctgggattacaggcacacaccaccatacccagctaattttttttttttttttttgagacagagtttcactcttgttgcccaggctggagtgcaatggcgctatctcagctcaccgcaacctccgcctcccaagttcaagctattctcctgcctcagcctccctagtaactgggattacaggcatgtgccaccacacccggctaattttgtatttttagtagagacagggtttctccatgttggtcaggctgatctcgaacttccgacctcaggtgatctgcccgccttggcctcccgaagtgctgggattgcaggaatgagccaccacgcccggccatttttgtatttttagtagagatggggtttcaccatgttggccaggcttgtcttgaactcctgacctcaagtgatctgaccacctcggcctcgcaaagtgctgggattacaggcatgagccaccacgcctggcctattttcagtagttttatatttacattcaatgttagccaaaaggccaagaagcaaacagtaattttatattattgagacatgttttatgacctaatagatagctaatactgaataatgttccgttgcacttgagaagaatatatattctgttgttgttggtttgaacgttctatagacatctgttgggtctagtggattatagtgttattcaagttctcttttttccttgctgatcttttatctagttggtatccatttttgaaagtaggttgctgaaatcttcaactattatggtggtattgcctttttgtcttttaaattcttagtttttgttttgtgtatttggggcttcttttattagctgcttatatgtttataattttttatctttttgatggattgacccttttttccttataaaatgcccttctttgtgtctaataagaatttttttaaaggctgtttttttctgacattagcatggccactttagctttcttttagttactgttcactttgcatatattttctcctttttagttgcaaccagtttgtgtctttgactctaaatcaggtctcctgtggatagtatattgttagatcatattttttttatctattctgtttttatttttttacttatgtatttattttttgagatggagtctcgctgtgtcgcccaggctggagtgcagtggcatgatctcggctcactgcaacctccacctcccaggttcaagtgattcttctgcctcagcctcccaagtactgggactacatgcacatgccaccacgcccggctaatttttgtatttttagtagagacagggtttcaccatattggccaggctgatctcgaactcctgacctcatgatccgcccgcctcgggctcccaaagtgctgggattacagacatgagccaccacacccggccctattctgttttcagttggagaatttattcatatgtatatgcccatgcatgtgtatacattatgttagcggtccccagccttttaggcatcaaggtctggtttcatggaagacaatttttccacagaccagacaggagggataatttcaggatggaactgttccacctcagatcatcaggctttagttatattctcataaggagtgtgctacctagatcccttgcatgtgcagttgacaatagggttcgccttcttatgagaatctgatgccgctgctgatatgacaggaggtggagctcaggcagtgaaacttgcttgccactactcacctcctgctgcacgactcagttcctaacaggctatggaccggtactggttcaagtcccatgggttggggacctcttaataaatatttgttgaatatgtgatacttgttgagtgaacaaattgagtggtcacttatgaccaaataagcaaaaatgttaaatataatactaccatacacaatttagccgtatgtggtatgtgttttttggttttttgtttgtttttagacagggtctcactctggcatcctgattggagtgcagtggcatggggctcaaactatcctcccacctcagccttctgagtgtctgggacttctgctgcataccaccatgtctgactagtttttttatttttttgtagagcagtgtatgctgcccaggattggggtatgtgtttacagtaatacacatcaagcccagtaagaatgtgaggactgtgagagtatttgaatattagaaaactatataatgtgatttataacattaatagattaaggaaaatataccatgtgatcaaaacaatgccagaaaagaaattcttatttaaaattcattgcctatttaagattttcaaaaacagtaacaaaaaagaactgttggtaaactaaaagtagcaatgaactttcttgacttgttaaggggtgctttaaaaaaaaaaagttgctgataactatacttcacagaaaactcttagaagctttccgtagggtcaggaatgagacaaggatgcttgcaatccctttttgtttatagcattatactaaagaaactagacaacgtaataggaaaagaaaaagcaacaattgctaatattgtgattattatcacaaagaaagttctagagacttaaacttctctatagttctgtatttttctagagaacttacactgtttatgttacaaaaacaatttaaaattagagaatgttgtaatatttttaatctgaaataagattgtttttagtaattgcattttatagtttatttacaagtttttgaataatttttaaaataaagttatattttttttcctctagagctacagagacttctgaagtggagagtctgcgacctcctcggttcttcaatgaagatggagttatcagaccgtacaggttgagggatgggactggaaatcaaatgttacaggtaaattaagagctatcttataaattaagattaatttagtcaagttagattttttttaagtagccatttaatatatattaaattatttgggcttttatctattttgcttaattccacttataagtttcttatatttacttagattttaaagtacatttatttactataagatttttttttcttttttacaggcatcaaaaagtttgatatgaaaagttaatgcatgactttgcaagtgaaagccaacagtagattttagtcttaaaatttacaaactacgtacagctgtttcagtattttgaatacaaagaaaaccttttgtattggtaacttttaataggaattttaatgaatctggtttttttatagggtgttcttagttctgcactggatttgctagatttgttggaagcctttgtaccttatgtatcctcgtcattggtggtacttacttaaccaattaaaccatttctgttgtggggttattaaaccactggtagcttttataccagatatataatccttatatccaattacacatgaagaaggaaaagcaaaactcaggaacactgctattgtgaattactcttggattcttgtgctttgcctttgaaaatgcttaaatggccatgaccctcttcctgctttattctagtgtagtctttataaaacttgtgggatttgataagcagttcacatgcaaaccagtatcttttaataatacaaagtagcatctggaacaatagacagtttgaagttagaatctgcttagacaactttcttacttggtaaattcgactttttaaaacctggattatgctgtaggtaactagtaatcatatataggctataccagtgtcatgttgtttctgtggtttagaggtggaatactaaattaaatcatttgtttgaaaacaa
